US010995327B2

(12) United States Patent
Chittoor et al.

(10) Patent No.: US 10,995,327 B2
(45) Date of Patent: May 4, 2021

(54) CRISPR-ASSOCIATED TRANSPOSASES AND USES THEREOF

(71) Applicant: MONSANTO TECHNOLOGY LLC, St. Louis, MO (US)

(72) Inventors: Jaishree M. Chittoor, Wildwood, MO (US); Ervin Nagy, Lake Saint Louis, MO (US)

(73) Assignee: MONSANTO TECHNOLOGY LLC, St. Louis, MO (US)

( * ) Notice: Subject to any disclaimer, the term of this patent is extended or adjusted under 35 U.S.C. 154(b) by 109 days.

(21) Appl. No.: 16/066,996

(22) PCT Filed: Dec. 29, 2016

(86) PCT No.: PCT/US2016/069221
§ 371 (c)(1),
(2) Date: Jun. 28, 2018

(87) PCT Pub. No.: WO2017/117395
PCT Pub. Date: Jul. 6, 2017

(65) Prior Publication Data
US 2019/0093090 A1    Mar. 28, 2019

Related U.S. Application Data

(60) Provisional application No. 62/272,441, filed on Dec. 29, 2015.

(51) Int. Cl.
*C12N 9/22*    (2006.01)
*C12N 15/82*   (2006.01)
*C12N 15/10*   (2006.01)
*C12N 15/11*   (2006.01)

(52) U.S. Cl.
CPC .............. *C12N 9/22* (2013.01); *C12N 15/102* (2013.01); *C12N 15/11* (2013.01); *C12N 15/8241* (2013.01); *C12N 2310/20* (2017.05); *C12N 2800/80* (2013.01)

(58) Field of Classification Search
None
See application file for complete search history.

(56) References Cited

U.S. PATENT DOCUMENTS

| | | |
|---|---|---|
| 5,106,739 A | 4/1992 | Comai et al. |
| 5,322,938 A | 6/1994 | McPherson et al. |
| 5,352,605 A | 10/1994 | Fraley et al. |
| 5,359,142 A | 10/1994 | McPherson et al. |
| 5,378,619 A | 1/1995 | Rogers |
| 5,530,196 A | 6/1996 | Fraley et al. |
| 5,580,859 A | 12/1996 | Felgner et al. |
| 5,589,466 A | 12/1996 | Felgner et al. |
| 5,593,972 A | 1/1997 | Weiner et al. |
| 5,641,876 A | 6/1997 | McElroy et al. |
| 5,837,848 A | 11/1998 | Ely et al. |
| 5,850,019 A | 12/1998 | Maiti et al. |
| 6,051,753 A | 4/2000 | Comai et al. |
| 6,140,078 A | 10/2000 | Sanders et al. |
| 6,175,060 B1 | 1/2001 | Lefebvre et al. |
| 6,177,611 B1 | 1/2001 | Rice |
| 6,232,526 B1 | 5/2001 | McElroy et al. |
| 6,252,138 B1 | 6/2001 | Karimi et al. |
| 6,294,714 B1 | 9/2001 | Matsunaga et al. |
| 6,426,446 B1 | 7/2002 | McElroy et al. |
| 6,429,357 B1 | 8/2002 | McElroy et al. |
| 6,429,362 B1 | 8/2002 | Crane |
| 6,433,252 B1 | 8/2002 | Kriz et al. |
| 6,437,217 B1 | 8/2002 | McElroy et al. |
| 6,635,806 B1 | 10/2003 | Kriz et al. |
| 7,151,204 B2 | 12/2006 | Houmard et al. |
| 9,121,022 B2 | 9/2015 | Sammons et al. |
| 2014/0357523 A1 | 12/2014 | Zeiner et al. |
| 2015/0197759 A1 | 7/2015 | Xu et al. |
| 2016/0208243 A1 | 7/2016 | Zhang et al. |
| 2017/0173086 A1* | 6/2017 | Boyle .................. A61K 35/741 |

FOREIGN PATENT DOCUMENTS

| | | |
|---|---|---|
| WO | WO 2011/112570 | 9/2011 |
| WO | WO 2015/131101 | 1/2015 |
| WO | WO 2016/196738 | 12/2016 |
| WO | WO 2016/196782 | 12/2016 |

OTHER PUBLICATIONS

Bland et al., "CRISPR Recognition Tool (CRT): a tool for automatic detection of clustered regularly interspaced palindromic repeats," *BMC Bioinformatics*, 8(1):209 (2007).
Chylinski et al., "Classification and evolution of type II CRISPR-Cas systems," *Nucleic Acids Research*, 42(10):6091-6105 (2014).
Louwen et al., "The Role of CRISPR-Cas Systems in Virulence of Pathogenic Bacteria," *Microbiology and Molecular Biology Reviews*, 78(1):74-88 (2014).
Partial European Search Report dated Apr. 24, 2019, in European Patent Application No. 16882665.9.
Bevan et al., "A chimaeric antibiotic resistance gene as a selectable marker for plant cell transformation," *Nature*, 304:184-187 (1983).
Callis et al., "Heat Inducible Expression of a Chimeric Maize hsp70CAT Gene in Maize Protoplasts," *Plant Physiology*, 88:965-968 (1988).

(Continued)

*Primary Examiner* — Brent T Page
(74) *Attorney, Agent, or Firm* — Arnold & Porter Kaye Scholer LLP; Amanda Carmany-Rampey; David R. Marsh

(57) ABSTRACT

Provided herein are systems, methods, and compositions for the modification of target DNA sequences. More particularly, systems, methods, and compositions for editing genomic DNA in eukaryotic cells with a CRISPR-associated transposase are provided. Also provided are vectors and vector systems which encode one or more CRISPR-associated transposases, as well as methods for the design and use of such vectors. Also provided are methods for identifying and validating novel CRISPR-associated transposases.

18 Claims, 12 Drawing Sheets

Specification includes a Sequence Listing.

(56) References Cited

OTHER PUBLICATIONS

Chan et al., "'Deadman' and 'Passcode' microbial kill switches for bacterial containment," *Nature Chemical Biology*, 12:82-86 (2015).
Chandler et al., "Two Regulatory Genes of the Maize Anthocyanin Pathway are Homologous: Isolation of B Utilizing R Genomic Sequences," *Plant Cell*, 1:1175-1183 (1989).
Chen et al., "A highly sensitive selection method for directed evolution of homing endonucleases," *Nucleic Acids Research*, 33(18):10 e154 (2005).
Cho et al., "Lipid-like nanoparticles for small interfering RNA delivery to endothelial cells," *Advanced Functional Materials*, 19:3112-3118 (2009).
Depicker et al., "Nopaline Synthase transcript mapping and DNA sequence," *Journal of Molecular and Applied Genetics*, 1:561-573 (1982).
Dey et al., "Toward a 'structural BLAST': using structural relationships to infer function," *Protein Sci.*, 22(4):359-66 (2013).
Dumitrache et al., "Trex2 Enables Spontaneous Sister Chromatid Exchanges Without Facilitating DNA Double-Strand Break Repair," *Genetics*, 188(4):787-797 (2011).
Ebert et al., "Identification of an essential upstream element in the nopaline synthase promoter by stable and transient assays," *Proc. Natl. Acad. Sci. USA*, 84(16):5745-5749 (1987).
Edgar et al., "Search and clustering orders of magnitude faster than BLAST," *Bioinformatics*, 26(19):2460-2461 (2010).
Geissmann, "OpenCFU, a New Free and Open-Source Software to Count Cell Colonies and other Circular Objects" *Q. PLoS One* 8(2):1-10 (2013).
Guo et al., "Directed evolution of an enhanced and highly efficient Fok1 cleavage domain for Zinc Finger Nucleases," *J. Mol. Biol.*, 400(1):96-107 (2010).
Hickman et al., "The casposon-encoded Cas 1 protein from *Aciduliprofundum boonie* is a DNA integrase that generates target site duplication," *Nucleic Acids Research*, 43(22):10576-10587 (2015).
International Search Report and Written Opinion dated Jun. 6, 2017, in International Application No. PCT/US2016/069221.
Kapitonov et al., "ISC, a Novel Group of Bacterial and Archaeal DNA Transposons That Encode Cas9 Homologs," *J. Bacteriol.*, 198(5):797-807 (2016).
Karvelis et al., "Rapid characterization of CRISPR-Cas9 protospacer adjacent motif sequence elements," *Genome Biology*, 16:253-266 (2015).
Kleinstiver et al., "Engineered CRISPR-Cas9 nucleases with altered PAM specificities," *Nature*, 523(7561):481-485 (2015).
Kuhlemeier et al.,"The Pea rbcS-3A Promoter Mediates Light Responsiveness but not Organ Specificity," *Plant Cell*, 1(4):471-478 (1989).
Lawton et al., "Expression of a soybean B-conclycinin gene under the control of the Cauliflower Mosaic Virus 35S and 19S promoters in transformed petunia tissues," *Plant Molecular Biology*, 9(4):315-324 (1987).
Lewis et al., "Efficient delivery of siRNA for inhibition of gene expression in postnatal mice," *Nat. Genet.*, 32(1):107-108 (2002).
Marcotte et al., "Abscisic Acid-Responsive Sequences from the Em Gene of Wheat," *Plant Cell*, 1(10):969-976 (1989).
Nuñez et al., "Foreign DNA capture during CRISPR-Cas adaptive immunity," *Nature*, 527(7579):535-538 (2015).
Nuñez et al., "Integrase-mediated spacer acquisition during CRISPR-Cas adaptive immunity," *Nature* 519(7542):193-198 (2015).
Odell et al., "Identification of DNA sequences required for activity of the cauliflower mosaic virus 35S promoter," *Nature*, 313:810-812 (1985).
Reich et al., "Small interfering RNA (siRNA) targeting VEGF effectively inhibits ocular neovascularization in a mouse model," *Mol. Vision*, 9:210-216 (2003).
Schaffner et al., "Maize rbcS Promoter Activity Depends on Sequence Elements Not Found on Dicto rbcS Promoters," *Plant Cell*, 3:997-1012 (1991).
Schroeder et al.,"Lipid-based nanotherapeutics for siRNA delivery," *J. Intern. Med.*, 267(1):9-21 (2010).
Shen et al., "Gene silencing by adenovirus-delivered siRNA," *FEBS Lett.*, 539:111-114 (2003).
Shmakov et al., "Discovery and functional characterization of diverse Class 2 CRISPR-Cas systems," *Molecular Cell*, 60(3):385-397 (2015).
Siebertz et al., "cis-Analysis of the Wound-Inducible Promoter wun1 in Transgenic Tobacco Plants and Histochemical Localization of Its Expression," *Plant Cell*, 1(10):961-968 (1989).
Simeoni et al., "Insight into the mechanism of the peptide-based gene delivery system MPG: implications for delivery of siRNA into mammalian cells," *Nucleic Acids Res.*, 31(11):2717-2724 (2003).
Sorensen et al., "Gene Silencing by Systemic Delivery of Synthetic siRNAs in Adult Mice," *J. Mol. Biol.*, 327(4):761-766 (2003).
Takebe et al.,"SRa Promoter: an Efficient and Versatile Mammalian cDNA Expression System Composted of the Simian Virus 40 Early Promoter and the R-U5 Segment of Human T-Cell Leukemia Virus Type 1 Long Terminal Repeat," *Mol. Cell. Biol.*, 8(1):466-472 (1988).
Thompson et al., "CLUSTAL W: improving the sensitivity of progressive multiple sequence alignment through sequence weighting, position-specific gap penalties and weight matrix choice," *Nucleic Acids Res.*, 22(22):4673-4680 (1994).
Wang et al., "Restriction-ligation-free (RLF) cloning: a high-throughput cloning method by in vivo homologous recombination of PCR products," *Genet. Mol. Res.*, 14(4):12306-12315 (2015).
Xia et al., "siRNA-mediated gene silencing in vitro and in vivo," *Nat. Biotech.*, 20(10):1006-1010 (2002).
Yang et al., "Maize sucrose synthase-1 promoter directs phloem cell-specific expression in Gus gene in transgenic tobacco plants," *Proc. Natl. Acad. Sci., USA*, 87:4144-4148 (1990).
Yin et al., "Structural basis for the modular recognition of single-stranded RNA by PPR proteins," *Nature*, 504(7478):168-171 (2013).
Zetsche et al., "Cpf1 is a single RNA-guided endonuclease of a Class 2 CRISPR-Cas System," *Cell*, 163(3):759-771 (2015).
Zhang et al., "A Nucleolar PUF RNA-binding Protein with Specificity for a Unique RNA Sequence," *J. Biol. Chem.*, 290(50):30108-30118 (2015).
Zhu et al., "Efficiency and Inheritance of Targeted Mutagenesis in Maize Using CRISPR-Cas9," *J. Genet. Genomics*, 43(1):25-36 (2016).
Edgar et al., "Search and clustering orders of magnitude faster than BLAST," *Bioinformatics*, 26(19):2460-1 (2010).
Karvelis et al., "Rapid characterization of CRISPR-Cas9 protospacer adjacent motif sequence elements," *Genome Biology*, 16:253 (2015).
Zhang et al., "A Nucleolar PUF RNA-binding Protein with Specificity for a Unique RNA Sequence," *J. Biol. Chem.*, 290(50):30108-18 (2015).

* cited by examiner

Figure 1

CLUSTAL 2.0.9 multiple sequence alignment

```
SEQ-228    MGTETDEHHTVHHRHDTSYRFLLSSKKLFVELLRSFVQKEWVERIDETNVQEIPHSFVLQ
SEQ-231    MGTETDEHHTVHHRHDTSYRFLLSSKKLFVELLRYFVQKEWVERIDETNVQEIPHSFVLQ
SEQ-229    MGTETDEHHTVHHRHDTSYRFLLSSKKLFVELLRSFVQKEWVERIDETNVQEIPHSFVLQ
SEQ-230    MGTETDEHHTVHHRHDTSYRFLLSSKKLFVELLRSFVQKEWVERIDETNVQEIPHSFVLQ
SEQ-232    MGTETEEHNTVHHRHDTSYRFLLSSKKLFVELLRSFVQKEWVKRIDETNVQEIPHSFVLQ
           *****::***:************************:*****:***************

SEQ-228    DFKRKEADLVYRVKLNGQDVVFYLLLEMQSKVDFLMPYRLLLYQVEIWRYLMKDQEKAKG
SEQ-231    DFKRKEADLVYRVKLNGQDVVFYLLLEMQSKVDFLMPYRLLLYQVEIWRYLMKDQEQAKG
SEQ-229    DFKRKEADLVYRVKLNGQDVVFYLLLEMQSKVDFLMPYRLLLYQVEIWRYLMKDQEKAKG
SEQ-230    DFKRKEADLVYRVKLNGQDIVFYLLLEMQSKVDFLMPYRLLLYQVEIWRYLMKDQEKAKG
SEQ-232    DFKRKEADLVYRVKLNGQDVVFYLLLEMQSTVDFLMPYRLLLYQVEIWRYLMKDQEKTKG
           ******************:***********.***************************:

SEQ-228    KPKTFRLPPIVPIVLYNGKRRWTASRQFRQLLANETMFGSELLNFEYVLIDVARYTEEEL
SEQ-231    KPKTFRLPPIVPIVLYNGKRRWTANRQFRQLLANETMFGSELLNFEYVLIDVARYTEEEL
SEQ-229    KPKTFRLPPIVPIVLYNGKRRWTASRQFRQLLANETMFGSELLNFEYVLIDVARYTEEEL
SEQ-230    KPKTFRLPPIVPIVLYNGKRRWTASRQFRQLLANETMFGSELLNFEYVLIDVARYTEEEL
SEQ-232    KPKAFRLPPIVPIVLYNGKRRWTANRQFRQLLANETMFGSELLNFEYVLIDVARYTEEEL
           ***:********************.***********************************

SEQ-228    LALSNTIGSVFLLDQTADQTELLNRLGKLMHTIQQLPEDSQQQLVAWMANILSQKLPENE
SEQ-231    LALSNTIGSVFLLDQTADQTELLNRLGKLMHTIQQLPEDSQQQLVAWMANILSQKLPENE
SEQ-229    LALSNTIGSVFLLDQTADQAELLNRLGKLMHTIQQLPEDSQQQLVAWMANILSQKLPENE
SEQ-230    LALSNTIGSVFLLDQTADQTELLNRLGKLMHTIQQLPEDSQQQLVAWMANILSQKLPENE
SEQ-232    LALSNTIGSVFLLDQTADQTELLNRLGQLMHTIQQLPEDSQQQLIAWMANILSQKLPENE
           ******************:*******:************************:******

SEQ-228    PQLRELIQNVKGGVSVMGLEKTLDAIKREGRREGRREGLREGLREGILEGKQEGKR
SEQ-231    PQLRELIQNVKGGVSVMGLEKTLDAIKREGRREGRREGLREGLREGILEGKQEGKR
SEQ-229    PQLRVLIQNVKGGVSVMGLEKTLDAIKREGRREGRREGRQGLQEGIRE----GKREGIR
SEQ-230    PQLRELIQNVKGGVSVMGLEKTLDAIKREGRREGRREGRREGLR----EGIRE----GKQEGIR
SEQ-232    PHLRELIQNEKGGVSVMGLEKTLDAIKREGRREGRR------------------
           *:*: ***  **************************

SEQ-228    EGILEGKQEGKREAKEEVVKQMIAENLDPDLIARVTGFPLDIITQLREKSH--
SEQ-231    EGLLEGKQEGKREAKEEVVKQMIAENLDPDLIARVTGFPLDIITQLREKSH--
SEQ-229    EGVLEGKQEGKREAKEEVAKQMISENLDPELIARVTGFSLDIIAQLREKSK--
SEQ-230    E----GKQEGKREAKEEVVKHMISENLDPELIARVTGFSLDIIAQLREKTK--
SEQ-232    ----EGKQEGKREAKEEVVQQMIAENLDPELIARITGFSLDIIAQLREKSKSK
           *******:*:.****:**.*:***:********:*:
```

Figure 2

```
                              Putative 5' PAM
                                     ↓
Spacer-1       ------------------------------------GCGTCCTCTTTTATAT  :17
Spacer-2       ------------------------------------GCGTCCTCTTTTATAT  :17
Spacer-3       ------------------------------------GCGTCCTCTTTTATAT  :17
KJ920400.1     TTTTTCCTGTATACAATTCAGCGTCCTCTTTTATAT  :37
HE614281.1     TTTTTCCTGTATACAATTCAGCGTCCTCTTTTATAT  :37
HE614282.1     TTTTTCCTGTATACAATTCAGCGTCCTCTTTTATAT  :37
KJ024807.1     TTTTTCCTATATACAATTCAGCGTCCTCTTTTATAT  :37
NC_029008.1    TTTTTCCTGTATACAATTCAGCGTCCTCTTTTATAT  :37

Spacer-1       AAAAGGAGGAACCTGGT-------------------  :34
Spacer-2       AAAAGGAGGAACCTGGTAG-----------------  :36
Spacer-3       AAAAGGAGGAACCTGGTA------------------  :35
KJ920400.1     AAAAGGAGGAACCTGGCTGATGAAAAATTAATGCA  :73
HE614281.1     AAAAGGAGGAACCTGGCTGATGAAAAATTAATGCA  :73
HE614282.1     AAAAGGAGGAACCTGGCTGATGAAAAATTAATGCA  :73
KJ024807.1     AAAAGGAGGAACCTGGCTGATGAAAAATTAATGCA  :73
NC_029008.1    AAAAGGAGGAACCTGGCTGATGAAAAATTAATGCA  :73
```

Figure 5

MGVTIKIMKYQILCPMNVDWT<u>IFEKHLRNLTYQVRTISNRTIQQLWEFDALSFDYFKE</u>
                      <u>Puf-1</u>

<u>RGTYPTVQDLYGCTQKKIDGYIYHTLQSKYPDIHKGNM</u>
              <u>Puf-2</u>

<u>STTLQKIIKTWKSRRNEIRKGEMSIPSFRNRIPIDLHNNSVDITKEKNGDYIAGISLFSRDFH</u>
                        <u>Puf-3</u>

KENDDVPKGKIFVKLATQKQKSMKVILDRLINQTYSKGACMIHKYKNKWYLSITYKFNAIK

<u>[ENKFDKELIMGIDLGGINTVYFAFNEGFIRSNIKSDEIKMFNERIRQRRIINLLKQSKYCSNS</u>
         ↑D:233                    <u>Puf-4</u>

<u>RTGKGRTKRLQPIDVLSNKIAKFRNSTNHKYANYIVKQCLKH</u>
                 <u>Puf-5</u>

<u>NCGRIQMELLKG]ISKNDRILKDWTY[FDLQEKIKNQAEIHGIEVIKVAPAYTSQRCSQCG</u>
         <u>Puf-6</u>         ↑E:354

<u>YICKENRCTQATFECKQCGYKTHADYNAAKNIS]]TYDIENIINKQLAVQSKLHSKKCMEEYI</u>
                        ↑D:408            <u>Puf-7</u>

<u>EELGYLD</u>

Figure 6

Repeat-1 (SEQ ID NO: 2012): GTTTGGTACTAACATAAGATGTATTTAAAT
Repeat-2 (SEQ ID NO: 2013): GTTAGTACTAACACAAGATGTATTTAAAT
Repeat-3 (SEQ ID NO: 2014): GTTAGTACTAACATAAGATGTATTTAAAT
Repeat-4 (SEQ ID NO: 2015): GTTACCAGTAACATAAGATGTATTTAAAT
Repeat-5 (SEQ ID NO: 2016): GTTTACCATTAGCATAAGATGTATTTAAAT Consensus Puf binding motif    <u>UGUANAUA</u>

**Blue-white selection in *E. coli***

Expression plasmid with region of interest (ROI)

Reporter plasmid with target and LacZ reporter

Co-transform into *E. coli*

Blue-white colony selection

Sequence analysis of white ROI colonies

*In vitro cutting assay*

Expression plasmid with region of interest (ROI) and transform into *E. coli*

Purify the novel endonuclease from *E. coli*

Complex with synthetic guide-RNA

*In vitro* digestion of DNA fragment containing the target sequence

DNA fragment length analysis by gel electrophoresis

DNA sequence analysis

Figure 10

Cutting assay in eukaryotic cells

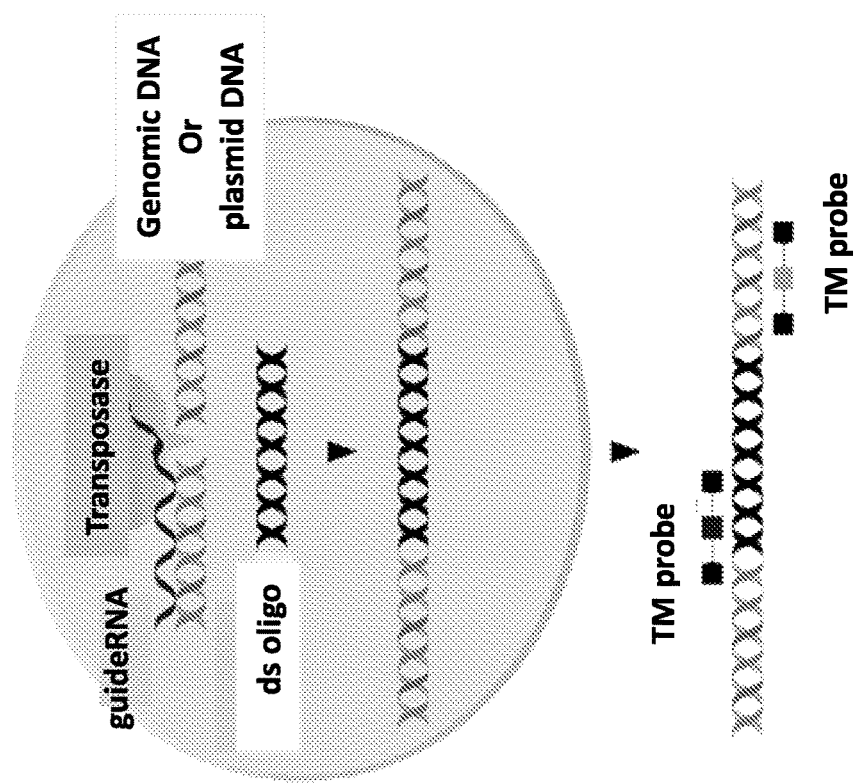

Clone genes of interest (Transposase protein, guide-RNA) into expression vectors for eukaryotic cells Transform the expression vectors, ds-oligo, and (optionally) plasmid DNA containing target sequence into a eukaryotic cell Analysis for RNA guided DSB induced in the eukaryotic cell chromosome or co-transformed plasmid by PCR and/or sequencing

CRISPR-ASSOCIATED TRANSPOSASES AND USES THEREOF

CROSS-REFERENCE TO RELATED APPLICATIONS AND INCORPORATION OF SEQUENCE LISTING

This application is a U.S. National Stage of International Application No. PCT/US2016/069221, filed Dec. 29, 2016, which claims priority to U.S. Provisional Application No. 62/272,441, filed Dec. 29, 2015, both of which are incorporated by reference in their entirety herein. The sequence listing is contained in the file "P34377US01_SEQ.txt", which is 4,394,282 bytes in size (measured in operating system MS Windows) and created on Jun. 28, 2018.

BACKGROUND

CRISPRs (Clustered Regularly Interspaced Short Palindromic Repeats) are loci found in the genomes of bacteria and archaea that contain multiple short direct repeats. CRISPR RNAs (crRNAs) associate with CRISPR-associated (Cas) effector proteins to form CRISPR-Cas systems that recognize foreign nucleic acids. CRISPRs systems are part of the adaptive immune system of bacteria and archaea, protecting them against invading nucleic acids, such as viruses, by cleaving the foreign DNA in a sequence-dependent manner. Immunity is acquired by integrating of short fragments of the invading DNA, known as spacers, between two adjacent repeats at the proximal end of a CRISPR locus. The CRISPR arrays are transcribed during subsequent encounters with invasive nucleic acids and are processed into small interfering CRISPR RNAs (crRNAs) of approximately 40 nt in length, which associate with the trans-activating CRISPR RNA (tracrRNA) to guide the CRISPR associated nuclease to the invasive nucleic acid. The CRISPR/Cas9 effector complex cleaves homologous double-stranded DNA sequences known as protospacers in the invading DNA. A prerequisite for cleavage is the presence of a conserved protospacer-adjacent motif (PAM) downstream of the target DNA, which, for Cas9, usually has the sequence 5'-NGG-3' but less frequently NAG. Specificity is provided by a "seed sequence" in the crRNA which is located approximately 12 bases upstream of the PAM, which must be capable of hybridizing with the target sequence. Cpf1, a type V Cas effector protein, acts in a similar manner to Cas9, but Cpf1 does not require a tracrRNA.

CRISPR-Cas systems are dived into two classes: Class 1 CRISPR systems, subdivided into types I, III, and IV, and Class 1 systems utilize multiple Cas proteins with a crRNA to form a complex; and Class 2 CRISPR systems, subdivided into types II and V, utilize a single Cas protein with a crRNA to form a complex capable of sequence specific genome modification.

SUMMARY

Several embodiments relate to a recombinant nucleic acid comprising a heterologous promoter operably linked to a polynucleotide encoding a CRISPR-associated transposase, wherein the CRISPR-associated transposase comprises an amino acid sequence selected from the group consisting of SEQ ID NOs: 124-246 and 275-287 or a fragment thereof. Several embodiments relate to a recombinant nucleic acid comprising a heterologous promoter operably linked to a polynucleotide encoding a CRISPR-associated transposase, wherein the CRISPR-associated transposase has a sequence homology or identity of at least 80%, at least 85%, at least 90%, at least 95%, at least 96%, at least 97%, at least 98%, or at least 99% with a CRISPR-associated transposase comprising an amino acid sequence selected from SEQ ID NOs: 124-246 and 275-287. In some embodiments, a vector comprising a recombinant nucleic acid comprising a heterologous promoter operably linked to a polynucleotide encoding CRISPR-associated transposase with an amino acid sequence selected from the group consisting of SEQ ID NOs: 124-246 and 275-286 are provided. In some embodiments, a vector comprising a recombinant nucleic acid comprising a heterologous promoter operably linked to a polynucleotide encoding CRISPR-associated transposase, wherein the CRISPR-associated transposase has a sequence homology or identity of at least 80%, at least 85%, at least 90%, at least 95%, at least 96%, at least 97%, at least 98%, or at least 99% with a CRISPR-associated transposase comprising an amino acid sequence selected from SEQ ID NOs: 124-246 and 275-287 are provided.

Several embodiments relate to a recombinant nucleic acid comprising a heterologous promoter operably linked to a polynucleotide encoding a CRISPR-associated transposase, wherein the polynucleotide comprises a nucleic acid sequence selected from the group consisting of SEQ ID NOs: 1-123 and 604-627 or a fragment thereof. Several embodiments relate to a recombinant nucleic acid comprising a heterologous promoter operably linked to a polynucleotide encoding a CRISPR-associated transposase, wherein the polynucleotide comprises a nucleic acid sequence selected from the group consisting of SEQ ID NOs: 2020-2699 or a fragment thereof. Several embodiments relate to a recombinant nucleic acid comprising a heterologous promoter operably linked to a polynucleotide encoding a CRISPR-associated transposase, wherein the polynucleotide comprises a nucleic acid sequence selected from the group consisting of SEQ ID NOs: 2700-3379 or a fragment thereof. Several embodiments relate to a recombinant nucleic acid comprising a heterologous promoter operably linked to a polynucleotide encoding a CRISPR-associated transposase, wherein the polynucleotide comprises a sequence that is at least 80%, at least 85%, at least 90%, at least 95%, at least 96%, at least 97%, at least 98%, or at least 99% identical to a sequence selected from SEQ ID NOs: 1-123, 604-627 and 2020-3379. Several embodiments relate to a vector comprising a recombinant nucleic acid comprising a heterologous promoter operably linked to a polynucleotide encoding CRISPR-associated transposase wherein the polynucleotide comprises a sequence selected from SEQ ID NOs: 1-123, 604-627 and 2020-3379. In some embodiments, the vector comprises a recombinant nucleic acid comprising a heterologous promoter operably linked to a polynucleotide encoding CRISPR-associated transposase, wherein the polynucleotide comprises a sequence having at least 80%, at least 85%, at least 90%, at least 95%, at least 96%, at least 97%, at least 98%, or at least 99% identity to a sequence selected from SEQ ID NOs: 1-123, 604-627 and 2020-3379.

Several embodiments relate to a cell comprising a recombinant nucleic acid comprising a heterologous promoter operably linked to a polynucleotide encoding a CRISPR-associated transposase, wherein the CRISPR-associated transposase comprises an amino acid sequence selected from the group consisting of SEQ ID NOs: 124-246 and 275-287 or a fragment thereof. Several embodiments relate to a cell comprising a recombinant nucleic acid comprising a heterologous promoter operably linked to a polynucleotide encoding a CRISPR-associated transposase, wherein the CRISPR-associated transposase has a sequence homology or identity of at least 80%, at least 85%, at least 90%, at least 95%, at least 96%, at least 97%, at least 98%, or at least 99% with a CRISPR-associated transposase comprising an amino acid sequence selected from SEQ ID NOs: 124-246 and 275-287. In some embodiments, the recombinant nucleic acid comprises a nucleic acid sequence having at least 80%, at least 85%, at least 90%, at least 95%, at least 96%, at least 97%, at least 98%, at least 99% or 100% homology to a nucleic acid sequence selected from SEQ ID NOs: 1-123, 604-627 and 2020-3379. In some embodiments, the recombinant nucleic acid is expressed transiently in the cell. In some embodiments, the recombinant nucleic acid is integrated into a genome of the cell. In some embodiments, the recombinant nucleic acid is integrated into a B chromosome of the cell. In some embodiments, the cell is a prokaryotic cell. In some embodiments, the cell is a eukaryotic cell. In some embodiments, the eukaryotic cell is a plant cell. In some embodiments, the eukaryotic cell is an algal cell. In some embodiments, the eukaryotic cell is a mammalian cell.

In one aspect, the present disclosure provides a system for sequence-specific modification of a target nucleic acid sequence comprising (a) a guide RNA or a DNA molecule encoding a guide RNA, where the guide RNA is specific for a target nucleic acid sequence, and (b) a polynucleotide encoding an CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246, and 275-287.

In one aspect, the present disclosure provides a method for modification of a target nucleic acid sequence in a cell comprising providing to the cell a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287 or a polynucleotide encoding the CRISPR-associated transposase. In some embodiments the CRISPR-associated transposase is encoded by a nucleic acid sequence having at least 80%, at least 85%, at least 90%, at least 95%, at least 96%, at least 97%, at least 98%, at least 99% or 100% homology to a nucleic acid sequence selected from SEQ ID NOs: 1-123, 604-627 and 2020-3379.

In one aspect, the present disclosure provides a method for sequence-specific modification of a target nucleic acid sequence in a cell comprising providing to a cell (a) a guide RNA specific for a target nucleic acid sequence in a cell, and (b) an a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287 or polynucleotide encoding the CRISPR-associated transposase, wherein the target nucleic acid sequence is modified. In some embodiments the polynucleotide encoding the CRISPR-associated transposase comprises a nucleic acid sequence having at least 80%, at least 85%, at least 90%, at least 95%, at least 96%, at least 97%, at least 98%, at least 99% or 100% homology to a nucleic acid sequence selected from SEQ ID NOs: 1-123, 604-627 and 2020-3379.

In an aspect, the present disclosure provides a eukaryotic cell containing a target nucleic acid sequence that has been modified with sequence specificity by a method for sequence-specific modification of a target nucleic acid sequence in a cell comprising providing to a cell (a) a guide RNA specific for a target nucleic acid sequence in a cell, and (b) an a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287 or polynucleotide encoding the CRISPR-associated transposase, where the target nucleic acid sequence is modified. In some embodiments the polynucleotide encoding the CRISPR-associated transposase comprises a nucleic acid sequence having at least 80%, at least 85%, at least 90%, at least 95%, at least 96%, at least 97%, at least 98%, at least 99% or 100% homology to a nucleic acid sequence selected from SEQ ID NOs: 1-123, 604-627 and 2020-3379.

In an aspect, the present disclosure provides a method of selectively modulating transcription of at least one target DNA in a eukaryotic cell comprising contacting the eukaryotic cell with: (a) a guide RNA or a DNA encoding a guide RNA where the guide RNA further comprises: (i) a first segment comprising a nucleotide sequence that is complementary to the target DNA; and (ii) a second segment that interacts with a CRISPR-associated transposase; and (b) an polynucleotide encoding the CRISPR-associated transposase, wherein the CRISPR-associated transposase comprises an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287, where components (a) and (b) are located on same or different vectors, where the guide RNA and the CRISPR-associated transposase form a complex in the eukaryotic cell, and where the complex selectively modulates transcription of the target DNA. In some embodiments the polynucleotide encoding the CRISPR-associated transposase comprises a nucleic acid sequence having at least 80%, at least 85%, at least 90%, at least 95%, at least 96%, at least 97%, at least 98%, at least 99% or 100% homology to a nucleic acid sequence selected from SEQ ID NOs: 1-123, 604-627 and 2020-3379.

Several embodiments relate to a method of identifying a CRISPR-associated transposase from a bacterial genome. In some embodiments, a polynucleotide encoding a CRISPR-associated transposase is identified based on its association within the bacterial genome with a CRISPR locus. In certain aspects, the polynucleotide encoding the CRISPR-associated transposase is further identified by association within the bacterial genome with a Cas1, a Cas2, or a Cas1 and a Cas2 but not Cas5 or Cas3. In some embodiments, the polynucleotide encoding the CRISPR-associated transposase is located in the same operon as the CRISPR locus. In other embodiments, the polynucleotide encoding the CRISPR-associated transposase is located within 2.5 kilobases of the CRISPR loci. In some embodiments, a polynucleotide encoding the CRISPR-associated transposase is identified by having at least 85%, at least 86%, at least 87%, at least 88%, at least 89%, at least 90%, at least 95%, at least 96%, at least 97%, at least 98%, or at least 99% identity to CRISPR-associated transposases comprising a sequence cluster identified in Table 1. In some embodiments, the bacterial genome is selected from the group consisting of: *Lysinibacillus* sp., *Brevibacillus* sp., *Sphingobium* sp., *Undibacterium* sp., *Bacillus* sp., *Chryseobacterium* sp., *Sphingomonas* sp., *Paenibacillus* sp., *Streptomyces* sp., *Stenotro-*

*phomonas* sp., and *Labrys* sp. In some embodiments, the bacterial genome is selected from the group consisting of: *Brevibacillus laterosporus; Bacillus thuringiensis; Bacillus weihenstephanensis, Bacillus megaterium, Enterococcus faecalis; Brevibacillus brevis; Undibacterium pigrum; Novosphingobium rosa; Labrys methylaminiphilus; Brevibacillus parabrevis; Paenibacillus thiaminolyticus; Paenibacillus lentimorbus*; and *Paenibacillus terrae*.

Several embodiments relate to a nucleic acid-targeting system comprising a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287. In some embodiments, the nucleic acid-targeting system further comprises a guide RNA capable of hybridizing with a target sequence. In some embodiments, the nucleic acid-targeting system further comprises a tracrRNA. In some embodiments, the nucleic acid-targeting system further comprises a divalent cation. In some embodiments, the nucleic acid-targeting system further comprises Mg2+. In some embodiments, the nuclease activity of the CRISPR-associated transposase is inactivated. In some embodiments, the nucleic acid-targeting system comprises a CRISPR-associated transposase with a heterologous functional domain.

Several embodiments relate to a method of enhancing recombination at selected genomic loci, comprising providing to a plant cell at least one nucleic acid-targeting system that introduces genome modification in a first genomic locus, thereby inducing recombination between the first genomic locus and a second genomic locus, wherein the at least one nucleic acid-targeting system does not introduce a genome modification at the second genomic locus, and selecting at least one plant cell comprising a recombination event between the first genomic locus and the second genomic locus. Several embodiments relate to a method of enhancing recombination at selected genomic loci, comprising providing to a plant cell at least one nucleic acid-targeting system that introduces genome modification at a first genomic locus and a second genomic locus, thereby inducing recombination between the first genomic locus and the second genomic locus, and selecting at least one plant cell comprising a recombination event between the first genomic locus and the second genomic locus. Several embodiments relate to a method of enhancing recombination at selected genomic loci, comprising providing to a cell a first nucleic acid-targeting system that introduces a genome modification at a first genomic locus and a second nucleic acid-targeting system that introduces a genome modification at a second genomic locus, thereby inducing recombination between the first genomic locus and the second genomic locus, and selecting at least one progeny comprising a recombination event between the first genomic locus and the second genomic locus. In some embodiments the first and second genomic loci are in cis. In some embodiments, the first and second genomic loci are in trans. In some embodiments, the first and second genomic loci are homologs. In some embodiments, the first and second genomic loci are paralogs. In some embodiments, the first and second genomic loci are homeologs. In some embodiments, the first and second genomic loci are identical. In some embodiments, the first genomic locus and the second genomic locus are on homologous chromosomes. In some embodiments, the first genomic locus and the second genomic locus are on non-homologous chromosomes. In some embodiments, the first genomic locus and the second genomic locus are on homoeologous chromosomes. In some embodiments, the first and second genomic loci share at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity. In some embodiments, the first genomic locus and the second genomic locus are located on homologous chromosomes. In some embodiments, the first genomic locus and the second genomic locus are located on non-homologous chromosomes. In some embodiments, the genome modification is a double strand break (DSB). In some embodiments, the genome modification is a single strand break. In some embodiments, the genome modification occurs at the beginning of meiosis. In some embodiments, the recombination is asymmetric. In some embodiments, the recombination is symmetric. In some embodiments, the first target sequence and/or the second target sequence is genic. In some embodiments, the first target sequence and/or the second target sequence is within an intergenic region. In some embodiments, the first target sequence is in a genomic locus that is homologous to at least about 100 bp, at least about 150 bp, at least about 200 bp, at least about 250 bp, at least about 300 bp, at least about 350 bp, at least about 400 bp, at least about 450 bp, at least about 500 bp, at least about 600 bp, at least about 700 bp, at least about 800 bp, at least about 900 bp, or at least about 1000 bp of a genomic locus containing the second target sequence. In some embodiments, the first target sequence is in a genomic locus that is homologous to at least about 100 bp, at least about 150 bp, at least about 200 bp, at least about 250 bp, at least about 300 bp, at least about 350 bp, at least about 400 bp, at least about 450 bp, at least about 500 bp, at least about 600 bp, at least about 700 bp, at least about 800 bp, at least about 900 bp, or at least about 1000 bp of a genomic locus containing the second target sequence, wherein the genomic locus containing the first target sequence and the genomic locus containing the second target sequence are in corresponding positions in the genome. In some embodiments, the first target sequence is in a genomic locus that is homologous to at least about 100 bp, at least about 150 bp, at least about 200 bp, at least about 250 bp, at least about 300 bp, at least about 350 bp, at least about 400 bp, at least about 450 bp, at least about 500 bp, at least about 600 bp, at least about 700 bp, at least about 800 bp, at least about 900 bp, or at least about 1000 bp of a genomic locus containing the second target sequence, wherein the genomic locus containing the first target sequence and the genomic locus containing the second target sequence are not in corresponding positions in the genome. In some embodiments, the first target sequence has at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or 100% sequence identity to the second target sequence. In some embodiments, one or more of the first genomic locus and the second genomic locus comprise one or more genomic regions selected independently from the group consisting of a gene, an array of tandemly duplicated genes, an enhancer, a suppressor, a promoter, a termination sequence, a splice acceptor sequence, a splice donor sequence, an intron, an exon, an siRNA, and a quantitative trait locus (QTL). In some embodiments, progeny of the one plant cell comprising the recombination event between the first genomic locus and the second genomic locus exhibit resistance to one or more diseases selected from Anthracnose Stalk Rot (*Colletotrichum graminicola*), *Fusarium* Ear Rot (*Fusarium verticillioides*), *Fusarium* Stalk Rot (*Fusarium* spp.), *Gibberella* Ear Rot (*Gibberella moniliformis*), *Gibberella* Stalk Rot (*Gibberella zeae*), Goss's Wilt and Leaf Blight (*Clavibacter michiganensis*), Gray Leaf Spot (*Cercospora zeae-maydis, C. zeina*), Northern Corn Leaf Blight (*Exserohilum turcicum*), Sudden death syndrome (*Fusarium solani* f. sp. glycines), Asian soybean rust (*Phakopsora pachyrhizi*), *Phytophthora* root and stem rot (*Phytophthora sojae*), Root-knot Nematode (*Meloidogyne* spp.), Soybean Cyst Nematode (*Heterodera glycines*), Reniform nematode (*Rotylenchulus reniformis*), Root-knot nematode (*Meloidogyne incognita*), *Fusarium* wilt (*Fusarium oxysporurn* f sp. *vasinfectum*), *Verticillium* wilt (*Verticillium dahlia*), *Fusarium* head blight (*Fusarium graminearum*), *Fusarium* seedling blight (*Fusarium* spp., *Septoria nodorum*), *Fusarium* Leaf Blotch (*Monographella nivalis*), and Stem Rust (*Puccinia graminis*). In some embodiments, the plant is a maize plant. In some embodiments, the plant is a soybean plant. In some embodiments, the plant is a cotton plant. In some embodiments, the plant is a wheat plant. In some embodiments, the plant is a sorghum plant. In some embodiments, the plant is a canola plant. In some embodiments, the nucleic acid-targeting system comprises a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287. In some embodiments, the nucleic acid-targeting system further comprises a guide RNA capable of hybridizing with a target sequence. In some embodiments, the nucleic acid-targeting system further comprises a tracrRNA. In some embodiments, the nucleic acid-targeting system further comprises a divalent cation. In some embodiments, the nucleic acid-targeting system further comprises Mg2+. In some embodiments, the nuclease activity of the CRISPR-associated transposase is inactivated. In some embodiments, the nucleic acid-targeting system comprises a CRISPR-associated transposase with a heterologous functional domain. Several embodiments relate to a plant, plant cell or a seed of a plant produced by according to the aforementioned methods.

Several embodiments relate to a method of introgressing a genomic locus of interest into a selected germplasm, comprising generating a plant cell comprising a first parental genome comprising the genomic locus of interest and a second parental genome comprising the selected germplasm, providing to the plant cell a first nucleic acid-targeting system that introduces genome modification in the first parental genome at a target sequence adjacent to the genomic locus of interest, thereby inducing recombination between the first parental genome and the second parental genome, and selecting at least one progeny comprising at least one recombinant chromosome comprising the selected germplasm and the genomic locus of interest. Several embodiments relate to a method of introgressing a genomic locus of interest into a selected germplasm, comprising generating a plant cell comprising a first parental genome comprising the genomic locus of interest and a second parental genome comprising the selected germplasm, providing to the plant cell a first nucleic acid-targeting system that introduces genome modification in the first parental genome at a target sequence adjacent to the genomic locus of interest and a genome modification at a target site in the second parental genome, thereby inducing recombination between the first parental genome and the second parental genome, and selecting at least one progeny comprising at least one recombinant chromosome comprising the selected germplasm and the genomic locus of interest. Several embodiments relate to a method of introgressing a genomic locus of interest into a selected germplasm, comprising generating a plant cell comprising a first parental genome comprising the genomic locus of interest and a second parental genome comprising the selected germplasm, providing to the plant cell a first nucleic acid-targeting system that introduces genome modification in the first parental genome at a target sequence adjacent to the genomic locus of interest and a second nucleic acid-targeting system that introduces a genome modification in the first parental genome at a second target sequence adjacent to the genomic locus, wherein the second target sequence is on opposite side of the genome genomic locus of interest from the target sequence of the first nucleic acid-targeting system, thereby inducing recombination between the first parental genome and the second parental genome, and selecting at least one plant cell comprising at least one recombinant chromosome comprising the selected germplasm and the genomic locus of interest. Several embodiments relate to a method of introgressing a genomic locus of interest into a selected germplasm, comprising generating a plant cell comprising a first parental genome comprising the genomic locus of interest and a second parental genome comprising the selected germplasm, providing to the plant cell a first nucleic acid-targeting system that introduces genome modification in the first parental genome at a target sequence adjacent to the genomic locus of interest and a genome modification at a target site in the second parental genome and further introducing into the plant cell a second nucleic acid-targeting system that introduces a genome modification in the first parental genome at a second target sequence adjacent to the genomic locus, wherein the second target sequence is on opposite side of the genome genomic locus of interest from the target sequence of the first nucleic acid-targeting system, thereby inducing recombination between the first parental genome and the second parental genome, and selecting at least one plant cell comprising at least one recombinant chromosome comprising the selected germplasm and the genomic locus of interest. In some embodiments, the second nucleic acid-targeting system introduces a genome modification at a target sequence in the second parental genome. In some embodiments, the recombination is asymmetric. In some embodiments, the recombination is symmetric. In some embodiments, the genomic locus of interest comprises one or more genomic regions selected independently from the group consisting of a gene, an array of tandemly duplicated genes, a multigene family, an enhancer, a suppressor, a promoter, a termination sequence, a splice acceptor sequence, a splice donor sequence, an intron, an exon, an siRNA, a sequence encoding a non-coding RNA, a microRNA, a transgene, and a quantitative trait locus (QTL). In some embodiments, the genome modification is a double strand break (DSB). In some embodiments, the genome modification is a single strand break. In some embodiments, the genome modification is a recombinase-mediated DNA exchange reaction. In some embodiments, the genome modification is a transposase-mediated DNA exchange reaction. In some embodiments, the genome modification occurs at the beginning of meiosis. In some embodiments, the target sequence is genic. In some embodiments, the target sequence is within an intergenic region. In some embodiments, the target sequence is in a genomic locus of the first parental genome that is homologous to at least about 100 bp, at least about 150 bp, at least about 200 bp, at least about 250 bp, at least about 300 bp, at least about 350 bp, at least about 400 bp, at least about 450 bp, at least about 500 bp, at least about 600 bp, at least about 700 bp, at least about 800 bp, at least about 900 bp, or at least about 1000 bp of a genomic locus of the second parental genome. In some embodiments, the target sequence is in a genomic locus of the first parental genome that is homologous to at least about 100 bp, at least about 150 bp, at least about 200 bp, at least about 250 bp, at least about 300 bp, at least about 350 bp, at least about 400 bp, at least about 450 bp, at least about 500 bp, at least about 600 bp, at least about 700 bp, at least about 800 bp, at least about 900 bp, or at least about 1000 bp of a genomic locus of the second parental genome, wherein the genomic locus of the first parental genome and the genomic locus of the second parental genome are located in corresponding positions. In some embodiments, the target sequence is in a genomic locus of the first parental genome that is homologous to at least about 100 bp, at least about 150 bp, at least about 200 bp, at least about 250 bp, at least about 300 bp, at least about 350 bp, at least about 400 bp, at least about 450 bp, at least about 500 bp, at least about 600 bp, at least about 700 bp, at least about 800 bp, at least about 900 bp, or at least about 1000 bp of a genomic locus of the second parental genome, wherein the genomic locus of the first parental genome and the genomic locus of the second parental genome are not located in corresponding positions, leading to asymmetric recombination. In some embodiments, the first parental genome and the second parental genome are not sexually compatible. In some embodiments, the first parental genome and the second parental genome are different species. In some embodiments, the first parental genome is *Triticum aestivum* (wheat) and the second parental genome is selected from *Aegilops ovate, Ae. biuncialis, Ae. triuncialis, Ae. quarrosa, Secale cereal, Triticum dicoccoides, Triticum dicoccum* and *Triticum durum*. In some embodiments, the first parental genome is selected from *Aegilops ovate, Ae. biuncialis, Ae. triuncialis, Ae. quarrosa, Secale cereal, Triticum dicoccoides, Triticum dicoccum* and *Triticum durum* and the second parental genome is *Triticum aestivum* (wheat). In some embodiments, the first parental genome is *Gossypium hirsutum* (cotton) and the second parental genome is selected from *G. sturtii, G. davidsonii, G. arboretum* and *G. raimondii*. In some embodiments, the first parental genome is selected from *G. sturtii, G. davidsonii, G. arboretum* and *G. raimondii* and the second parental genome is *Gossypium hirsutum* (cotton). In some embodiments, the first parental genome and/or the second parental genome are haploid. In some embodiments, the first parental genome and/or the second parental genome are diploid. In some embodiments, the genomic locus of interest is Rp1 disease resistance locus. In some embodiments, the genomic locus of interest is Rpp1 disease resistance locus. In some embodiments, the genomic locus of interest is Rps1 disease resistance locus. In some embodiments, the genomic locus of interest is Rhg1 disease resistance locus. In some embodiments, the genomic locus of interest is Rgh4 disease resistance locus. In some embodiments, the plant is a maize plant. In some embodiments, the plant is a soybean plant. In some embodiments, the plant is a cotton plant. In some embodiments, the plant is a wheat plant. In some embodiments, the plant is a sorghum plant. In some embodiments, the plant is a canola plant. In some embodiments, the nucleic acid-targeting system comprises a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287. In some embodiments, the nucleic acid-targeting system further comprises a guide RNA capable of hybridizing with a target sequence. In some embodiments, the nucleic acid-targeting system further comprises a tracrRNA. In some embodiments, the nucleic acid-targeting system further comprises a divalent cation. In some embodiments, the nucleic acid-targeting system further comprises $Mg^{2+}$. In some embodiments, the nuclease activity of the CRISPR-associated transposase is inactivated. In some embodiments, the nucleic acid-targeting system comprises a CRISPR-associated transposase with a heterologous functional domain. Several embodiments relate to a plant, plant cell or a seed of a plant produced by according to the aforementioned methods.

Several embodiments relate to a method of removing linkage drag, comprising generating a plant cell comprising a first parental genome and a second parental genome, wherein the first parental genome comprises a genomic locus of interest linked in cis to a undesirable genomic locus, providing to the cell a first nucleic acid-targeting system that introduces a genome modification between the genomic locus of interest and the undesirable genomic locus, thereby inducing recombination between the first parental genome and the second parental genome and unlinking the genomic locus of interest and the undesirable locus, and selecting at least one progeny comprising the genomic locus of interest. Several embodiments relate to a method of removing linkage drag, comprising generating a plant cell comprising a first parental genome and a second parental genome, wherein the first parental genome comprises a genomic locus of interest linked in cis to an undesirable genomic locus, providing to the cell a first nucleic acid-targeting system that introduces a first genome modification between the genomic locus of interest and the undesirable genomic locus and a second genome modification on the opposite side of the undesirable genomic locus from the first genome modification, thereby inducing recombination between the first parental genome and the second parental genome and removing the undesirable locus while maintaining the germplasm of the first parental genome distal to the second genome modification, and selecting at least one progeny comprising the genomic locus of interest. In some embodiments, the second nucleic acid-targeting system introduces a genome modification at a target sequence in the second parental genome. In some embodiments, the recombination is asymmetric. In some embodiments, the recombination is symmetric. In some embodiments, the genomic locus of interest comprises one or more genomic regions selected independently from the group consisting of a gene, an array of tandemly duplicated genes, a multigene family, an enhancer, a suppressor, a promoter, a termination sequence, a splice acceptor sequence, a splice donor sequence, an intron, an exon, an siRNA, a sequence encoding a non-coding RNA, a microRNA, a transgene, and a quantitative trait locus (QTL). In some embodiments, the genome modification is a double strand break (DSB). In some embodiments, the genome modification is a single strand break. In some embodiments, the genome modification is a recombinase-mediated DNA exchange reaction. In some embodiments, the genome modification is a transposase-mediated DNA exchange reaction. In some embodiments, the genome modification occurs at the beginning of meiosis. In some embodiments, the first parental genome and the second parental genome are not sexually compatible. In some embodiments, the first parental genome and the second parental genome are different species. In some embodiments, the first parental genome is *Triticum aestivum* (wheat) and the second parental genome is selected from *Aegilops ovate, Ae. biuncialis, Ae. triuncialis, Ae. quarrosa, Secale cereal, Triticum dicoccoides, Triticum dicoccum* and *Triticum durum*. In some embodiments, the first parental genome is selected from *Aegilops ovate, Ae. biuncialis, Ae. triuncialis, Ae. quarrosa, Secale cereal, Triticum dicoccoides, Triticum dicoccum* and *Triticum durum* and the second parental genome is *Triticum aestivum* (wheat). In some embodiments, the first parental genome is *Gossypium hirsutum* (cotton) and the second parental genome is selected from *G. sturtii, G. davidsonii, G. arboretum* and *G. raimondii*. In some embodiments, the first parental genome is selected from *G. sturtii, G. davidsonii, G. arboretum* and *G. raimondii* and the second parental genome is *Gossypium hirsutum* (cotton). In some embodiments, the first parental genome and/or the second parental genome are haploid. In some embodiments, the first parental genome and/or the second parental genome are diploid. In some embodiments, the genomic locus of interest is Rp1 disease resistance locus. In some embodiments, the genomic locus of interest is Rpp1 disease resistance locus. In some embodiments, the genomic locus of interest is Rps1 disease resistance locus. In some embodiments, the genomic locus of interest is Rhg1 disease resistance locus. In some embodiments, the genomic locus of interest is Rhg4 disease resistance locus. In some embodiments, the plant is a maize plant. In some embodiments, the plant is a soybean plant. In some embodiments, the plant is a cotton plant. In some embodiments, the plant is a wheat plant. In some embodiments, the plant is a sorghum plant. In some embodiments, the plant is a canola plant. In some embodiments, the nucleic acid-targeting system comprises a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287. In some embodiments, the nucleic acid-targeting system further comprises a guide RNA capable of hybridizing with a target sequence. In some embodiments, the nucleic acid-targeting system further comprises a tracrRNA. In some embodiments, the nucleic acid-targeting system further comprises a divalent cation. In some embodiments, the nucleic acid-targeting system further comprises Mg2+. In some embodiments, the nuclease activity of the CRISPR-associated transposase is inactivated. In some embodiments, the nucleic acid-targeting system comprises a CRISPR-associated transposase with a heterologous functional domain. Several embodiments relate to a plant, plant cell or a seed of a plant produced by according to the aforementioned methods.

Several embodiments relate to a method of coupling genomic loci in repulsion, comprising generating a plant cell comprising a first parental genome comprising a first genomic locus and a second parental genome comprising a second genomic locus, wherein the first genomic locus and the second genetic locus are in repulsion, providing to the cell a first nucleic acid-targeting system that introduces a genome modification adjacent to the first genomic locus, thereby inducing recombination between the first parental genome and the second parental genome, and selecting at least one plant cell comprising the first genomic locus and the second genomic locus on the same chromosome. In some embodiments, the first genomic locus and the second genomic locus are located on homologous chromosomes. In some embodiments, the first parental genome and the second parental genome are not sexually compatible. In some embodiments, the first parental genome and the second parental genome are different species. In some embodiments, the first genomic locus of interest and/or the second genomic locus of interest comprises one or more genomic regions selected independently from the group consisting of a gene, an array of tandemly duplicated genes, an enhancer, a suppressor, a promoter, a termination sequence, a splice acceptor sequence, a splice donor sequence, an intron, an exon, an siRNA, and a quantitative trait locus (QTL). In some embodiments, the first parental genome and/or the second parental genome are haploid. In some embodiments, the first parental genome and/or the second parental genome are diploid. In some embodiments, the first parental genome is *Triticum aestivum* (wheat) and the second parental genome is selected from *Aegilops ovate, Ae. biuncialis, Ae. triuncialis, Ae. quarrosa, Secale cereal, Triticum dicoccoides, Triticum dicoccum* and *Triticum durum*. In some embodiments, the first parental genome is selected from *Aegilops ovate, Ae. biuncialis, Ae. triuncialis, Ae. quarrosa, Secale cereal, Triticum dicoccoides, Triticum dicoccum* and *Triticum durum* and the second parental genome is *Triticum aestivum* (wheat). In some embodiments, the first parental genome is *Gossypium hirsutum* (cotton) and the second parental genome is selected from *G. sturtii, G. davidsonii, G. arboretum* and *G. raimondii*. In some embodiments, the first parental genome is selected from *G. sturtii, G. davidsonii, G. arboretum* and *G. raimondii* and the second parental genome is *Gossypium hirsutum* (cotton). In some embodiments, the genomic locus of interest is Rp1 disease resistance locus. In some embodiments, the first genomic locus of interest and/or the second genomic locus of interest is Rpp1 disease resistance locus. In some embodiments, the first genomic locus of interest and/or the second genomic locus of interest is Rps1 disease resistance locus. In some embodiments, the first genomic locus of interest and/or the second genomic locus of interest Rhg1 disease resistance locus. In some embodiments, the first genomic locus of interest and/or the second genomic locus of interest Rhg4 disease resistance locus. In some embodiments, the first genomic locus of interest is Rhg1 and the second genomic locus of interest Rhg4. In some embodiments, the plant is a maize plant. In some embodiments, the plant is a soybean plant. In some embodiments, the plant is a cotton plant. In some embodiments, the plant is a wheat plant. In some embodiments, the plant is a sorghum plant. In some embodiments, the plant is a canola plant. In some embodiments, the nucleic acid-targeting system comprises a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287. In some embodiments, the nucleic acid-targeting system further comprises a guide RNA capable of hybridizing with a target sequence. In some embodiments, the nucleic acid-targeting system further comprises a tracrRNA. In some embodiments, the nucleic acid-targeting system further comprises a divalent cation. In some embodiments, the nucleic acid-targeting system further comprises Mg2+. In some embodiments, the nuclease activity of the CRISPR-associated transposase is inactivated. In some embodiments, the nucleic acid-targeting system comprises a CRISPR-associated transposase with a heterologous functional domain. Several embodiments relate to a plant, plant cell or a seed of a plant produced by according to the aforementioned methods.

Several embodiments relate to a method of generating a new array of tandemly duplicated genes, comprising contacting a cell with a nucleic acid-targeting system that cleaves at least one target sequence in a first array of tandemly duplicated genes thereby inducing asymmetric recombination with a homologous sequence of a second array of tandemly duplicated genes and selecting at least one progeny comprising a new array of tandemly duplicated genes. In some embodiments, the first and second arrays of tandemly duplicated genes are identical. In other embodiments, the first and second arrays of tandemly duplicated genes are different. In some embodiments, the asymmetric recombination generates two new arrays of tandemly duplicated genes, depending on the recombination site. In some embodiments, the asymmetric recombination results in a deletion in at least one of the tandemly duplicated genes. In some embodiments, the cell is a plant cell. In a further embodiment, the plant cell is obtained from a plant selected from an inbred plant or a hybrid plant. In other embodiments, the cell is a mammalian cell. In some embodiments, the nucleic acid-targeting system comprises a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287. In some embodiments, the nucleic acid-targeting system further comprises a guide RNA capable of hybridizing with a target sequence. In some embodiments, the nucleic acid-targeting system further comprises a tracrRNA. In some embodiments, the nucleic acid-targeting system further comprises a divalent cation. In some embodiments, the nucleic acid-targeting system further comprises $Mg^{2+}$. In some embodiments, the nuclease activity of the CRISPR-associated transposase is inactivated. In some embodiments, the nucleic acid-targeting system comprises a CRISPR-associated transposase with a heterologous functional domain. Several embodiments relate to a plant, plant cell or a seed of a plant produced by according to the aforementioned methods.

BRIEF DESCRIPTION OF THE FIGURES

FIG. 1 shows a multiple sequence alignment of CRISPR-associated transposase protein sequences SEQ ID NOs: 228-232.

FIG. 2 shows the multiple sequence alignment of three CRISPR spacer sequences and five bacterial phage sequences. The three spacers (spacer-1: SEQ ID NO: 2004, spacer-2: SEQ ID NO: 2005, spacer-3: SEQ ID NO: 2006) are from CRISPR regions associated with transposases in protein cluster 1. The five phage sequences (KJ920400.1: SEQ ID NO: 2007, HE614281.1: SEQ ID NO: 2008, HE614282.1: SEQ ID NO: 2009, KJ024807.1: SEQ ID NO: 2010, NC 029008.1: SEQ ID NO: 2011) are blast search hits of spacer sequences against datasets of phage and viral genomic sequences. The conserved "TCA" motif in the rectangle box is a putative 5'-PAM for the transposases.

FIG. 5 shows the amino acid sequence of the CRISPR-associated transposase of SEQ ID NO: 136 with domain annotations: seven Puf domains Puf-1 to Puf-7 are underlined and labeled; two pfam domains, IS605_ORFB and Zn_Ribbon region, are enclosed by brackets [ ] and [[ ]] respectively; and the conserved RuvC catalytic sites D233, E354, and D408 are pointed out by arrows.

FIG. 6 shows a multiple sequence alignment of five CRISPR repeat sequences (SEQ ID NOs: 2012-2016) from the CRISPR region (SEQ ID NO: 662) associated with the CRISPR-associated transposase of SEQ ID NO: 136 (DNA: SEQ ID NO: 304). The conserved nucleotides that are consistent with the consensus Puf binding motif (5'-UGUA-NAUA-3') are underlined and shown in bold.

FIG. 10 shows a diagram of a cutting assay for eukaryotic cells. The CRISPR-associated transposase and associated guide RNA are cloned into a vector to facilitate expression in a eukaryotic cell. The expression vectors, double strand oligo (ds oligo), and (optionally) plasmid DNA containing target sequence are co-transformed into a eukaryotic cell. The nuclease activity on either (a) chromosomal DNA, or (b) introduced plasmid template is evaluated with standard molecular biology assays (PCR (Taqman® (TM)), restriction fragment size analysis, or sequencing).

DETAILED DESCRIPTION

Figure 3:
FIG. 3 shows the predicted stem-loop secondary structure for the CRISPR repeat sequence 1 (SEQ ID NO: 2012) and the CRISPR repeat sequence 2 (SEQ ID NO: 2013) from the transposase-associated CRISPR region (SEQ ID NO: 662). The structure of the repeat sequences suggests that the repeat sequence alone is sufficient to form an effective guide RNA.

Unless defined otherwise, all technical and scientific terms used herein have the same meaning as commonly understood by one of ordinary skill in the art to which this disclosure belongs. Where a term is provided in the singular, the inventors also contemplate aspects of the disclosure described by the plural of that term. Where there are discrepancies in terms and definitions used in references that are incorporated by reference, the terms used in this application shall have the definitions given herein. Other technical terms used have their ordinary meaning in the art in which they are used, as exemplified by various art-specific dictionaries, for example, "The American Heritage® Science Dictionary" (Editors of the American Heritage Dictionaries, 2011, Houghton Mifflin Harcourt, Boston and New York), the "McGraw-Hill Dictionary of Scientific and Technical Terms" (6th edition, 2002, McGraw-Hill, New York), or the "Oxford Dictionary of Biology" (6th edition, 2008, Oxford University Press, Oxford and New York). The inventors do not intend to be limited to a mechanism or mode of action. Reference thereto is provided for illustrative purposes only.

The practice of the present disclosure employs, unless otherwise indicated, conventional techniques of biochemistry, chemistry, molecular biology, microbiology, cell biology, genomics, plant breeding, and biotechnology, which are within the skill of the art. See Green and Sambrook, MOLECULAR CLONING: A LABORATORY MANUAL, 4th edition (2012); CURRENT PROTOCOLS IN MOLECULAR BIOLOGY (F. M. Ausubel, et al. eds., (1987)); the series METHODS IN ENZYMOLOGY (Academic Press, Inc.): PCR 2: A PRACTICAL APPROACH (M. J. MacPherson, B. D. Hames and G. R. Taylor eds. (1995)); Harlow and Lane, eds. (1988) ANTIBODIES, A LABORATORY MANUAL; ANIMAL CELL CULTURE (R. I. Freshney, ed. (1987)); RECOMBINANT PROTEIN PURIFICATION: PRINCIPLES AND METHODS, 18-1142-75, GE Healthcare Life Sciences; C. N. Stewart, A. Touraev, V. Citovsky, T. Tzfira eds. (2011) PLANT TRANSFORMATION TECHNOLOGIES (Wiley-Blackwell); and R. H. Smith (2013) PLANT TISSUE CULTURE. TECHNIQUES AND EXPERIMENTS (Academic Press, Inc.).

Any references cited herein are incorporated by reference in their entireties.

As used herein, the singular form "a," "an," and "the" include plural references unless the context clearly dictates otherwise. For example, the term "a compound" or "at least one compound" may include a plurality of compounds, including mixtures thereof. Thus, for example, reference to "plant," "the plant," or "a plant" also includes a plurality of plants; also, depending on the context, use of the term "plant" can also include genetically similar or identical progeny of that plant; use of the term "a nucleic acid" optionally includes, as a practical matter, many copies of that nucleic acid molecule.

As used herein, the term "about" indicates that a value includes the inherent variation of error for the method being employed to determine a value, or the variation that exists among experiments.

As used herein, the terms "CRISPR-associated enzyme" refers to genome modification enzymes that associated in its native context (e.g., in a bacterial genome) with a CRISPR locus. In some embodiments, the CRISPR-associated enzymes are CRISPR-associated transposases.

As used herein, "encoding" refers either to a polynucleotide (DNA or RNA) encoding for the amino acids of a polypeptide or a DNA encoding for the nucleotides of an RNA. As used herein, "coding sequence" and "coding region" are used interchangeably and refer to a polynucleotide that encodes a polypeptide. The boundaries of a coding region are generally determined by a translation start codon at its 5' end and a translation stop codon at its 3' end.

As used herein, an "endogenous" molecule is one that is normally present in a particular cell at a particular developmental stage under particular environmental conditions.

As used herein, an "expression cassette" refers to a polynucleotide sequence which may or may not be operably linked to one or more expression elements such as an enhancer, a promoter, a leader, an intron, a 5' untranslated region (UTR), a 3' UTR, or a transcription termination sequence. In some embodiments, an expression cassette comprises at least a first polynucleotide sequence capable of initiating transcription of an operably linked second polynucleotide sequence and optionally a transcription termination sequence operably linked to the second polynucleotide sequence.

As used herein, the term "gene" or "genic" means a locatable region of genomic sequence corresponding to a unit of inheritance. A gene may include regulatory regions, such as promoters, enhancers, 5'-untranslated regions, intron regions, exon regions, 3'-untranslated regions, transcribed regions, and other functional sequence regions that may exist as native genes or transgenes in a plant or a mammalian genome. Depending upon the circumstances, the term "target gene" can refer to the full-length nucleotide sequence of a gene targeted for binding and/or cleavage or the nucleotide sequence of a portion of a gene targeted for binding and/or cleavage. A target gene can be an endogenous gene or a transgene.

As used herein, the term "genomic locus" refers to a specific location on a chromosome. A genomic locus may comprise a single nucleotide, a few nucleotides, a large number of nucleotides, a gene, a portion of a gene, a gene cluster, a multigene family or array of genes in a genomic region.

As used herein, the term "homologous recombination" refers to the exchange of nucleotide sequences at a conserved region shared by two genomic loci or by a donor DNA and a target site. Homologous recombination includes symmetric homologous recombination and asymmetric homologous recombination. Asymmetric homologous recombination may also be referred to as unequal recombination.

As used herein, the term "identity" when used in relation to nucleic acids, describes the degree of similarity between two or more nucleotide sequences. The percentage of "sequence identity" between two sequences can be determined by comparing two optimally aligned sequences over a comparison window, such that the portion of the sequence in the comparison window may comprise additions or deletions (gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity. A sequence that is identical at every position in comparison to a reference sequence is said to be identical to the reference sequence and vice-versa. An alignment of two or more sequences may be performed using any suitable computer program. For example, a widely used and accepted computer program for performing sequence alignments is CLUSTALW v1.6 (Thompson, et al. (1994) Nucl. Acids Res., 22: 4673-4680).

As used herein, a "non-coding sequence" can encode a functional RNA (e.g. transfer RNA, ribosomal RNA, microRNA, Piwi-interacting RNA), a promoter, an intron, an untranslated region of an mRNA (e.g., a 5' untranslated region or a 3' untranslated region), a pseudogene, a repeat sequence, or a transposable element. Non-coding sequences do not encode functional polypeptides.

As used herein, the terms "nucleic acid," "polynucleotide," and "oligonucleotide are used interchangeably and refer to deoxyribonuclotides (DNA), ribonucleotides (RNA), and functional analogues thereof, such as complementary DNA (cDNA) in linear or circular conformation. Nucleic acid molecules provided herein can be single stranded or double stranded. Nucleic acid molecules comprise the nucleotide bases adenine (A), guanine (G), thymine (T), cytosine (C). Uracil (U) replaces thymine in RNA molecules. Analogues of the natural nucleotide bases, as well as nucleotide bases that are modified in the base, sugar, and/or phosphate moieties are also provided herein. The symbol "N" can be used to represent any nucleotide base (e.g., A, G, C, T, or U). As used herein, "complementary" in reference to a nucleic acid molecule or nucleotide bases refers to A being complementary to T (or U), and G being complementary to C. Two complementary nucleic acid molecules are capable of hybridizing with each other under appropriate conditions. In an aspect of the present disclosure, two nucleic acid sequences are homologous if they have at least 70%, at least 75%, at least 80%, at least 85%, at least 90%, at least 95%, at least 96%, at least 97%, at least 98%, at least 99% or 100% sequence identity with each other.

As used herein, "operably linked" means that the operably linked nucleic acid sequences exhibit their desired function. For example, in an aspect of this disclosure, a provided DNA promoter sequence can initiate transcription of an operably linked DNA sequence into RNA. A nucleic acid sequence provided herein can be upstream or downstream of a physically or operably linked nucleic acid sequence. In an aspect, a first nucleic acid molecule provided herein is both physically linked and operably linked to a second nucleic acid molecule provided herein. In another aspect, a first nucleic acid molecule provided herein is neither physically linked nor operably linked to a second nucleic acid molecule provided herein. As used herein, "upstream" means the nucleic acid sequence is positioned before the 5' end of a linked nucleic acid sequence. As used herein, "downstream" means the nucleic acid sequence is positioned after the 3' end of a linked nucleic acid sequence.

As used herein, the term "plant" refers to any photosynthetic, eukaryotic, unicellular or multicellular organism of the kingdom Plantae and includes a whole plant or a cell or tissue culture derived from a plant, comprising any of: whole plants, plant components or organs (e.g., leaves, stems, roots, etc.), plant tissues, seeds, plant cells, protoplasts and/or progeny of the same. A progeny plant can be from any filial generation, e.g., F1, F2, F3, F4, F5, F6, F7, etc. A "plant cell" is a biological cell of a plant, taken from a plant or derived through culture from a cell taken from a plant. The term plant encompasses monocotyledonous and dicotyledonous plants. The methods, systems, and compositions described herein are useful across a broad range of plants. Suitable plants in which the methods, systems, and compositions disclosed herein can be used include, but are not limited to, cereals and forage grasses (e.g., alfalfa, rice, maize, wheat, barley, oat, sorghum, pearl millet, finger millet, cool-season forage grasses, and bahiagrass), oilseed crops (e.g., soybean, oilseed brassicas including canola and oilseed rape, sunflower, peanut, flax, sesame, and safflower), legume grains and forages (e.g., common bean, cowpea, pea, fava bean, lentil, tepary bean, Asiatic beans, pigeonpea, vetch, chickpea, lupine, alfalfa, and clovers), temperate fruits and nuts (e.g., apple, pear, peach, plums, berry crops, cherries, grapes, olive, almond, and Persian walnut), tropical and subtropical fruits and nuts (e.g., citrus including limes, oranges, and grapefruit; banana and plantain, pineapple, papaya, mango, avocado, kiwifruit, passionfruit, and persimmon), vegetable crops (e.g., solanaceous plants including tomato, eggplant, and peppers; vegetable brassicas; radish, carrot, cucurbits, alliums, asparagus, and leafy vegetables), sugar cane, tubers (e.g., beets, parsnips, potatoes, turnips, sweet potatoes), and fiber crops (sugarcane, sugar beet, stevia, potato, sweet potato, cassava, and cotton), plantation crops, ornamentals, and turf grasses (tobacco, coffee, cocoa, tea, rubber tree, medicinal plants, ornamentals, and turf grasses), and forest tree species.

As used herein, "plant genome" refers to a nuclear genome, a mitochondrial genome, or a plastid (e.g., chloroplast) genome of a plant cell. In some embodiments, a plant genome may comprise a parental genome contributed by the male and a parental genome contributed by the female. In some embodiments, a plant genome may comprise only one parental genome.

As used herein, "polynucleotide" refers to a nucleic acid molecule containing multiple nucleotides and generally refers both to "oligonucleotides" (a polynucleotide molecule of 18-25 nucleotides in length) and polynucleotides of 26 or more nucleotides. Aspects of this disclosure include compositions including oligonucleotides having a length of 18-25 nucleotides (e. g., 18-mers, 19-mers, 20-mers, 21-mers, 22-mers, 23-mers, 24-mers, or 25-mers), or medium-length polynucleotides having a length of 26 or more nucleotides (e. g., polynucleotides of 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, about 65, about 70, about 75, about 80, about 85, about 90, about 95, about 100, about 110, about 120, about 130, about 140, about 150, about 160, about 170, about 180, about 190, about 200, about 210, about 220, about 230, about 240, about 250, about 260, about 270, about 280, about 290, or about 300 nucleotides), or long polynucleotides having a length greater than about 300 nucleotides (e. g., polynucleotides of between about 300 to about 400 nucleotides, between about 400 to about 500 nucleotides, between about 500 to about 600 nucleotides, between about 600 to about 700 nucleotides, between about 700 to about 800 nucleotides, between about 800 to about 900 nucleotides, between about 900 to about 1000 nucleotides, between about 300 to about 500 nucleotides, between about 300 to about 600 nucleotides, between about 300 to about 700 nucleotides, between about 300 to about 800 nucleotides, between about 300 to about 900 nucleotides, or about 1000 nucleotides in length, or even greater than about 1000 nucleotides in length, for example up to the entire length of a target gene including coding or non-coding or both coding and non-coding portions of the target gene). Where a polynucleotide is double-stranded, its length can be similarly described in terms of base pairs.

As used herein, terms "polypeptide", "peptide" and "protein" are used interchangeably to refer to a polymer of amino acid residues. The term also applies to amino acid polymers in which one or more amino acids are chemical analogues or modified derivatives of a corresponding naturally-occurring amino acids.

As used herein, "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

As used herein, "promoter" refers to a nucleic acid sequence located upstream or 5' to a translational start codon of an open reading frame (or protein-coding region) of a gene and that is involved in recognition and binding of RNA polymerase I, II, or III and other proteins (trans-acting transcription factors) to initiate transcription. In some embodiments described herein, the promoter is a plant promoter. A "plant promoter" is a native or non-native promoter that is functional in plant cells. Constitutive promoters are functional in most or all tissues of a plant throughout plant development. Tissue-, organ- or cell-specific promoters are expressed only or predominantly in a particular tissue, organ, or cell type, respectively. Rather than being expressed "specifically" in a given tissue, plant part, or cell type, a promoter may display "enhanced" expression, i.e., a higher level of expression, in one cell type, tissue, or plant part of the plant compared to other parts of the plant. Temporally regulated promoters are functional only or predominantly during certain periods of plant development or at certain times of day, as in the case of genes associated with circadian rhythm, for example. Inducible promoters selectively express an operably linked DNA sequence in response to the presence of an endogenous or exogenous stimulus, for example by chemical compounds (chemical inducers) or in response to environmental, hormonal, chemical, and/or developmental signals. Inducible or regulated promoters include, for example, promoters regulated by light, heat, stress, flooding or drought, phytohormones, wounding, or chemicals such as ethanol, jasmonate, salicylic acid, or safeners. In an aspect, a promotor provided herein is a constitutive promoter. In another aspect, a promoter provided herein is a regulatable promoter. In an aspect, a promoter provided herein is located within a sequence of interest. In another aspect, a promoter provided herein is not located within a sequence of interest. A number of promoters that are active in plant cells have been described in the literature. Such promoters would include but are not limited to the nopaline synthase (NOS) (Ebert et al., 1987) and octopine synthase (OCS) promoters that are carried on Ti plasmids of *Agrobacterium tumefaciens*, the caulimovirus promoters such as the cauliflower mosaic virus (CaMV) 19S (Lawton et al., Plant Molecular Biology (1987) 9: 315-324) and 35S promoters (Odell et al., Nature (1985) 313: 810-812), the Figwort mosaic virus (FMV) 35S promoter (U.S. Pat. Nos. 6,051,753; 5,378,619), and the enhanced CaMV35S promoter (e35S). Additional promoters that can find use are the sucrose synthase promoter (Yang and Russell, Proceedings of the National Academy of Sciences, USA (1990) 87: 4144-4148), the R gene complex promoter (Chandler et al., Plant Cell (1989) 1: 1175-1183), and the chlorophyll a/b binding protein gene promoter, PC1SV (U.S. Pat. No. 5,850,019), and AGRtu.nos (GenBank Accession V00087; Depicker et al., Journal of Molecular and Applied Genetics (1982) 1: 561-573; Bevan et al., 1983) promoters. A variety of other plant gene promoters that are regulated in response to environmental, hormonal, chemical, and/or developmental signals, also can be used for expression of heterologous genes in plant cells, including, for instance, promoters regulated by (1) heat (Callis et al., Plant Physiology, (1988) 88: 965-968), (2) light (e.g., pea RbcS-3A promoter, Kuhlemeier et al., Plant Cell, (1989) 1: 471-478; maize RbcS promoter, Schaffner et al., Plant Cell (1991) 3: 997-1012); (3) hormones, such as abscisic acid (Marcotte et al., Plant Cell, (1989) 1: 969-976), (4) wounding (e.g., Siebertz et al., Plant Cell, (1989) 961-968); or other signals or chemicals. Tissue specific promoters are also known. In some embodiments, a promoter is capable of causing sufficient expression to result in the production of an effective amount of the gene product of interest. Examples describing such promoters include without limitation U.S. Pat. No. 6,437,217 (maize RS81 promoter), U.S. Pat. No. 5,641,876 (rice actin promoter), U.S. Pat. No. 6,426,446 (maize RS324 promoter), U.S. Pat. No. 6,429,362 (maize PR-1 promoter), U.S. Pat. No. 6,232,526 (maize A3 promoter), U.S. Pat. No. 6,177,611 (constitutive maize promoters), U.S. Pat. Nos. 5,322,938, 5,352,605, 5,359,142 and 5,530,196 (35S promoter), U.S. Pat. No. 6,433,252 (maize L3 oleosin promoter), U.S. Pat. No. 6,429,357 (rice actin 2 promoter as well as a rice actin 2 intron), U.S. Pat. No. 5,837,848 (root specific promoter), U.S. Pat. No. 6,294,714 (light inducible promoters), U.S. Pat. No. 6,140,078 (salt inducible promoters), U.S. Pat. No. 6,252,138 (pathogen inducible promoters), U.S. Pat. No. 6,175,060 (phosphorus deficiency inducible promoters), U.S. Pat. No. 6,635,806 (gamma-coixin promoter), and U.S. patent application Ser. No. 09/757,089 (maize chloroplast aldolase promoter). In some embodiments, promoter hybrids can be constructed to enhance transcriptional activity (U.S. Pat. No. 5,106,739). In some embodiments, promoter hybrids can be constructed to combine a desired transcriptional activity, transcriptional inducibility, transcriptional tissue specificity, and/or transcriptional developmental specificity. Promoters that function in plants include but are not limited to promoters that are inducible, viral, synthetic, constitutive, temporally regulated, spatially regulated, and spatio-temporally regulated. Other promoters that are tissue-enhanced, tissue-specific, or developmentally regulated are also known in the art and envisioned to have utility in the practice of this disclosure. Promoters used in the provided nucleic acid molecules and transformation vectors of the present disclosure can be modified, if desired, to affect their control characteristics. Promoters can be derived by means of ligation with operator regions, random or controlled mutagenesis, etc. Furthermore, the promoters can be altered to contain multiple "enhancer sequences" to assist in elevating gene expression.

As used herein, a "recombinant nucleic acid" refers to a nucleic acid molecule (DNA or RNA) having a coding and/or non-coding sequence distinguishable from endogenous nucleic acids found in natural systems. In some aspects, a recombinant nucleic acid provided herein is used in any composition, system or method provided herein. In some aspects, a recombinant nucleic acid may any CRISPR-associated transposase provided herein. In some aspects, a recombinant nucleic acid may comprise or encode any guide RNA provided herein can be used in any composition, system or method provided herein. In some aspects, a recombinant nucleic acid can comprise any donor polynucleotide provided herein can be used in any composition, system or method provided herein. In an aspect, a vector provided herein comprises any recombinant nucleic acid provided herein. In another aspect, a cell provided herein comprises a recombinant nucleic acid provided herein. In another aspect, a cell provided herein comprises a vector provided herein.

As used herein, the term "recombination" refers to the process by which two DNA molecules exchange nucleotide sequences. In some aspects, the compositions, systems or methods provided herein promote recombination between two DNA molecules. In some embodiments, recombination occurs between two sets of parental chromosomes. In some embodiments, recombination occurs between two homologous chromosomes. In some embodiments, recombination occurs between non-homologous chromosomes. In some embodiments, recombination occurs between homoeologous chromosomes. In some embodiments, recombination results in the production of a new gene sequence, number of genes, arrangement of genes, allele or combination of alleles. Many methods for detecting recombination are know in the art and include, but are not limited to, 1) phenotypic screening, 2) molecular marker technologies such as single nucleotide polymorphism—SNP analysis by TaqMan® or Illumina/Infinium technology, 3) Southern blot, and 4) sequencing.

As used herein, the term "recombination event" refers to an instance of recombination between two DNA molecules.

As used herein, the term "recombination rate" refers to the probability that a recombination event will occur between two genomic loci. The recombination rate may be influenced by a number of factors, including, but not limited to, the distance between two genomic loci, the chromosomal region (e.g., centromereic, telomereic) in which the loci occur, transcriptional activity, the presence of chromosomal inversions and other factors. Methods for measuring recombination include, but are not limited to, linkage analysis in mapping populations, and quantitative technologies such as quantitative PCR (qPCR) or droplet digital PCR (ddPCR), as described in the present disclosure. In some aspects, the compositions, systems or methods provided herein increase the recombination rate. As used herein, the term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif. (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as meristem, or particular cell types (e.g., pollen). Regulatory elements may also direct expression in a temporal-dependent manner, such as in a cell-cycle dependent or developmental stage-dependent manner, which may or may not also be tissue or cell-type specific. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); and SV40 enhancer.

As used herein, the terms "target sequence" or "target site" refer to a nucleotide sequence modified by a CRISPR-associated transposase as described herein. A target sequence may be genic or non-genic. In some aspects, a target sequence provided herein comprises a genic region. In other aspects, a target sequence provided herein comprises an intergenic region. In yet another aspect, a target sequence provided herein comprises both a genic region and an intergenic region. In an aspect, a target sequence provided herein comprises a coding nucleic acid sequence. In another aspect, a target sequence provided herein comprises a non-coding nucleic acid sequence. In an aspect, a target sequence provided herein is located in a promoter. In another aspect, a target sequence provided herein comprises an enhancer sequence. In yet another aspect, a target sequence provided herein comprises both a coding nucleic acid sequence and a non-coding nucleic acid sequence. In one aspect, a target sequence provided herein is cleaved by a double-strand break inducing agent, such as a CRISPR-associated transposase as described herein.

Novel CRISPR-Associated Transposases

The present disclosure provides polynucleotide sequences and amino acid sequences of novel CRISPR-associated transposases identified from various bacterial genomes. In some embodiments, the CRISPR-associated transposases provided herein comprise an amino acid sequence selected from SEQ ID NOs: 124-246 and 275-287, fragments thereof, homologs thereof and orthologs thereof. The terms "ortholog" and "homolog" are well known in the art. A "homologue" of a CRISPR-associated transposase as described herein is a protein isolated from the same species which performs the same or a similar function as the protein it is a homolog of Homologous proteins may, but need not, be structurally related, or are only partially structurally related. An "ortholog" of a CRISPR-associated transposase as described herein is a protein isolated from a different species which performs the same or a similar function as the protein it is an ortholog of. Orthologous proteins may but need not be structurally related, or are only partially structurally related. Homologs and orthologs may be identified by homology modeling or structural BLAST (Dey F, Cliff Zhang Q, Petrey D, Honig B. Toward a "structural BLAST": using structural relationships to infer function. Protein Sci. 2013 April; 22(4):359-66. doi: 10.1002/pro.2225.). In some embodiments, the homolog or ortholog of a novel CRISPR-associated transposase as described herein has a sequence homology or identity of at least 80%, at least 85%, at least 90%, at least 95%, at least 96%, at least 97%, at least 98%, or at least 99% with a CRISPR-associated transposase comprising an amino acid sequence selected from SEQ ID NOs: 124-246 and 275-287.

In some embodiments, the CRISPR-associated transposase provided herein form a complex with a guide RNA that directs the CRISPR-associated transposase to a target site where the CRISPR-associated transposase introduces a single-strand break or a double-strand break (DSB) in a nucleic acid sequence. The targeted nucleic acid sequence can be DNA, RNA, or a DNA/RNA hybrid. The introduced DSB can be repaired by non-homologous end joining (NHEJ) creating high likelihood of introducing small insertions or deletions (Indels) leading to frame shift mutations. Alternatively, a DNA sequence with desired mutation can be substituted at the region of DSB when homology dependent repair (HDR) pathway is applied. In some embodiments a recombinant nucleic acid comprising a one or more transgenes is integrated at the target site.

The instant disclosure also provides a recombinant nucleic acid comprising a heterologous promoter operably linked to a polynucleotide encoding a CRISPR-associated transposase as described herein. In some embodiments, the CRISPR-associated transposases provided herein are encoded by a polynucleotide sequence comprising a sequence selected from SEQ ID NOs: 1-123, 604-627 and 2020-3379, or a fragment thereof. In some embodiments, the CRISPR-associated transposases provided herein are encoded by a polynucleotide sequence comprising a sequence having at least 80% identity, at least 81% identity, at least 82% identity, at least 83% identity, at least 84% identity, at least 85% identity, at least 90% identity, at least 91% identity, at least 92% identity, at least 93% identity, at least 94% identity, at least 95% identity, at least 96% identity, at least 97% identity, at least 98% identity, or at least 99% identity to a sequence selected from SEQ ID NOs: 1-123, 604-627 and 2020-3379, or a fragment thereof. In one aspect, a recombinant nucleic acid provided herein comprises one or more, two or more, three or more, four or more, five or more, six or more, seven or more, eight or more, nine or more, or ten or more heterologous promoters operably linked to one or more, two or more, three or more, four or more, five or more, six or more, seven or more, eight or more, nine or more, or ten or more polynucleotides encoding a CRISPR-associated transposase. In some embodiments, a recombinant nucleic acid provided herein encodes one or more, two or more, three or more, four or more, five or more, six or more, seven or more, eight or more, nine or more, or ten or more guide RNAs. As used herein, the term "guide RNA" refers to an RNA molecule comprising a nucleotide sequence that can guide CRISPR enzyme to a target DNA molecule by hybridizing to a target sequence. In one aspect, a guide RNA provided herein comprises a CRISPR RNA (crRNA). In one aspect, a guide RNA provided herein comprises a CRISPR RNA (crRNA) complexed with a trans-activating CRISPR RNA (tracrRNA). In another aspect, a guide RNA provided herein comprises a single-chain guide RNA. In an aspect, a single-chain guide RNA provided herein comprises both a crRNA and a tracrRNA.

In some embodiments, a recombinant nucleic acid provided herein comprises a polynucleotide encoding a guide RNA. In an aspect, a recombinant nucleic acid provided herein comprises one or more, two or more, three or more, four or more, five or more, six or more, seven or more, eight or more, nine or more, or ten or more polynucleotides encoding one or more, two or more, three or more, four or more, five or more, six or more, seven or more, eight or more, nine or more, or ten or more guide RNAs. In one aspect, a polynucleotide encoding a guide RNA provided herein is operably linked to a second promoter. In one aspect, a polynucleotide encoding a guide RNA provided herein is operably linked to a U6 snRNA promoter. In one aspect, a polynucleotide encoding a guide RNA provided herein is operably linked to a U6 snRNA promoter as described in WO20150131101, incorporated by reference herein. In another aspect, a guide RNA provided herein is an isolated RNA. In an aspect, a guide RNA provided herein is encoded in a viral vector, a plasmid vector, or an *Agrobacterium* vector. In an aspect, a guide RNA provided herein comprises a crRNA. In an aspect, a guide RNA provided herein comprises a tracrRNA. In another aspect, a guide RNA provided herein comprises a single-chain guide RNA. In an aspect, a single-chain guide RNA provided herein comprises both a crRNA and a tracrRNA.

In some embodiments, a recombinant nucleic acid provided herein comprises one or more, two or more, three or more, four or more, five or more, six or more, seven or more, eight or more, nine or more, or ten or more donor polynucleotides. As used herein, a "donor polynucleotide" is a polynucleotide molecule capable of being inserted into a genome of a recipient cell using a CRISPR-associated transposase or method as described herein. In another aspect, a donor polynucleotide provided herein is operably linked to a second promoter. In yet another aspect, a donor polynucleotide provided herein comprises at least one promoter. In an aspect, a donor polynucleotide provided herein comprises one or more, two or more, three or more, four or more, five or more, six or more, seven or more, eight or more, nine or more, or ten or more transgenes. In an aspect, a donor polynucleotide provided herein comprises one or more, two or more, three or more, four or more, five or more, six or more, seven or more, eight or more, nine or more, or ten or more coding nucleic acid sequences, one or more, two or more, three or more, four or more, five or more, six or more, seven or more, eight or more, nine or more, or ten or more non-coding nucleic acid sequences, or a combination of one or more, two or more, three or more, four or more, five or more, six or more, seven or more, eight or more, nine or more, or ten or more coding nucleic acid sequences and one or more, two or more, three or more, four or more, five or more, six or more, seven or more, eight or more, nine or more, or ten or more non-coding nucleic acid sequences. In an aspect, a donor polynucleotide provided herein comprises one or more, two or more, three or more, four or more, five or more, six or more, seven or more, eight or more, nine or more, or ten or more nucleic acid sequences for templated editing. In some embodiments, a recombinant nucleic acid comprising a donor polynucleotide is provided to a cell in the same vector as a CRISPR-associated transposase. In some embodiments, a recombinant nucleic acid comprising a donor polynucleotide is provided to a cell independently of a CRISPR-associated transposase. In an aspect, a donor polynucleotide provided herein is encoded in a viral vector, a plasmid vector, or an *Agrobacterium* vector.

In some embodiments, a polynucleotide encoding the CRISPR-associated transposase is from the genome of a bacterium selected from the group consisting of: *Lysinibacillus* sp., *Brevibacillus* sp., *Sphingobium* sp., *Undibacterium* sp., *Bacillus* sp., *Chryseobacterium* sp., *Sphingomonas* sp., *Paenibacillus* sp., *Streptomyces* sp., *Stenotrophomonas* sp., and *Labrys* sp. In other embodiments, a polynucleotide encoding the CRISPR-associated transposase is from the genome of a bacterium selected from the group consisting of: *Brevibacillus laterosporus*; *Bacillus thuringiensis*; *Bacillus weihenstephanensis*; *Bacillus megaterium*; *Enterococcus faecalis*; *Brevibacillus brevis*; *Undibacterium pigrum*; *Novosphingobium rosa*; *Labrys methylaminiphilus*; *Brevibacillus parabrevis*; *Paenibacillus thiaminolyticus*; *Paenibacillus lentimorbus*; and *Paenibacillus terrae*. In certain aspects, a polynucleotide encoding the CRISPR-associated transposase is associated within the bacterial genome with a CRISPR repeat locus. In certain aspects, a polynucleotide encoding the CRISPR-associated transposase is further identified in the bacterial genome by associated with a Cas1, a Cas2, or a Cas1 and a Cas2 but not Cas5 or Cas3. In some embodiments, the polynucleotide encoding the CRISPR-associated transposase is located in the same operon as the CRISPR locus. In other embodiments, the polynucleotide encoding the CRISPR-associated transposase is located within 2.5 kilobases of the CRISPR loci. In another embodiment, the polynucleotide encoding the CRISPR-associated transposase is further identified by the presence of one or more pfam domains identified in Table 5. In an aspect, a polynucleotide encoding a CRISPR-associated transposase provided herein is characterized by: being from a genome of a *Lysinibacillus* sp., a *Brevibacillus* sp., a *Sphingobium* sp., a *Undibacterium* sp., a *Bacillus* sp., a *Chryseobacterium* sp., a *Sphingomonas* sp., a *Paenibacillus* sp., a *Streptomyces* sp., a *Stenotrophomonas* sp., or a *Labrys* sp.; being from a genome of *Bacillus thuringiensis*, *Brevibacillus brevis*, *Brevibacillus laterosporus*, *Brevibacillus parabrevis*, *Bacillus weihenstephanensis*, *Bacillus megaterium*, *Enterococcus faecalis*, *Labrys methylaminiphilus*, *Novosphingobium rosa*, *Paenibacillus thiaminolyticus*, *Paenibacillus lentimorbus*, *Paenibacillus terrae* or *Undibacterium pigrum*; being associated with a bacterial genome by association with a CRISPR repeat locus; being identified in a bacterial genome by association with a Cas1 protein, a Cas2 protein, or a Cas1 protein and a Cas2 protein, but not a Cas3 protein or Cas5 protein; being located in the same operon as a CRISPR loci; being located within 10, 25, 50, 75, 100, 150, 200, 250, 500, 550, 600, 650, 700, 750, 800, 850, 900, 950, 1000, 1250, 1500, 1750, 2000, 2500, 3000, 4000, 5000, 7500, or 10,000 nucleotides of a CRISPR loci; being a polynucleotide comprising a sequence encoding a protein having at least 80%, at least 85%, at least 90%, at least 91%, at least 92%, at least 93%, at least 94%, at least 95%, at least 96%, at least 97%, at least 98%, at least 99% or 100% identity to a sequence selected from SEQ ID NOs: 124-246 and 275-287; and any combination thereof.

Several embodiments described herein relate to targeted genome modification in eukaryotic cells, for example, plant cells. Some embodiments relate to a composition for cleaving a target DNA comprising a CRISPR-associated transposase as described herein, and the use thereof. In some embodiments, the CRISPR-associated transposase is selected from the group consisting of SEQ ID NOs:124-246 and 275-287, homologs thereof and orthologs thereof. In some embodiments, a complex comprising CRISPR-associated transposase and a guide RNA specific for a target DNA is described. In some embodiments, the complex further comprises a divalent cation. In some embodiments the CRISPR-associated transposase, when complexed with a guide RNA, effects cleavage of the target DNA thereby modifying the target DNA. In some embodiments, cleavage comprises cleaving one or two strands at the location of the target DNA by the CRISPR-associated transposase. In some embodiments, formation of a complex comprising a CRISPR-associated transposase and a guide RNA results in cleavage of one or both strands in or near (e.g. within 1, 2, 3, 4, 5, 6, 7, 8, 9, 10, 20, 50, or more base pairs from) the target sequence. In some embodiments, cleavage results in decreased transcription of a target gene. In some embodiments, cleavage results in an increase recombination rate between two genomic loci. In some embodiments, cleavage results in integration of one ore more transgenes. In some embodiments, cleavage results in integration of a cis-genic sequence. In some embodiments, cleavage results in an insertion or deletion of nucleotides at or near the target sequence. In some embodiments, the cleaved target DNA is repaired by homologous recombination with an exogenous template polynucleotide. In some embodiments, the template polynucleotide comprises one or more exogenous transgenes. In some embodiments, the one or more exogenous transgenes are flanked by sequence homologous to the cleavage site. In some embodiments, the template polynucleotide comprises a sequence that has at least at least 85% identity, at least 90% identity, at least 91% identity, at least 92% identity, at least 93% identity, at least 94% identity, at least 95% identity, at least 96% identity, at least 97% identity, at least 98% identity, at least 99% identity, or 100% identity, to at least 50 bp, at least 100 bp, at least 150 bp, at least 200 bp, at least 250 bp, at least 300 bp, at least 350 bp, at least 400 bp, at least 450 bp, at least 500 bp, at least 550 bp, at least 600 bp, at least 650 bp, at least 700 bp, at least 750 bp, at least 800 bp, at least 850 bp, at least 900 bp, at least 950 bp, or at least 1,000 bp of a nucleic acid sequence comprising the target sequence. In some embodiments, the template polynucleotide comprises 1, 2, 3, 4, 5, 6, 7, 8, 9, 10 or more nucleotide mutations compared to the target sequence. In some embodiments, the cleaved target DNA is repaired by non-homologous end joining (NHEJ) wherein said repair results in a mutation comprising an insertion, deletion, or substitution of one or more nucleotides of said target DNA.

Several embodiments relate to a method of modifying a targeted DNA sequence in a eukaryotic cell. In some embodiments, the method comprises allowing a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287 cleave the targeted DNA sequence. In some embodiments, the CRISPR-associated transposase complexed with a guide RNA cleaves a targeted DNA sequence. In some embodiments, the method comprises delivering one or more vectors to said eukaryotic cells, wherein the one or more vectors drive expression of one or more of: the CRISPR-associated transposase, a guide RNA, and a donor polynucleotide.

In an aspect, the disclosure provides methods of identifying putative CRISPR-associated transposases from bacterial genomes. In some embodiments, the method comprises: (a) identification of large protein sequences (approximately 1,000 amino acids); (b) that these protein sequences were located in the same operon with a Cas1 and a Cas2, but not a Cas5 or a Cas3; and (c) that the proteins were in the same operon within <2.5 kb of a CRISPR loci. In some embodiments, the method comprises: (a) identification of large protein sequences (approximately 1,000 amino acids); (b) that these protein sequences comprise one or more pfam domains as described in Table 5; and (c) that the proteins were in the same operon within <2.5 kb of a CRISPR loci.

Nucleic Acid-Targeting Systems and Components Thereof

The present disclosure provides a nucleic acid-targeting system for sequence-specific modification of a target nucleic acid sequence. As used herein, the terms "nucleic acid-targeting system" refers to transcripts and other elements involved in the expression of or directing the activity of CRISPR-associated transposases, which may include sequences encoding a CRISPR-associated transposase. In some embodiments, the CRISPR-associated transposase comprises an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287. In some embodiments, the nucleic acid-targeting system comprises a CRISPR RNA (crRNA) sequence that acts as a nucleic acid-targeting guide RNA. In some embodiments, the crRNA sequence comprises a CRISPR repeat sequence as described in Table 9, or a portion thereof. In some embodiments, the nucleic acid-targeting system comprises (in some systems, but not all systems) a trans-activating CRISPR RNA (tracrRNA) sequence, or other sequences and transcripts from a CRISPR locus. In some systems, a tracrRNA sequence is not required. In other systems, a tracrRNA sequence is required. In some embodiments, the targeted nucleic acid is DNA or RNA. In other embodiments, the targeted nucleic acid is a DNA-RNA hybrid or derivatives thereof. In some embodiments, a targeted nucleic acid is located in the nucleus or cytoplasm of a cell. In some embodiments, the nucleic acid-targeting system further comprises a divalent cation. In some embodiments, the nucleic acid-targeting system further comprises Mg2+. In some embodiments, the nuclease activity of the CRISPR-associated transposase is inactivated. In some embodiments, the nucleic acid-targeting system further comprises a CRISPR-associated transposase with a heterologous functional domain. In some embodiments, the nucleic acid-targeting system is functional in a eukaryotic cell. In some embodiments, the nucleic acid-targeting system is functional in a plant cell.

In an embodiment, the nucleic acid-targeting system comprises a polynucleotide encoding a CRISPR-associated transposase. In a further embodiment, the CRISPR-associated transposase comprises an amino acid sequence having at least 85%, at least 90%, at least 91%, at least 92%, at least 93%, at least 94%, at least 95%, at least 96%, at least 97%, at least 98%, at least 99%, or 100% identity to a sequence selected from the group consisting of SEQ ID NOs: 124-246 and 275-287. In another embodiment, the polynucleotide encoding the CRISPR-associated transposase comprises a nucleotide sequence selected from the group consisting of SEQ ID NOs: 1-123, 604-627 and 2020-3379. In some embodiments, the nucleic acid-targeting system further comprises a guide RNA or a DNA molecule encoding a guide RNA, wherein the guide RNA is comprises a sequence that is complementary to a target nucleic acid sequence. In some embodiments, the guide RNA or a DNA molecule encoding a guide RNA is provided on a first nucleic acid molecule and the polynucleotide encoding the CRISPR-associated transposase is provided on a second nucleic acid molecule. In other embodiments, the guide RNA or a DNA molecule encoding a guide RNA and the polynucleotide encoding a CRISPR-associated transposase is are provided on a single nucleic acid molecule. In some embodiments, the guide RNA comprises a portion of one or more crRNA sequences provided in Tables 8, 9 and 10. In some embodiments, the guide RNA comprises a CRISPR repeat sequence of one or more crRNA sequences provided in Table 8. In some embodiments, the guide RNA comprises a CRISPR repeat sequence as described in Table 9. In some embodiments, the guide RNA comprises a CRISPR repeat sequence as described in Table 10.

In some embodiments, the target nucleic acid sequence comprises coding sequence, non-coding sequence, or a combination of coding and non-coding sequence. In some embodiments, the target nucleic acid sequence comprises an endogenous gene or a transgene.

In some embodiments, the guide RNA comprises a crRNA and a tracrRNA. In some embodiments, the guide RNA comprises a single-chain guide RNA. In some embodiments, the guide RNA comprises a single-chain guide RNA comprising a crRNA. In some embodiments, the crRNA comprises a portion of a crRNA sequence provided in Tables 9 and 10.

In some embodiments, the nucleic acid-targeting system disclosed herein further comprises a donor polynucleotide. In some embodiments, the donor polynucleotide comprises a coding sequence, a non-coding sequence, or a combination of coding and non-coding sequence. In some embodiments, the donor polynucleotide comprises a promoter. In some embodiments, the donor polynucleotide comprises a regulatory element. In some embodiments, the donor polynucleotide comprises one or more transgenes.

As used herein, the term "guide RNA" refers to any polynucleotide sequence having sufficient complementarity with a target nucleic acid sequence to hybridize with the target nucleic acid sequence and direct sequence-specific binding of a CRISPR-associated transposase to the target nucleic acid sequence. In some embodiments, the degree of complementarity, when optimally aligned using a suitable alignment algorithm, is about or more than about 50%, 60%, 75%, 80%, 85%, 90%, 91%, 92%, 93%, 94%, 95%, 96%, 97%, 98%, 99%, or more. Optimal alignment may be determined with the use of any suitable algorithm for aligning sequences.

In some embodiments, the guide RNA comprises a mature crRNA. In certain embodiments, the mature crRNA comprises, consists essentially of, or consists of a direct repeat sequence and a guide sequence or spacer sequence. Examples of direct repeat sequences and spacer sequences may be found in Tables 9 and 10. Examples of crRNA sequences may be found in Tables 8, 9 and 10. In certain embodiments, the guide RNA comprises, consists essentially of, or consists of a direct repeat sequence linked to a guide sequence or spacer sequence. In some embodiments, a guide RNA sequence is about or more than about 5, 10, 11, 12, 13, 14, 15, 16, 17, 18, 19, 20, 21, 22, 23, 24, 25, 26, 27, 28, 29, 30, 35, 40, 45, 50, 75, or more nucleotides in length. In some embodiments, a guide RNA sequence is less than about 75, 50, 45, 40, 35, 30, 25, 20, 15, 12, or fewer nucleotides in length. In some embodiments, the guide RNA sequence is 10-30 nucleotides long. In some embodiments, the guide RNA sequence is 10-20 nucleotides long. A guide RNA sequence may be selected to target any target sequence. In some embodiments, the target sequence is a sequence within a genome of a cell. In some embodiments, the target sequence is unique in the target genome.

In some embodiments, the mature crRNA comprises a stem loop or an optimized stem loop structure or an optimized secondary structure. In some embodiments the mature crRNA comprises a stem loop or an optimized stem loop structure in the direct repeat sequence, wherein the stem loop or optimized stem loop structure is important for cleavage activity. In certain embodiments, the mature crRNA comprises a single stem loop. In certain embodiments, the direct repeat sequence comprises a single stem loop. In certain embodiments, the cleavage activity of the nucleic acid-targeting system is modified by introducing mutations that affect the stem loop RNA duplex structure. In some embodiments, mutations which maintain the RNA duplex of the stem loop may be introduced, whereby the cleavage activity of the nucleic acid-targeting system is maintained. In other embodiments, mutations which disrupt the RNA duplex structure of the stem loop may be introduced, whereby the cleavage activity of the nucleic acid-targeting system is completely abolished.

The ability of a guide RNA sequence to direct sequence-specific binding of a nucleic acid-targeting system to a target nucleic acid sequence may be assessed by any suitable assay. For example, the components of a nucleic acid-targeting system sufficient to form a nucleic acid-targeting complex, including the CRISPR-associated transposase and guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence. Similarly, cleavage of a target nucleic acid sequence may be evaluated in vitro by providing the target nucleic acid sequence, components of a nucleic acid-targeting system, including the CRISPR-associated transposase and/or guide sequence to be tested and a control guide sequence different from the test guide sequence, and comparing binding or rate of cleavage at the target sequence between the test and control guide sequence reactions. Other assays are possible, and will occur to those skilled in the art. A guide sequence, and hence a nucleic acid-targeting guide RNA may be selected to target any target nucleic acid sequence. The target sequence may be DNA. The target sequence may be any RNA sequence. In some embodiments, the target sequence may be a sequence within a RNA molecule selected from the group consisting of messenger RNA (mRNA), pre-mRNA, ribosomal RNA (rRNA), transfer RNA (tRNA), micro-RNA (miRNA), small interfering RNA (siRNA), small nuclear RNA (snRNA), small nucleolar RNA (snoRNA), double stranded RNA (dsRNA), non coding RNA (ncRNA), long non-coding RNA (lncRNA), and small cytoplasmatic RNA (scRNA). In some embodiments, the target sequence may be a sequence within a RNA molecule selected from the group consisting of mRNA, pre-mRNA, and rRNA. In some embodiments, the target sequence may be a sequence within a RNA molecule selected from the group consisting of ncRNA, and lncRNA. In some embodiments, the target sequence may be a sequence within an mRNA molecule or a pre-mRNA molecule.

As used herein, the term "tracrRNA" includes any polynucleotide sequence that has sufficient complementarity with a crRNA sequence to hybridize. In some embodiments, the tracrRNA is not required for cleavage activity of a nucleic acid-targeting system. In other embodiments, the tracrRNA is required for cleavage activity of a nucleic acid-targeting system.

In some embodiments, one of more components of a nucleic acid-targeting system disclosed herein are expressed or delivered in a vector. As used herein, the term "vector" refers to a nucleic acid molecule capable of transporting another nucleic acid to which it has been linked. Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid", which refers to a circular double stranded DNA loop into which additional DNA segments can be inserted, such as by standard molecular cloning techniques. Another type of vector is an *Agrobacterium*. Another type of vector is a viral vector, wherein virally-derived DNA or RNA sequences are present in the vector for packaging into a virus (e.g., retroviruses, replication defective retroviruses, Tobacco mosaic virus (TMV), Potato virus X (PVX) and Cowpea mosaic virus (CPMV), tobamovirus, Gemini viruses, adenoviruses, replication defective adenoviruses, and adeno-associated viruses). Viral vectors also include polynucleotides carried by a virus for transfection into a host cell. In some embodiments, a viral vector may be delivered to a plant using *Agrobacterium*. Certain vectors are capable of autonomous replication in a host cell into which they are introduced. Other vectors are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors". Vectors for and that result in expression in a eukaryotic cell can be referred to herein as "eukaryotic expression vectors." Common expression vectors of utility in recombinant DNA techniques are often in the form of plasmids. It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.).

Recombinant expression vectors can comprise a nucleic acid of the disclosure in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed.

As used herein, the terms "template nucleic acid" or "donor polynucleotide" may be used interchangeably and refer to a nucleic acid sequence which can be used in conjunction with a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287 or an ortholog or homolog thereof to alter the structure of a target sequence. In some embodiments, the template nucleic acid or donor polynucleotide comprises one or more, two or more, three or more, four or more, five or more transgenes. In an embodiment, the target sequence is modified to have some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA.

In an embodiment, the template nucleic acid alters the structure of the target sequence by participating in homologous recombination. In an embodiment, the template nucleic acid alters the sequence of the target position. In an embodiment, the template nucleic acid results in the incorporation of a modified, or non-naturally occurring base into the target nucleic acid.

The template sequence may undergo a breakage mediated or catalyzed recombination with the target sequence. In an embodiment, the template nucleic acid may include sequence that corresponds to a site on the target sequence that is cleaved by a nucleic acid-targeting system mediated cleavage event. In an embodiment, the template nucleic acid may include sequence that corresponds to both, a first site on the target sequence that is cleaved in a first nucleic acid-targeting system mediated event, and a second site on the target sequence that is cleaved in a second nucleic acid-targeting system mediated event.

In certain embodiments, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation. In certain embodiments, the template nucleic acid can include sequence which results in an alteration in a non-coding sequence, e.g., an alteration in an exon or in a 5' or 3' non-translated or non-transcribed region. Such alterations include an alteration in a regulatory element, e.g., a promoter, enhancer, and an alteration in a cis-acting or trans-acting control element.

A template nucleic acid having homology with a target sequence in a target gene may be used to alter the structure of a target gene. The template sequence may be used to alter an unwanted structure, e.g., an unwanted or mutant nucleotide. The template nucleic acid may include sequence which, when integrated, results in: decreasing the activity of a positive regulatory element; increasing the activity of a positive regulatory element; decreasing the activity of a negative regulatory element; increasing the activity of a negative regulatory element; decreasing the expression of a gene; increasing the expression of a gene; increasing resistance to a herbicide; increasing resistance to a disease; increasing resistance to a insect or nematode pest; increasing resistance to an abiotic stress (e.g., drought, nitrogen deficiency); increasing resistance to viral entry; correcting a mutation or altering an unwanted amino acid residue conferring, increasing, abolishing or decreasing a biological property of a gene product, e.g., increasing the enzymatic activity of an enzyme, or increasing the ability of a gene product to interact with another molecule.

In some embodiments, a template nucleic acid may include sequence which results in: a change in sequence of 1, 2, 3, 4, 5, 6, 7, 8, 9, 10, 11, 12 or more nucleotides of the target sequence. In an embodiment, the template nucleic acid may be 20+/−10, 30+/−10, 40+/−10, 50+/−10, 60+/−10, 70+/−10, 80+/−10, 90+/−10, 100+/−10, 110+/−10, 120+/−10, 130+/−10, 140+/−10, 150+/−10, 160+/−10, 170+/−10, 180+/−10, 190+/−10, 200+/−10, 210+/−10, of 220+/−10 nucleotides in length. In an embodiment, the template nucleic acid may be 30+/−20, 40+/−20, 50+/−20, 60+/−20, 70+/−20, 80+/−20, 90+/−20, 100+/−20, 110+/−20, 120+/−20, 130+/−20, 140+/−20, I 50+/−20, 160+/−20, 170+/−20, 180+/−20, 190+/−20, 200+/−20, 210+/−20, of 220+/−20 nucleotides in length. In an embodiment, the template nucleic acid is 10 to 1,000, 20 to 900, 30 to 800, 40 to 700, 50 to 600, 50 to 500, 50 to 400, 50 to 300, 50 to 200, or 50 to 100 nucleotides in length.

In some embodiments, a donor nucleic acid comprises the following components: [5' homology arm]-[sequence of interest]-[3' homology arm]. The homology arms provide for recombination into the chromosome. In some embodiments, the sequence of interest replaces an undesired element, e.g., a mutation or signature, with the sequence of interest. In some embodiments, the sequence of interest comprises one or more, two or more, three or more, four or more, or five or more transgenes. In an embodiment, the homology arms flank the most distal cleavage sites. In an embodiment, the 3' end of the 5' homology arm is the position next to the 5' end of the sequence of interest. In an embodiment, the 5' homology arm can extend at least 10, 20, 30, 40, 50, 100, 200, 300, 400, 500, 600, 700, 800, 900, 1000, 1500, or 2000 nucleotides 5' from the 5' end of the sequence of interest. In an embodiment, the 5' end of the 3' homology arm is the position next to the 3' end of the sequence of interest. In an embodiment, the 3' homology arm can extend at least 10, 20, 30, 40, 50, 100, 200, 300, 400, 500, 600, 700, 800, 900, 1000, 1500, or 2000 nucleotides 3' from the 3' end of the sequence of interest.

In certain embodiments, one or both homology arms may be shortened to avoid including certain sequence repeat elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

In certain embodiments, a donor nucleic acid may designed for use as a single-stranded oligonucleotide. When using a single-stranded oligonucleotide, 5' and 3' homology arms may range up to about 200 bases in length, e.g., at least 25, 50, 75, 100, 125, 150, 175, or 200 bases in length.

In certain embodiments, the components of the nucleic acid-targeting system may further comprise at least one or more nuclear localization signal (NLS), nuclear export signal (NES), functional domain, flexible linker, mutation, deletion, alteration or truncation. The one or more of the NLS, the NES or the functional domain may be conditionally activated or inactivated.

In some embodiments, the nucleic acid-targeting system as described herein is functional at 20° C., 21° C., 22° C., 23° C., 24° C., 24° C., 25° C., 26° C., 27° C., 28° C., 29° C., 30° C., 31° C., 32° C., 33° C., 34° C., 35° C., 36° C., 37° C., 38° C., 39° C., 40° C., 41° C., 42° C., 43° C., 44° C., 45° C., 46° C., 47° C., 48° C., 49° C., or 50° C.

In certain embodiments, one or more components of a nucleic acid-targeting system are comprised on one or more vectors for delivery to a eukaryotic cell. In some embodiments, one or more vector(s) encode(s): one or more of (i) one or more CRISPR-associated transposases, more particularly, one or more CRISPR-associated transposases comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287; (ii) a first guide RNA capable of hybridizing to a first target sequence in a cell; and (iii) a second guide RNA capable of hybridizing to a second target sequence in the cell. Not wishes to be bound by a particular theory, the first guide RNA directs a first CRISPR-associated transposase to the first target sequence in the cell; the second guide RNA directs a second CRISPR-associated transposase to the second target sequence in the celle. The various coding sequences (CRISPR-associated transposase, guide RNAs) can be included on a single vector or on multiple vectors. For instance, it is possible to encode the CRISPR-associated transposase on one vector and the various RNA sequences on another vector, or to encode the CRISPR-associated transposase and various guide RNAs on one vector, and donor nucleic acids on additional vectors, or any other permutation. In an aspect, a system uses a total of one, two, three, four, five or more different vectors. Where multiple vectors are used, it is possible to deliver them in unequal numbers.

In certain embodiments, recombinant nucleic acids encoding guide RNAs may be designed in an array format such that multiple guide RNA sequences can be simultaneously released. In some embodiments, expression of one or more guide RNAs is U6-driven. In some embodiments, CRISPR-associated transposases complex with multiple guide RNAs to mediate genome editing and at multiple target sequences. Some embodiments relate to expression of singly or in tandem array format from 1 up to 4 or more different guide sequences; e.g. up to about 20 or about 30 guides sequences. Each individual guide sequence may target a different target sequence. Such may be processed from, e.g. one chimeric pol3 transcript. Pol3 promoters such as U6 or H1 promoters may be used. Pol2 promoters such as those mentioned throughout herein. Inverted terminal repeat (iTR) sequences may flank the Pol3 promoter-gRNA(s)-Pol2 promoter-Cas.

In another embodiment, a construct that will transiently express a gRNA and/or CRISPR-associated transposase is created and introduced into a cell. In yet another embodiment, the vector will produce sufficient quantities of the gRNAs and/or CRISPR-associated transposase in order for the desired episomal or genomic target site or sites to be effectively modified by a nucleic acid-targeting system as described herein. For instance, the disclosure contemplates preparation of a vector that can be bombarded, electroporated, chemically transfected or transported by some other means across the plant cell membrane. Such a vector could have several useful properties. For instance, in one embodiment, the vector can replicate in a bacterial host such that the vector can be produced and purified in sufficient quantities for transient expression. In another embodiment, the vector can encode a drug resistance gene to allow selection for the vector in a host, or the vector can also comprise an expression cassette to provide for the expression of the gRNA and/or CRISPR-associated transposase in a plant. In a further embodiment, the expression cassette could contain a promoter region, a 5' untranslated region, an optional intron to aid expression, a multiple cloning site to allow facile introduction of a sequence encoding gRNAs and/or CRISPR-associated transposases, and a 3' UTR. In particular embodiments, the promoters in the expression cassette would be U6 promoters from Zea maize. In yet other embodiments, the promoters would be chimeric U6 promoters from Zea maize. In some embodiments, it can be beneficial to include unique restriction sites at one or at each end of the expression cassette to allow the production and isolation of a linear expression cassette, which can then be free of other vector elements. The untranslated leader regions, in certain embodiments, can be plant-derived untranslated regions. Use of an intron, which can be plant-derived, is contemplated when the expression cassette is being transformed or transfected into a monocot cell.

In some embodiments, a recombinant nucleic acid as described herein may comprise multiple U6 promoters with differing sequences. A utility of having multiple U6 promoters with differing sequence is to minimize problems in vector stability, which is typically associated with sequence repeats. Further, highly repetitive regions in chromosomes may lead to genetic instability and silencing. Therefore, another utility of using multiple U6 promoters in the nucleic acid-targeting system is to facilitate vector stacking of multiple gRNA cassettes in the same transformation construct, where the differing gRNA transcript levels are to be maximized for efficient targeting of a single target site. Chimeric U6 promoters can result in new, functional versions with improved or otherwise modified expression levels.

In several embodiments, an expression vector comprises at least one expression cassette encoding one or more components of a nucleic acid-targeting system as described herein may comprise a promoter. In certain embodiments, the promoter is a constitutive promoter, a tissue specific promoter, a developmentally regulated promoter, or a cell cycle regulated promoter. Certain contemplated promoters include ones that only express in the germline or reproductive cells, among others. Such developmentally regulated promoters have the advantage of limiting the expression of the nucleic acid-targeting system to only those cells in which DNA is inherited in subsequent generations. Therefore, a nucleic acid-targeting system mediated genetic modification (i.e., chromosomal or episomal dsDNA cleavage) is limited only to cells that are involved in transmitting their genome from one generation to the next. This might be useful if broader expression of the nucleic acid-targeting system were genotoxic or had other unwanted effects. Examples of such promoters include the promoters of genes encoding DNA ligases, recombinases, replicases, and so on.

In some embodiments, the recombinant nucleic acid molecules described herein can be incorporated into any suitable plant transformation plasmid or vector. In some embodiments, the plant transformation plasmid or vector contains a selectable or screenable marker and associated regulatory elements as described, along with one or more nucleic acids encoded by a structural gene.

Inducible Nucleic Acid-Targeting System

In one aspect, the disclosure provides a non-naturally occurring or engineered nucleic acid-targeting system which may comprise at least one switch wherein the activity of the nucleic acid-targeting system is controlled by contact with at least one inducer energy source as to the switch. In an embodiment of the disclosure, the control as to the at least one switch or the activity of the nucleic acid-targeting system may be activated, enhanced, terminated or repressed. The contact with the at least one inducer energy source may result in a first effect and a second effect. The first effect may be one or more of nuclear import, nuclear export, recruitment of a secondary component (such as an effector molecule), conformational change (of protein, DNA or RNA), cleavage, release of cargo (such as a caged molecule or a cofactor), association or dissociation. The second effect may be one or more of activation, enhancement, termination or repression of the control as to the at least one switch or the activity of the nucleic acid-targeting system. In one embodiment the first effect and the second effect may occur in a cascade.

Aspects of control as detailed in this application relate to at least one or more switch(es). The term "switch" as used herein refers to a system or a set of components that act in a coordinated manner to affect a change, encompassing all aspects of biological function such as activation, repression, enhancement or termination of that function. In one aspect the term switch encompasses genetic switches which comprise the basic components of gene regulatory proteins and the specific DNA sequences that these proteins recognize. In one aspect, switches relate to inducible and repressible systems used in gene regulation. In general, an inducible system may be off unless there is the presence of some molecule (called an inducer) that allows for gene expression. The molecule is said to "induce expression". The manner by which this happens is dependent on the control mechanisms as well as differences in cell type. A repressible system is on except in the presence of some molecule (called a corepressor) that suppresses gene expression. The molecule is said to "repress expression". The manner by which this happens is dependent on the control mechanisms as well as differences in cell type. The term "inducible" as used herein may encompass all aspects of a switch irrespective of the molecular mechanism involved.

In another aspect of the disclosure the nucleic acid-targeting system may further comprise at least one or more nuclear localization signal (NLS), nuclear export signal (NES), functional domain, flexible linker, mutation, deletion, alteration or truncation. The one or more of the NLS, the NES or the functional domain may be conditionally activated or inactivated. In another embodiment, the mutation may be one or more of a mutation in a transcription factor homology region, a mutation in a DNA binding domain (such as mutating basic residues of a basic helix loop helix), a mutation in an endogenous NLS or a mutation in an endogenous NES. The disclosure comprehends that the inducer energy source may be heat, ultrasound, electromagnetic energy or chemical.

In some embodiments, the inducer energy source may be an antibiotic, a small molecule, a hormone, a hormone derivative, a steroid or a steroid derivative. In some embodiments, the inducer energy source may be abscisic acid (ABA), salicylic acid, doxycycline (DOX), cumate, rapamycin, 4-hydroxytamoxifen (4OHT), estrogen or ecdysone. The disclosure provides that the at least one switch may be selected from the group consisting of antibiotic based inducible systems, electromagnetic energy based inducible systems, small molecule based inducible systems, nuclear receptor based inducible systems and hormone based inducible systems.

The present nucleic acid-targeting system may be designed to modulate or alter expression of individual endogenous genes in a temporally and spatially precise manner. The nucleic acid-targeting system may be designed to bind to the promoter sequence of the gene of interest to change gene expression.

Another system contemplated by the present disclosure is a chemical inducible system based on change in sub-cellular localization. An inducible nucleic acid-targeting system may be engineered to target a genomic locus of interest where the CRISPR-associated transposase is split into two fusion constructs that are further linked to different parts of a chemical or energy sensitive protein. This chemical or energy sensitive protein will lead to a change in the sub-cellular localization of either half of the CRISPR-associated transposase upon the binding of a chemical or energy transfer to the chemical or energy sensitive protein. This transportation of fusion constructs from one sub-cellular compartments or organelles, in which its activity is sequestered due to lack of substrate for the reconstituted nucleic acid-targeting system, into another one in which the substrate is present would allow the components to come together and reconstitute functional activity and to then come in contact with its desired substrate (i.e. genomic DNA in the mammalian nucleus) and result in activation or repression of target gene expression.

Other inducible systems are contemplated such as, but not limited to, regulation by heavy-metals, steroid hormones, heat shock and other reagents have been developed.

In particular embodiments, the nucleic acid-targeting systems described herein are placed under the control of a passcode kill switch, which is a mechanisms which efficiently kills the host cell when the conditions of the cell are altered. In some embodiments, this is ensured by introducing hybrid Lacl-GalR family transcription factors, which require the presence of IPTG to be switched on (Chan et al. 2015 Nature Nature Chemical Biology doi:10.1038/nchembio.1979) which can be used to drive a gene encoding an enzyme critical for cell-survival. By combining different transcription factors sensitive to different chemicals, a "code" can be generated, This system can be used to spatially and temporally control the extent of nucleic acid-targeting system-induced genetic modifications, which can be of interest in different fields including therapeutic applications and may also be of interest to avoid the "escape" of transgene containing organisms from their intended environment.

Self-Inactivating Systems

In some embodiments, once all copies of a gene in the genome of a cell have been edited, continued nucleic acid-targeting system expression in that cell is no longer necessary. In some embodiments, sustained expression would be undesirable in case of off-target effects at unintended genomic sites, etc. In some embodiments, time-limited expression of components of the nucleic acid-targeting system would be useful. Inducible expression offers one approach, another approach may be a self-inactivating nucleic acid-targeting system that relies on the use of a non-coding guide target sequence within the vector itself. Thus, after expression begins, the nucleic acid-targeting system will lead to its own destruction, but before destruction is complete it will have time to edit the genomic copies of the target gene. In some embodiments, self inactivating nucleic acid-targeting system includes additional RNA (i.e., guide RNA) that targets the coding sequence for the CRISPR-associated transposase or that targets one or more non-coding guide target sequences complementary to unique sequences present in one or more of the following: (a) within the promoter driving expression of the non-coding RNA elements, (b) within the promoter driving expression of the CRISPR-associated transposase, (c) within 100 bp of the ATG translational start codon in the CRISPR-associated transposase coding sequence, (d) within the inverted terminal repeat (iTR) of a viral delivery vector.

In some embodiments, one or more guide RNAs can be delivered via a vector, e.g., a separate vector or the same vector that is encoding the CRISPR-associated transposase. When provided by a separate vector, a guide RNA that targets CRISPR-associated transposase expression can be administered sequentially or simultaneously. When administered sequentially, the guide RNA that targets CRISPR-associated transposase expression may be delivered after the guide RNA that is intended for gene editing or genome engineering. This period may be a period of minutes (e.g. 5 minutes, 10 minutes, 20 minutes, 30 minutes, 45 minutes, 60 minutes). This period may be a period of hours (e.g. 2 hours, 4 hours, 6 hours, 8 hours, 12 hours, 24 hours). This period may be a period of days (e.g. 2 days, 3 days, 4 days, 7 days). This period may be a period of weeks (e.g. 2 weeks, 3 weeks, 4 weeks). This period may be a period of months (e.g. 2 months, 4 months, 8 months, 12 months). This period may be a period of years (2 years, 3 years, 4 years). In some embodiments, the CRISPR-associated transposase associates with a first guide RNA capable of hybridizing to a first target, such as a genomic locus or loci of interest and undertakes the function(s) desired of the nucleic acid-targeting system (e.g., gene engineering); and subsequently the CRISPR-associated transposase may then associate with the second guide RNA capable of hybridizing to the sequence encoding at least part of the CRISPR-associated transposase. Where the guide RNA targets the sequences encoding expression of the CRISPR-associated transposase, the transposase becomes impeded and the system becomes self inactivating. In some embodiments, guide RNA that targets CRISPR-associated transposase expression applied via, for example particle bombardment, lipofection, nanoparticles, microvesicles, may be administered sequentially or simultaneously. Similarly, self-inactivation may be used for inactivation of one or more guide RNA used to target one or more targets.

In some aspects, a single guide RNA is provided that is capable of hybridizing to a sequence downstream of a start codon, thereby after a period of time there is a loss of CRISPR-associated transposase expression. In some aspects, one or more guide RNA(s) are provided that are capable of hybridizing to one or more coding or non-coding regions of the polynucleotide encoding one or more components the nucleic acid-targeting system, whereby after a period of time there is a inactivation of one or more, or in some cases all, of the components of the nucleic acid-targeting system. In some aspects, and not to be limited, a cell may comprise a plurality of CRISPR-associated enzymes, where a first CRISPR-associated enzyme targets a genomic locus or loci to be edited, and a second CRISPR-associated enzyme targets the polynucleotide encoding one or more components of the nucleic acid-targeting system. In some embodiments, the first and second CRISPR-associated enzymes are independently selected from the group consisting of Cas9, Cpf1, Ncc1 and CRISPR-associated transposase.

Modification of CRISPR-Associated Transposases

In an embodiment, nucleic acid molecule(s) encoding the CRISPR-associated transposases disclosed herein, or an ortholog or homolog thereof, may be codon-optimized for expression in an eukaryotic cell. In some embodiments, nucleic acid molecule(s) encoding the CRISPR-associated transposases disclosed herein, or an ortholog or homolog thereof, may be codon-optimized for expression in a plant cell. Examples of codon-optimized nucleic acid molecule(s) encoding the CRISPR-associated transposases are provided in Table 12. In some embodiments, a nucleic acid molecule may comprise one or more sequences selected from SEQ ID NOs: 2020-2699. In some embodiments, a nucleic acid molecule may comprise one or more sequences selected from SEQ ID NOs: 2700-3379. Nucleic acid molecule(s) can be engineered or non-naturally occurring. The terms "non-naturally occurring" or "engineered" are used interchangeably and indicate the involvement of the hand of man. The terms, when referring to nucleic acid molecules or polypeptides mean that the nucleic acid molecule or the polypeptide is at least substantially free from at least one other component with which they are naturally associated in nature and as found in nature. The nucleic acid-targeting systems described herein are non-naturally occurring.

In some embodiments, the CRISPR-associated transposases disclosed herein, or an ortholog or homolog thereof, may comprise one or more mutations (and hence nucleic acid molecule(s) coding for same may have mutation(s)). The mutations may be artificially introduced mutations and may include but are not limited to one or more mutations in a catalytic domain. Examples of catalytic domains with reference to a CRISPR-associated transposases may include but are not limited to RuvC I, RuvC II, RuvC III and IS605_ORFB domains.

In some embodiments, the CRISPR-associated transposases disclosed herein, or an ortholog or homolog thereof, may be used as a generic nucleic acid binding protein with fusion to or being operably linked to a functional domain. Examples of functional domains may include but are not limited to PvuII, MutH, TevI, FokI, AlwI, MlyI, SbfI, SdaI, StsI, CleDORF, Clo051, Pept071, recombinanse, transposase, methylase, translational initiator, translational activator, translational repressor, nucleases, in particular ribonucleases, a spliceosome, beads, a light inducible/controllable domain or a chemically inducible/controllable domain. The FokI nuclease domain requires dimerization to cleave DNA and therefore CRISPR-associated transposases with Fok1 functional domains are needed to bind opposite DNA strands of the cleavage site.

In some embodiments, the unmodified CRISPR-associated transposases may have cleavage activity. In some embodiments, the CRISPR-associated transposase directs cleavage of one or both nucleic acid (DNA or RNA) strands at the location of or near a target sequence, such as within the target sequence and/or within the complement of the target sequence or at sequences associated with the target sequence. In some embodiments, the CRISPR-associated transposase may direct cleavage of one or both DNA or RNA strands within about 1, 2, 3, 4, 5, 6, 7, 8, 9, 10, 15, 20, 25, 50, 100, 200, 500, or more base pairs from the first or last nucleotide of a target sequence. In some embodiments, the cleavage may be staggered, i.e. generating sticky ends. In some embodiments, the cleavage is a staggered cut with a 5' overhang. In some embodiments, the cleavage is a staggered cut with a 5' overhang of 1 to 5 nucleotides, 4 or 5 nucleotides. In some embodiments, a vector encodes a CRISPR-associated transposase that may be mutated with respect to a corresponding wild-type enzyme such that the mutated CRISPR-associated transposase lacks the ability to cleave one or both DNA or RNA strands of a target polynucleotide containing a target sequence. As a further example, two or more catalytic domains of a CRISPR-associated transposase (e.g. RuvC I, RuvC II, RuvC III or IS605 ORFB domain) may be mutated to produce a mutated CRISPR-associated transposases substantially lacking all DNA cleavage activity. In some embodiments, a CRISPR-associated transposases may be considered to substantially lack all cleavage activity when the cleavage activity of the mutated CRISPR-associated transposase is about no more than 25%, 10%, 5%, 1%, 0.1%, 0.01%, or less of the nucleic acid cleavage activity of the non-mutated form of the enzyme; an example can be when the nucleic acid cleavage activity of the mutated CRISPR-associated transposases is negligible as compared with the non-mutated CRISPR-associated transposase.

Target Sequences

As used herein, the term "target polynucleotide" or "target sequence" refers to a nucleotide sequence that occurs in a polynucleotide against which a CRISPR-associated transposase is directed. In some embodiments, the target polynucleotide or target sequence is in a gene. In this context, the term "gene" means a locatable region of genomic sequence, corresponding to a unit of inheritance, which includes regulatory regions, such as promoters, enhancers, 5' untranslated regions, intron regions, 3' untranslated regions, transcribed regions, and other functional sequence regions that may exist as native genes or transgenes in a plant genome. Depending upon the circumstances, the term target sequence or target gene can refer to the full-length nucleotide sequence of the gene or gene product targeted for suppression or the nucleotide sequence of a portion of the gene or gene product targeted for suppression.

The target polynucleotide of a nucleic acid-targeting system as described herein can be any polynucleotide endogenous or exogenous to a prokaryotic or a eukaryotic cell. For example, the target polynucleotide can be a polynucleotide residing in the nucleus of the eukaryotic cell. The target polynucleotide can be a sequence coding a gene product (e.g., a protein) or a non-coding sequence (e.g., a regulatory polynucleotide or a junk DNA), or a combination of both.

Examples of target polynucleotides include a sequence associated with a signaling biochemical pathway, e.g., a signaling biochemical pathway-associated gene or polynucleotide. Examples of target polynucleotides include genes that encode proteins that provide tolerance to herbicides, such as 5-enolpyruvylshikimate-3-phosphate synthase (EPSPS), glyphosate oxidoreductase (GOX), glyphosate decarboxylase, glyphosate-N-acetyl transferase (GAT), dicamba monooxygenase, phosphinothricin acetyltransferase, 2,2-dichloropropionic acid dehalogenase, acetohydroxyacid synthase, acetolactate synthase (ALS), haloarylnitrilase, acetyl-coenzyme A carboxylase, dihydropteroate synthase, phytoene desaturase, Protoporphyrinogen oxidase (PPO), protoporphyrin IX oxygenase, hydroxyphenylpyruvate dioxygenase, para-aminobenzoate synthase, glutamine synthase, cellulose synthase, beta-tubulin, 4-Hydroxyphenylpyruvate dioxygenase (HPPD) and serine hydroxymethyltransferase. Examples of target polynucleotides include polynucleotides associated with a disease resistance locus. As used herein, the term "disease resistance locus" refers to a genomic region associated with disease or pathogen resistance in a plant. A disease resistance locus may comprise one or more genes, gene families, arrays of genes or QTLs encoding a protein or proteins that confer to a plant resistance to at least one disease or pathogen. In one embodiment, the disease resistance locus comprises one or more NBS-LRR disease resistance genes, also referred to as NB-LRR genes, R genes, LRR genes. In another embodiment, the disease resistance locus comprises one or more PRR disease resistance genes. The disease resistance locus may encompass a specific gene, cluster of genes, array of genes and/or gene family known to confer pathogen resistance, for example Rp1, or Rpp1, or Rps1. In another embodiment, the disease resistance locus comprises the Rgh1 locus. In another embodiment, the disease resistance locus comprises the Rgh4 locus. Alternatively, the disease resistance locus may encompass a genomic region but the actual gene/element composition conferring disease resistance is unknown. Examples of target polynucleotides include polynucleotides that encode quality traits, such as brown midrib (bmr), waxy, white, Fad2, Fad3.

Without wishing to be bound by theory, it is believed that the target sequence should be associated with a PAM (protospacer adjacent motif); that is, a short sequence recognized by the CRISPR-associated transposase. The precise sequence and length requirements for the PAM differ depending on the CRISPR-associated transposase used, but PAMs are typically 2-5 base pairs adjacent the target sequence. In some embodiments, the PAM is 5' to the target sequence. In some embodiments, the PAM is 3' to the target sequence. Examples of PAM sequences are given in Example 2 below, and the skilled person will be able to identify further PAM sequences for use with a given CRISPR-associated transposase. Further, engineering of the PAM Interacting (PI) domain may allow programming of PAM specificity, improve target site recognition fidelity, and increase the versatility of the CRISPR-associated transposase.

Uses of the CRISPR-Associated Transposases

In an aspect, the disclosure provides a method for sequence-specific modification of a target nucleic acid sequence in a cell, comprising providing to a cell one or more CRISPR-associated transposases. In some embodiments, the one or more CRISPR-associated transposases are provided by expressing in the cell a recombinant DNA molecule encoding the one or more CRISPR-associated transposases. In some embodiments, the one or more CRISPR-associated transposases are provided by contacting the cell with a composition comprising one or more CRISPR-associated transposases or a recombinant DNA molecule encoding the one or more CRISPR-associated transposases. In some embodiments, the one or more CRISPR-associated transposases are provided by contacting the cell with a composition comprising one or more RNA molecules encoding the one or more CRISPR-associated transposases. In some embodiments, the method further comprises providing a guide RNA capable of hybridizing to the target nucleic acid sequence to the cell. In some embodiments, the guide RNA is provided by expressing in the cell a recombinant DNA molecule encoding the guide RNA. In some embodiments, the guide RNA is provided by contacting the cell with a composition comprising the guide RNA or a recombinant DNA molecule encoding the guide RNA. In some embodiments, the guide RNA is complexed with the CRISPR-associated transposase and provided to the cell. Methods and compositions for providing RNAs to plant cells are known in the art. See, e.g., PCTUS2016035500, PCTUS2016035435, and WO2011112570, incorporated by reference herein.

In an aspect, the disclosure provides a method as herein discussed wherein the cell is a eukaryotic cell. In an aspect, the disclosure provides a method as herein discussed wherein the cell is a mammalian cell. In an aspect, the disclosure provides a method as herein discussed, wherein the cell is a non-human eukaryote cell. In an aspect, the disclosure provides a method as herein discussed, wherein the non-human eukaryote cell is a non-human mammalian cell. In an aspect, the disclosure provides a method as herein discussed, wherein the non-human mammalian cell may be a primate, bovine, ovine, procine, canine, rodent, Leporidae such as monkey, cow, sheep, pig, dog, rabbit, rat or mouse cell. In an aspect, the disclosure provides a method as herein discussed, wherein the cell may be a non-mammalian eukaryotic cell such as poultry bird (e.g., chicken), vertebrate fish (e.g., salmon, tilapia) or shellfish (e.g., oyster, claim, lobster, shrimp) cell.

In an aspect, the disclosure provides a method as herein discussed, wherein the eukaryotic cell is a plant cell. The plant cell may be of a monocot or dicot or of a crop or grain plant such as cassava, corn, sorghum, alfalfa, cotton, soybean, canola, wheat, oat or rice. The plant cell may also be of an algae, tree or production plant, fruit or vegetable (e.g., trees such as citrus trees, e.g., orange, grapefruit or lemon trees; peach or nectarine trees; apple or pear trees; nut trees such as almond or walnut or pistachio trees; nightshade plants; plants of the genus *Brassica*; plants of the genus

*Lactuca*; plants of the genus *Spinacia*; plants of the genus *Capsicum*; cotton, tobacco, asparagus, avocado, papaya, cassava, carrot, cabbage, broccoli, cauliflower, tomato, eggplant, pepper, lettuce, spinach, strawberry, potato, squash, melon, blueberry, raspberry, blackberry, grape, coffee, cocoa, etc).

In another aspect, the present disclosure provides for a method of functional screening of genes in a genome in a pool of cells ex vivo or in vivo comprising the administration or expression of a library comprising a plurality of guide RNAs and wherein the screening further comprises use of a CRISPR-associated transposase as described herein. In some embodiments, the CRISPR-associated transposase is modified to comprise a heterologous functional domain. In an aspect the disclosure provides a method for screening a genome comprising the administration to a cell or expression in a cell in vivo of a library. In an aspect, the disclosure provides a method as herein discussed further comprising an activator administered to the cell or expressed in the cell. In an aspect, the disclosure provides a method as herein discussed wherein the activator is attached to a CRISPR-associated transposase as described herein. In an aspect, the disclosure provides a method as herein discussed wherein the activator is attached to the N terminus or the C terminus of the CRISPR-associated transposase. In an aspect, the disclosure provides a method as herein discussed wherein the activator is attached to a gRNA loop. In an aspect the disclosure provides a method as herein discussed further comprising a repressor administered to the cell or expressed in the cell. In an aspect, the disclosure provides a method as herein discussed wherein the screening comprises affecting and detecting gene activation, gene inhibition, or cleavage in the targeted locus.

In an aspect, the disclosure provides efficient on-target activity and minimizes off target activity. In an aspect, the disclosure provides efficient on-target cleavage by a CRISPR-associated transposase as described herein and minimizes off-target cleavage by the CRISPR-associated transposase. In an aspect, the disclosure provides guide RNA specific binding of a CRISPR-associated transposase at a gene locus without DNA cleavage. In an aspect, the disclosure provides efficient guide RNA directed on-target binding of a CRISPR-associated transposase at a genomic locus and minimizes off-target binding of the CRISPR-associated transposase. Accordingly, in an aspect, the disclosure provides target-specific gene regulation. In an aspect, the disclosure provides orthogonal activation and/or inhibition and/or cleavage of multiple targets using one or more CRISPR-associated transposases.

In an aspect, the disclosure provides a method as herein discussed comprising the delivery of one or more CRISPR-associated transposases or nucleic acid molecule(s) encoding one or more CRISPR-associated transposases, wherein said nucleic acid molecule(s) are operatively linked to regulatory sequence(s) and expressed in vivo. In an aspect, the disclosure provides a method as herein discussed wherein the expression of one ore more CRISPR-associated transposases in a cell is via a lentivirus, an adenovirus, an AAV, a geminivirus, a Tobacco Rattle Virus (TRV), Potato virus X (PVX), Tomato yellow leaf curl China virus (TYLCCV), a Begomovirus, Barley stripe mosaic virus (BSMV), Cymbidium mosaic virus (CymMV), Rice tungro bacilliform virus (RTBV), Cauliflower mosaic virus (CaMV), Turnip yellow mosaic virus (TYMV), Cabbage leaf curl virus (CbLCV), Apple latent spherical virus (ALSV), Cucumber mosaic virus (CMV), Cotton leaf crumple virus (CLCrV), African cassava mosaic virus (ACMV), Pea early browning virus (PEBV), Beet curly top virus (BCTV) or an *Agrobacterium*. In an aspect, the disclosure provides a method as herein discussed wherein the delivery of one or more CRISPR-associated transposases is via a particle, a nanoparticle, a lipid or a cell penetrating peptide (CPP).

In an aspect, the disclosure provides a nucleic acid-targeting system comprising a CRISPR-associated transposase and a guide RNA (gRNA) comprising a guide sequence capable of hybridizing to a target sequence in a genomic locus of interest in a cell, wherein the gRNA binds to the CRISPR-associated transposase.

In one aspect, the disclosure provides a method for altering or modifying expression of a gene product. The method may comprise introducing into a cell and expressing a DNA molecule encoding a CRISPR-associated transposase, whereby the CRISPR-associated transposase cleaves product target sequence in the genome of the cell, whereby expression of the gene product is altered. The disclosure further comprehends the CRISPR-associated transposase being codon optimized for expression in a Eukaryotic cell. In an embodiment the eukaryotic cell is a plant cell. In a further embodiment of the disclosure, the expression of the gene product is decreased.

In an aspect, the disclosure provides altered cells and progeny of those cells, as well as products made by the cells. CRISPR-associated transposases and nucleic acid-targeting systems of the disclosure are used to produce cells comprising a modified target locus. In some embodiments, the method may comprise allowing a nucleic acid-targeting complex to bind to the target DNA or RNA to effect cleavage of said target DNA or RNA thereby modifying the target DNA or RNA, wherein the nucleic acid-targeting complex comprises a CRISPR-associated transposase. In one aspect, the disclosure provides a method of repairing a genetic locus in a cell. In another aspect, the disclosure provides a method of modifying expression of DNA or RNA in a eukaryotic cell. In some embodiments, the method comprises allowing a nucleic acid-targeting complex to bind to the DNA or RNA such that said binding results in increased or decreased expression of said DNA or RNA; wherein the nucleic acid-targeting complex comprises a CRISPR-associated transposase. Similar considerations and conditions apply as above for methods of modifying a target DNA or RNA. In fact, these sampling, culturing and re-introduction options apply across the aspects of the present disclosure. In an aspect, the disclosure provides for methods of modifying a target DNA or RNA in a eukaryotic cell, which may be in vivo, ex vivo or in vitro. In some embodiments, the method comprises sampling a cell or population of cells from a plant, and modifying the cell or cells. Culturing may occur at any stage ex vivo. Such cells can be, without limitation, plant cells, animal cells, yeast cells, particular cell types of any organism, including protoplasts, somatic cells, germ cells, haploid cells, stem cells, immune cells, T cell, B cells, dendritic cells, cardiovascular cells, epithelial cells, stem cells and the like. The cells can be modified according to the disclosure to produce gene products, for example in controlled amounts, which may be increased or decreased, depending on use, and/or mutated. In certain embodiments, a genetic locus of the cell is repaired. The cell or cells may even be re-introduced into the non-human animal or plant. For re-introduced cells it may be preferred that the cells are stem cells.

In an aspect, the instant disclosure provides cells which transiently comprise the nucleic acid-targeting systems, or components thereof. For example, CRISPR-associated transposases and, optionally, guide RNAs are transiently provided to a cell and a genetic locus is altered, followed by a decline in the amount of one or more components of the nucleic acid-targeting system. Subsequently, the cells, progeny of the cells, and organisms which comprise the cells, having acquired a CRISPR-associated transposase-mediated genetic alteration, comprise a diminished amount of one or more nucleic acid-targeting system components, or no longer contain the comprise one or more nucleic acid-targeting system components.

Gene Editing or Altering Target Loci

In some embodiments, a double strand break or single strand break in one of the strands is sufficiently close to a target sequence such that template repair occurs. In an embodiment, the distance is not more than 10, 20, 50, 100, 150, 200, 250, 300, 350 or 400 nucleotides. While not wishing to be bound by a particular theory, it is believed that the break should be sufficiently close to a target sequence such that the break is within the region that is subject to exonuclease-mediated removal during end resection.

In an embodiment, a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287 or an ortholog or homolog thereof, induces a double strand break for the purpose of inducing HDR-mediated repair, where the cleavage site is between 0-200 bp (e.g., 0 to 175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target sequence. In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target sequence.

In some embodiments, homology arms extend at least as far as the region in which end resection may occur, e.g., in order to allow the resected single stranded overhang to find a complementary region within the donor template. In some embodiments, the overall length is limited by parameters such as plasmid size or viral packaging limits. Examples of homology arm lengths include a least 10, 15, 20, 25, 30, 35, 40, 45, 50, 55, 60, 65, 70, 75, 80, 85, 90, 95, 100, 150, 200, 250, 300, 350, 400, 450, 500, 550, 600, 650, 700, 750, 800, 850, 900, 950 or 1000 nucleotides.

Target sequence, as used herein, refers to a nucleic acid sequence that is modified by a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287 or an ortholog or homolog thereof. In some embodiments, the CRISPR-associated transposase is directed to the target sequence by a guide RNA. A target sequence can be modified by cleavage by a CRISPR-associated transposase and repair of the target sequence. In an embodiment, repair of a target sequence can result in addition or deletion of one or more nucleotides. In some embodiments, the target sequence may comprise one or more nucleotides that are altered by incorporation of a template nucleic acid.

In certain embodiments, CRISPR-associated transposase-induced non-homologous end-joining (NHEJ) can be used to target gene-specific knockouts. CRISPR-associated transposase-induced NHEJ can also be used to remove (e.g., delete) sequence in a gene of interest. Generally, NHEJ repairs a double-strand break in the DNA by joining together the two ends; however, generally, the original sequence is restored only if two compatible ends, exactly as they were formed by the double-strand break, are perfectly ligated. The DNA ends of the double-strand break are frequently the subject of enzymatic processing, resulting in the addition or removal of nucleotides, at one or both strands, prior to rejoining of the ends. This results in the presence of insertion and/or deletion (indel) mutations in the DNA sequence at the site of the NHEJ repair. Two-thirds of these mutations typically alter the reading frame and, therefore, produce a non-functional protein. Additionally, mutations that maintain the reading frame, but which insert or delete a significant amount of sequence, can destroy functionality of the protein. This is locus dependent as mutations in critical functional domains are likely less tolerable than mutations in non-critical regions of the protein. The indel mutations generated by NHEJ are unpredictable in nature; however, at a given break site certain indel sequences are favored and are over represented in the population, likely due to small regions of microhomology. The lengths of deletions can vary widely; most commonly in the 1-50 bp range, but they can easily be greater than 50 bp, e.g., they can easily reach greater than about 100-200 bp. Insertions tend to be shorter and often include short duplications of the sequence immediately surrounding the break site. However, it is possible to obtain large insertions, and in these cases, the inserted sequence has often been traced to other regions of the genome or to plasmid DNA present in the cells.

Because NHEJ is a mutagenic process, it may also be used to delete small sequence motifs as long as the generation of a specific final sequence is not required. If a double-strand break is targeted near to a short target sequence, the deletion mutations caused by the NHEJ repair often span, and therefore remove, the unwanted nucleotides. For the deletion of larger DNA segments, introducing two double-strand breaks, one on each side of the sequence, can result in NHEJ between the ends with removal of the entire intervening sequence. Both of these approaches can be used to delete specific DNA sequences; however, the error-prone nature of NHEJ may still produce indel mutations at the site of repair.

Both double strand cleaving and single strand cleaving CRISPR-associated transposases, or an ortholog or homolog thereof, can be used in the methods and compositions described herein to generate NHEJ-mediated indels. NHEJ-mediated indels targeted to a gene, e.g., a coding region, e.g., an early coding region of a gene of interest can be used to knockout (i.e., eliminate expression of) a gene of interest. For example, early coding region of a gene of interest includes sequence immediately following a transcription start site, within a first exon of the coding sequence, or within 500 bp of the transcription start site (e.g., less than 500, 450, 400, 350, 300, 250, 200, 150, 100 or 50 bp).

Genome Wide Knock-Out Screening

The CRISPR-associated transposases and nucleic acid-targeting systems described herein can be used to perform functional genomic screens. In some embodiments, genomic screens can utilize guide RNA based genome wide libraries. Such screens and libraries can provide for determining the function of genes, cellular pathways genes are involved in, and how any alteration in gene expression can result in a particular biological process. In some embodiments, the CRISPR-associated transposase comprises an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-287 or an ortholog or homolog thereof.

In some embodiments, a genome wide library may comprise a plurality of guide RNAs, as described herein, comprising guide sequences that are capable of targeting a plurality of target sequences in a plurality of genomic loci in a population of eukaryotic cells. The population of cells may be a population of plant cells. The target sequence in the genomic locus may be a non-coding sequence. The non-coding sequence may be an intron, regulatory sequence, splice site, 3' UTR, 5' UTR, or polyadenylation signal. Gene function of one or more gene products may be altered by said targeting. The targeting may result in a knockout of gene function. The targeting of a gene product may comprise more than one guide RNA. A gene product may be targeted by 2, 3, 4, 5, 6, 7, 8, 9, or 10 guide RNAs. The targeting may be of about 100 or more sequences. The targeting may be of about 1000 or more sequences. The targeting may be of about 20,000 or more sequences. The targeting may be of the entire genome. The targeting may be of a panel of target sequences focused on a relevant or desirable pathway. The pathway may be an immune pathway. The pathway may be a cell division pathway.

One aspect of the disclosure comprehends a genome wide library that may comprise a plurality of guide RNAs that may comprise guide sequences that are capable of targeting a plurality of target sequences in a plurality of genomic loci, wherein said targeting results in a knockout of gene function. This library may potentially comprise guide RNAs that target each and every gene in the genome of an organism. In some embodiments, the organism is a plant.

In some embodiments of the disclosure the organism is a eukaryote (including mammal including human) or a non-human eukaryote or a non-human animal or a non-human mammal. In some embodiments, the organism is a non-human animal, and may be an arthropod, for example, an insect, or may be a nematode. In some methods of the disclosure the organism is a plant. In some methods of the disclosure the organism or subject is algae, including microalgae, or is a fungus.

Functional Alteration and Screening

In another aspect, the present disclosure provides for a method of functional evaluation and screening of genes. Several embodiments relate to the use of the CRISPR-associated transposases of the present disclosure to precisely deliver functional domains, to activate or repress genes or to alter epigenetic state by precisely altering the methylation site on a specific locus of interest, by providing a CRISPR-associated transposase comprising an amino acid sequence having at least 85%, at least 90%, at least 91%, at least 92%, at least 93%, at least 94%, at least 95%, at least 96%, at least 97%, at least 98%, at least 99%, or 100% homology to a sequence selected from the group consisting of SEQ ID NOs: 124-246 and 275-297, wherein the CRISPR-associated transposase is modified to comprise a heterologous functional domain. In an aspect, the disclosure provides a method as herein discussed further comprising an activator administered to the host or expressed in the host. In an aspect, the disclosure provides a method as herein discussed wherein the activator is attached to a CRISPR-associated transposase. In an aspect, the disclosure provides a method as herein discussed wherein the activator is attached to the N terminus or the C terminus of the CRISPR-associated transposase. In an aspect the disclosure provides a method as herein discussed, wherein the screening comprises affecting and detecting gene activation, gene inhibition, or cleavage in the locus.

In an aspect the disclosure provides a method as herein discussed, wherein the host is a eukaryotic cell. In an aspect the disclosure provides a method as herein discussed, wherein the host is a mammalian cell. In an aspect the disclosure provides a method as herein discussed, wherein the host is a non-human eukaryote. In an aspect the disclosure provides a method as herein discussed, wherein the non-human eukaryote is a plant.

Method of Using Nucleic Acid Targeting Systems to Modify a Cell or Organism

The disclosure in some embodiments comprehends a method of modifying an cell or organism. The cell may be a prokaryotic cell or a eukaryotic cell. The cell may be a mammalian cell. The mammalian cell many be a non-human primate, bovine, porcine, rodent or mouse cell. The cell may be a non-mammalian eukaryotic cell such as poultry, fish or shrimp. The cell may also be a plant cell. The plant cell may be of a crop plant such as cassava, soybean, corn, cotton, alfalfa, canola, sorghum, wheat, or rice. The plant cell may also be of an algae, tree or vegetable. The modification introduced to the cell by the present disclosure may be such that the cell and progeny of the cell are altered for improved production of biologic products such as an antibody, oil, fiber, starch, alcohol or other desired cellular output. The modification introduced to the cell by the present disclosure may be such that the cell and progeny of the cell include an alteration that changes the biologic product produced.

The nucleic acid-targeting system may comprise one or more different vectors. In an aspect of the disclosure, the CRISPR-associated transposase is codon optimized for expression the desired cell type, preferentially a eukaryotic cell, preferably a plant cell.

Delivery of the Nucleic Acid-Targeting Systems and Components Thereof

Through this disclosure and the knowledge in the art, nucleic acid-targeting system, specifically the novel systems described herein, or components thereof or nucleic acid molecules thereof (including, for instance HDR template) or nucleic acid molecules encoding or providing components thereof may be delivered by a delivery system herein described both generally and in detail.

The CRISPR-associated transposases, for instance those encoded by a polynucleotide sequence selected from SEQ ID NOs: 1-123, 604-627 and 2020-3379, and/or any of the present RNAs, for instance a guide RNA, can be delivered using any suitable vector, e.g., plasmid or viral vectors, such as Ti plasmids of *Agrobacterium tumefaciens*, geminivirus, Tobacco Rattle Virus (TRV), Potato virus X (PVX), Tomato yellow leaf curl China virus (TYLCCV), Begomovirus, Barley stripe mosaic virus (BSMV), Cymbidium mosaic virus (CymMV), Rice tungro bacilliform virus (RTBV), Cauliflower mosaic virus (CaMV), Turnip yellow mosaic virus (TYMV), Cabbage leaf curl virus (CbLCV), Apple latent spherical virus (ALSV), Cucumber mosaic virus (CMV), Cotton leaf crumple virus (CLCrV), African cassava mosaic virus (ACMV), Pea early browning virus (PEBV), Beet curly top virus (BCTV), adeno associated virus (AAV), lentivirus, adenovirus or other viral vector types, or combinations thereof. Polynucleotides encoding CRISPR-associated transposases can be packaged into one or more vectors, e.g., plasmid or viral vectors. In some embodiments, the vector, e.g., plasmid or viral vector, is delivered to the tissue of interest by, for example, particle bombardment, *Agrobacterium* infection, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 μg to about 10 μg. Plasmids of the disclosure will generally comprise one or more of (i) a promoter; (ii) a sequence encoding CRISPR-associated transposase, operably linked to said promoter; (iii) a selectable marker; (iv) an origin of replication; and (v) a transcription terminator downstream of and operably linked to (ii). The plasmid can also encode a guide RNA and/or a tracrRNA, but one or more of these may instead be encoded on a different vector.

In some embodiments the RNA molecules of the disclosure are delivered in liposome or lipofectin formulations and the like and can be prepared by methods well known to those skilled in the art. Such methods are described, for example, in U.S. Pat. Nos. 5,593,972, 5,589,466, 5,580,859, and 9,121,022 which are herein incorporated by reference. Delivery systems aimed specifically at the enhanced and improved delivery of siRNA into mammalian cells have been developed, (see, for example, Shen et al FEBS Let. 2003, 539:111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present disclosure.

In some embodiments, RNA delivery is in vivo delivery. It is possible to deliver RNA molecules encoding CRISPR-associated transposases and guide RNAs into cells using liposomes or nanoparticles. Thus delivery of the CRISPR-associated transposases and/or delivery of the RNAs of the disclosure may be in RNA form and via microvesicles, liposomes or particle or particles. For example, mRNA encoding a CRISPR-associated transposase can be packaged into liposomal particles for delivery in vivo. Liposomal transfection reagents such as lipofectamine from Life Technologies and other reagents on the market can effectively deliver RNA molecules into the liver.

Means of delivery of RNA also include delivery of RNA via particles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the CRISPR system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo.

Several embodiments relate to enhancing NHEJ or HR efficiency. NHEJ efficiency can be enhanced by co-expressing end-processing enzymes such as Trex2 (Dumitrache et al. Genetics. 2011 August; 188(4): 787-797). It is preferred that HR efficiency is increased by transiently inhibiting NHEJ machineries such as Ku70 and Ku86. HR efficiency can also be increased by co-expressing prokaryotic or eukaryotic homologous recombination enzymes such as RecBCD, RecA.

Particle Delivery Systems and/or Formulations

Several types of particle delivery systems and/or formulations are known to be useful in a diverse spectrum of applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present disclosure. A particle in accordance with the present disclosure is any entity having a greatest dimension (e.g. diameter) of less than 100 microns (μm). In some embodiments, inventive particles have a greatest dimension of less than 10 μm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the disclosure. In some embodiments, inventive particles have a greatest dimension ranging between 25 nm and 200 nm.

Particles delivery systems within the scope of the present disclosure may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present disclosure.

The disclosure involves at least one component of the nucleic acid-targeting system, e.g., CRISPR-associated transposase, gRNA, delivered via at least one nanoparticle complex. In some aspects, the disclosure provides methods comprising delivering one or more polynucleotides, such as or one or more vectors as described herein, one or more transcripts thereof, and/or one or proteins transcribed therefrom, to a host cell. In some aspects, the disclosure further provides cells produced by such methods, and plants comprising or produced from such cells. In some embodiments, a CRISPR-associated transposase in combination with (and optionally complexed with) a guide RNA is delivered to a cell. Conventional viral and non-viral based gene transfer methods can be used to introduce nucleic acids in plant cells or target tissues. Such methods can be used to administer nucleic acids encoding components of a nucleic acid-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell.

In some embodiments, one or more vectors described herein are used to produce a non-human transgenic animal or transgenic plant. In some embodiments, the transgenic animal is a mammal, such as a mouse, rat, or rabbit. Methods for producing transgenic animals and plants are known in the art, and generally begin with a method of cell transfection, such as described herein. In one aspect, the disclosure provides for methods of modifying a target polynucleotide in a eukaryotic cell. In some embodiments, the method comprises allowing a CRISPR-associated transposase to effect cleavage of said target polynucleotide thereby modifying the target polynucleotide.

Use of Nucleic Acid-Targeting System in Plants

The nucleic acid-targeting systems disclosed herein can be used in conjunction with recent advances in crop genomics. The systems described herein can be used to perform efficient and cost effective plant gene or genome interrogation or editing or manipulation. The nucleic acid-targeting systems can be used with regard to plants in Site-Directed Integration (SDI) or Gene Editing (GE) or any near reverse breeding or reverse breeding techniques. Aspects of utilizing the herein described nucleic acid-targeting systems may be analogous to the use of the CRISPR-Cas (e.g. CRISPR-Cas9) system in plants, and mention is made of the University of Arizona web site "CRISPR-PLANT" (http://www.genome.arizona.edu/crispr/) (supported by Penn State and AGI).

The methods for genome editing using the nucleic acid-targeting system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above.

In some embodiments, the polynucleotides encoding the components of the nucleic acid-targeting system are introduced for stable integration into the genome of a plant cell. In these embodiments, the design of the transformation vector or the expression system can be adjusted depending on for when, where and under what conditions the guide RNA and/or the CRISPR-associated transposase are expressed.

In some embodiments, the polynucleotides encoding the components of the nucleic acid-targeting system are transiently expressed in a plant, plant tissue, or plant cell. In these embodiments, the nucleic acid-targeting system can ensure modification of a target gene only when the CRISPR-associated transposase is present in a cell, such that genomic modification can further be controlled. As the expression of the CRISPR-associated transposase is transient, plants regenerated from such plant cells typically contain no foreign DNA. In particular embodiments, the CRISPR-associated transposase is stably expressed by the plant cell and a guide RNA is transiently expressed. In particular embodiments the CRISPR-associated transposase is stably expressed by the plant cell and the guide RNA is provided directly to the plant cell by any method described herein.

DNA construct(s) encoding components of the nucleic acid-targeting system, and, where applicable, template sequence, may be introduced into a plant, plant part, or plant cell by a variety of conventional techniques.

In particular embodiments, nucleic acid-targeting system components can be introduced in the plant cells using a plant viral vector. In some embodiments, the viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., Fava bean necrotic yellow virus). In some embodiments, the viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors.

The methods described herein generally result in the generation of plants comprising one or more desirable traits compared to the wild-type plant. In some embodiments, the plants, plant cells or plant parts obtained are transgenic plants, comprising an exogenous DNA sequence incorporated into the genome of all or part of the cells of the plant. In other embodiments, non-transgenic genetically modified plants, plant parts or cells are obtained, in that no exogenous DNA sequence is incorporated into the genome of any of the plant cells of the plant. In such embodiments, the plants are non-transgenic. Where only the modification of an endogenous gene is ensured and no foreign genes are introduced or maintained in the plant genome; the resulting genetically modified plants contain no non-native genes.

In some embodiments the nucleic acid-targeting system is targeted to a chloroplast. In some embodiments, targeting may be achieved by the presence of an N-terminal extension, called a chloroplast transit peptide (CTP) or plastid transit peptide.

REFERENCES

Bland C, et al. CRISPR Recognition Tool (CRT): a tool for automatic detection of clustered regularly interspaced palindromic repeats. BMC Bioinformatics. 2007 Jun. 18; 8(1):209.
Chen and Zhao, Nucleic Acids Research, 2005 33:e154.
Edgar R C. Search and clustering orders of magnitude faster than BLAST. Bioinformatics. 2010 Oct. 1; 26(19):2460-1.
Eddy, S. R., HMMER3 beta test: User's Guide, Version 3.0b3; November 2009, at the web site hmmer.org.
Geissmann, Q. PLoS One 8, 2013.
Guo et al., J. Mol Biol. 2010 400(1):96-107.
Kapitonov et al. ISC, a Novel Group of Bacterial and Archaeal DNA Transposons That Encode Cas9 Homologs., J Bacteriol. 2016 Mar. 1; 198(5): 797-807.
Karvelis et al. Genome Biology (2015) 16:253.
Kleinstiver, et al., Nature 2015 523:481-485.
Shmakov et al. Molecular Cell (2015) 60:1-13.
Wang et al. (Restriction-ligation-free (RLF) cloning: a high-throughput cloning method by in vivo homologous recombination of PCR products. 2015 Genet. Mol. Res., 14, 12306-12315.
Yin, P. et al. Structural basis for the modular recognition of single-stranded RNA by PPR proteins. 2013 Nature 504, 168-171.
Zetsche et al. Cell, 2015 163:759-771.
Zhang and Muench et al. A Nucleolar PUF RNA-binding Protein with Specificity for a Unique RNA Sequence. J Biol Chem. 2015 Dec. 11; 290(50):30108-18.
Zhu et al. Journal of Genetics and Genomics 43 (2016) 25-36.

The following Examples, while indicating embodiments of the invention, are provided for illustrative purposes only and should not be used to limit the invention.

EXAMPLES

Example 1: Identification of Bacterial Sequences Encoding CRISPR-Associated Transposases A number of sequences encoding transposases were identified based on their close proximity to a CRISPR (repeat element) locus. Polynucleotide sequences encoding transposases were identified by bioinformatic searching of bacterial genomes from *Lysinibacillus* sp., *Brevibacillus* sp., *Sphingobium* sp., *Undibacterium* sp., *Bacillus* sp., *Chryseobacterium* sp., *Sphingomonas* sp., *Labrys* sp., *Brevibacillus laterosporus, Bacillus thuringiensis, Bacillus weihenstephanensis, Bacillus megaterium, Enterococcus faecalis, Brevibacillus brevis, Undibacterium pigrum, Novosphingobium rosa, Labrys methylaminiphdus, Brevibacillus parabrevis, Paenibacillus* sp., *Paenibacillus thiaminolyticus, Paenibacillus lentimorbus, Paenibacillus terrae, Streptomyces* sp., and *Stenotrophomonas* sp.

A search of 15980 bacterial genomes for CRISPR sequences using the CRISPR recognition toolv1.1 was completed (Bland, 2007; web address: room220.com/crt). From this search, 20467 CRISPR loci were identified, of which 622 CRISPR loci were identified within 2 kb of the coding regions annotated as putative transposases. The CRISPR loci were further prioritized and narrowed down to 521 unique loci by excluding loci that: were associated with known Cas proteins; occurred within a coding region; or originated from an undesirable bacterial strain. The prioritization resulted in identification of 123 unique CRISPR-associated transposase proteins (SEQ ID NO: 124-246) with at least 300 amino acids (encoded by nucleotide sequences SEQ ID NO: 1-123).

The transposase protein sequences (SEQ ID NO: 124-246) were aligned using the USEARCH tool at 50% sequence identity cutoff (Edgar, 2010) and 12 sequence alignment clusters were identified, as shown in Table 1. From the 12 sequence alignment clusters, 23 transposase proteins were selected to represent protein diversity and the respective associated CRISPR array polynucleotide sequences are provided in Table 2.

The transposase protein sequences in each cluster can be aligned to further demonstrate sequence similarities among them and one example is provided in FIG. 1 for cluster 4 (SEQ ID NO: 228-231). Sequence identity percentages among protein sequences in cluster 4 are presented in Table 3. Each cell in the table shows the percentage identity for the transposase protein in the corresponding row (query sequence) as compared to the transposase protein in the corresponding column (subject sequence) divided by the total length of the query sequence, and the number in parenthesis is the total number of identical residues between the query and subject sequences. As can be seen from Table 3 and FIG. 1, the percentage identity among protein sequences for these transposases in cluster 4 ranges from about 86% to about 98% identity.

TABLE 1

Sequence clusters identified among the 123 transposases.

| Cluster ID | DNA sequences (SEQ ID NO:) | PRT sequences (SEQ ID NO:) |
| --- | --- | --- |
| 1 | 1-97 | 124-220 |
| 2 | 98-100 | 221-223 |
| 3 | 101-104 | 224-227 |
| 4 | 105-109 | 228-232 |
| 5 | 110-113 | 233-236 |
| 6 | 114 | 237 |
| 7 | 115-116 | 238-239 |
| 8 | 117 | 240 |
| 9 | 118 | 241 |
| 10 | 119 | 242 |
| 11 | 120-122 | 243-245 |
| 12 | 123 | 246 |

TABLE 2

Transposases and the associated CRISPR arrays selected for representing protein diversity across the 12 clusters.

| Transposase protein sequences (SEQ IN NO:) | Associated CRISPR arrays (SEQ ID NO:) |
| --- | --- |
| 125 | 247 |
| 128 | 248 |
| 146 | 249 |
| 178 | 250 |
| 184 | 251 |
| 193 | 252 |
| 212 | 253, 254 |
| 222 | 255 |
| 224 | 256 |
| 225 | 257 |
| 228 | 258 |
| 232 | 259 |

TABLE 2-continued

Transposases and the associated CRISPR arrays selected for representing protein diversity across the 12 clusters.

| Transposase protein sequences (SEQ IN NO:) | Associated CRISPR arrays (SEQ ID NO:) |
|---|---|
| 234 | 260, 261 |
| 236 | 262 |
| 237 | 263, 264 |
| 238 | 265 |
| 239 | 266 |
| 240 | 267, 268 |
| 241 | 269, 270 |
| 242 | 271 |
| 243 | 272 |
| 245 | 273 |
| 246 | 274 |

TABLE 3

Percent identity comparison of protein sequences for each of the transposase proteins in cluster ID 4.

| Sequence | 1 | 2 | 3 | 4 | 5 |
|---|---|---|---|---|---|
| 1 SEQ-228 | — | 95.2 (334) | 93.2 (327) | 98.6 (346) | 87.2 (306) |
| 2 SEQ-229 | 96.3 (334) | — | 95.4 (331) | 95.1 (330) | 88.5 (307) |
| 3 SEQ-230 | 96.5 (327) | 97.6 (331) | — | 95.3 (323) | 89.4 (303) |
| 4 SEQ-231 | 98.6 (346) | 94.0 (330) | 92.0 (323) | — | 86.6 (304) |
| 5 SEQ-232 | 94.2 (306) | 94.5 (307) | 93.2 (303) | 93.5 (304) | — |

A transposase protein sequence encoded by a polynucleotide sequence as described herein may also be designed or chosen to have one or more amino acid substitution(s) known to be chemically and/or structurally conservative (for example, replacing one amino acid with another having similar chemical or physical properties, such as hydrophobicity, polarity, charge, steric effect, acid/base chemistry, similar side chain group, such as hydroxyl, sulfhydryl, amino, etc.) to avoid or minimize structural changes to the protein that might affect its function. Examples of conservative amino acid substitutions are presented in Table 4. A transposase protein sequence encoded by a polynucleotide sequence as described herein may include proteins that differ in one or more amino acids from those of a CRISPR-associated transposase of SEQ ID NOs: 124-246 or similar sequence as a result of deletion(s) and/or insertion(s) involving one or more amino acids, and may also be designed or chosen based on known transposase protein sequences and their conserved amino acid residues and domains. Amino acid mutations may be made as a single amino acid substitution in the protein or in combination with one or more other mutation(s), such as one or more other amino acid substitution(s), deletions, or additions. Mutations may be made by any method known to those of skill in the art.

TABLE 4

Amino Acid Substitutions.

| Residue | Conservative Substitutions | Residue | Conservative Substitutions |
|---|---|---|---|
| Ala | Ser | Leu | Ile; Val |
| Arg | Lys | Lys | Arg; Gln |
| Asn | Gln; His | Met | Leu; Ile |
| Asp | Glu | Phe | Met; Leu; Tyr |
| Gln | Asn | Ser | Thr; Gly |
| Cys | Ser | Thr | Ser; Val |
| Glu | Asp | Trp | Tyr |
| Gly | Pro | Tyr | Trp; Phe |
| His | Asn; Gln | Val | Ile; Leu |
| Ile | Leu; Val | | |

Additional CRISPR-associated transposases were further identified by using the same bioinformatics procedure as described above, with the following change to the searching criteria. In the initial search parameters, transposases that were 300 amino acids or longer and within 2 kb of CRISPR loci were selected. In this round, additional transposases were selected if they were within 2.2 kb of CRISPR loci, regardless of the protein length. A total of 13 additional transposase proteins were identified, SEQ ID NOs: 275-287.

Example 2: Sequence Analysis for the Identified CRISPR-Associated Transposases

Pfam annotation of the identified 136 sequences encoding CRISPR-associated transposases is presented in Table 5. For each protein, the domain ID is indicated (for example, PUF, OrfB_IS605, or OrfB_Zn_ribbon), then the domain E-value, then the pfam domain coordinates (from and to), followed by the endpoint coordinate symbols. For each pair of query and target endpoint coordinates, the endpoint coordinate symbols have the following meaning: both ends of the alignment ended internally is represented by ".."; both ends of the alignment were full-length flush to the ends of the query and target is represented by "[ ]"; where only the left or right end was flush/full-length is represented by "[." Or ".]," respectively (Eddy, 2009; web site hmmer.org).

TABLE 5

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| 124 | 1 | *Bacillus* sp. multi | C1_1: (0.00069_368 . . . 412_ . . . ); OrfB_IS605: (0.00012_203 . . . 338_ . . . ); OrfB_Zn_ribbon: (6.2e−24_349 . . . 418_ . . . ); PUF: (0.018_308 . . . 335_ . . . ); RNA_POL_M_15KD: (2.1_379 . . . 410_ . . . ); RNA_POL_M_15KD: (3.4_373 . . . 388_ . . . ); zf-Mss51: (0.041_354 . . . 415_ . . . ); zn-ribbon_14: (0.25_377 . . . 393_ . . . ); zn-ribbon_14: (0.47_397 . . . 409_ . . . ) |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| 125 | 2 | *Bacillus* sp. multi | C1_1: (0.00069_368 . . . 412_ . . . ); OrfB_IS605: (0.00012_203 . . . 338_ . . . ); OrfB_Zn_ribbon: (6.2e-24_349 . . . 418_ . . . ); PUF: (0.018_308 . . . 335_ . . . ); RNA_POL_M_15KD: (2.1_379 . . . 410_ . . . ); RNA_POL_M_15KD: (3.4_373 . . . 388_ . . . ); zf-Mss51: (0.041_354 . . . 415_ . . . ); zn-ribbon_14: (0.25_377 . . . 393_ . . . ); zn-ribbon_14: (0.47_397 . . . 409_ . . . ) |
| 126 | 3 | *Bacillus* sp. multi | C1_1: (0.00069_368 . . . 412_ . . . ); OrfB_IS605: (0.00012_203 . . . 338_ . . . ); OrfB_Zn_ribbon: (6.2e-24_349 . . . 418_ . . . ); PUF: (0.018_308 . . . 335_ . . . ); RNA_POL_M_15KD: (2.1_379 . . . 410_ . . . ); RNA_POL_M_15KD: (3.4_373 . . . 388_ . . . ); zf-Mss51: (0.041_354 . . . 415_ . . . ); zn-ribbon_14: (0.25_377 . . . 393_ . . . ); zn-ribbon_14: (0.47_397 . . . 409_ . . . ) |
| 127 | 4 | *Bacillus* sp. multi | C1_1: (0.00069_368 . . . 412_ . . . ); OrfB_IS605: (0.00016_204 . . . 338_ . . . ); OrfB_Zn_ribbon: (6.2e-24_349 . . . 418_ . . . ); PUF: (0.0052_308 . . . 335_ . . . ); RNA_POL_M_15KD: (2.1_379 . . . 410_ . . . ); RNA_POL_M_15KD: (3.4_373 . . . 388_ . . . ); zf-Mss51: (0.043_353 . . . 416_ . . . ); zn-ribbon_14: (0.25_377 . . . 393_ . . . ); zn-ribbon_14: (0.47_397 . . . 409_ . . . ) |
| 128 | 5 | *Bacillus* sp. multi | C1_1: (0.00069_368 . . . 412_ . . . ); OrfB_IS605: (0.00016_204 . . . 338_ . . . ); OrfB_Zn_ribbon: (6.2e-24_349 . . . 418_ . . . ); PUF: (0.0052_308 . . . 335_ . . . ); RNA_POL_M_15KD: (2.1_379 . . . 410_ . . . ); RNA_POL_M_15KD: (3.4_373 . . . 388_ . . . ); zf-Mss51: (0.043_353 . . . 416_ . . . ); zn-ribbon_14: (0.25_377 . . . 393_ . . . ); zn-ribbon_14: (0.47_397 . . . 409_ . . . ) |
| 129 | 6 | *Bacillus* sp. multi | C1_1: (0.00069_368 . . . 412_ . . . ); OrfB_IS605: (0.00015_204 . . . 338_ . . . ); OrfB_Zn_ribbon: (6.2e-24_349 . . . 418_ . . . ); PUF: (0.0052_308 . . . 335_ . . . ); RNA_POL_M_15KD: (2.1_379 . . . 410_ . . . ); RNA_POL_M_15KD: (3.4_373 . . . 388_ . . . ); zf-Mss51: (0.043_353 . . . 416_ . . . ); zn-ribbon_14: (0.25_377 . . . 393_ . . . ); zn-ribbon_14: (0.47_397 . . . 409_ . . . ) |
| 130 | 7 | *Bacillus* sp. multi | C1_1: (0.00052_367 . . . 412_ . . . ); OrfB_IS605: (0.00016_204 . . . 338_ . . . ); OrfB_Zn_ribbon: (1.5e-22_349 . . . 418_ . . . ); PUF: (0.0052_308 . . . 335_ . . . ); RNA_POL_M_15KD: (2.1_379 . . . 410_ . . . ); RNA_POL_M_15KD: (3.4_373 . . . 388_ . . . ) ; zf-Mss51: (0.042_353 . . . 417_ . . . ); zn-ribbon_14: (0.25_377 . . . 393_ . . . ); zn-ribbon_14: (0.47_397 . . . 409_ . . . ) |
| 131 | 8 | *Bacillus* sp. multi | C1_1: (0.00065_361 . . . 407_ . . . ); OrfB_IS605: (0.00011_196 . . . 331_ . . . ); OrfB_Zn_ribbon: (3.9e-23_342 . . . 411_ . . . ); PUF: (0.018_301 . . . 328_ . . . ); RNA_POL_M_15KD: (2.5_372 . . . 403_ . . . ); RNA_POL_M_15KD: (3.7_367 . . . 381_ . . . ); zf-Mss51: (0.036_347 . . . 407_ . . . ); zn-ribbon_14: (0.25_370 . . . 386_ . . . ); zn-ribbon_14: (0.46_390 . . . 402_ . . . ) |
| 132 | 9 | *Bacillus* sp. multi | C1_1: (0.00065_361 . . . 407_ . . . ); OrfB_IS605: (9.3e-05_196 . . . 331_ . . . ); OrfB_Zn_ribbon: (3.9e-23_342 . . . 411_ . . . ); PUF: (0.0051_301 . . . 328_ . . . ); RNA_POL_M_15KD: (2.5_372 . . . 403_ . . . ); RNA_POL_M_15KD: (3.7_367 . . . 381_ . . . ); zf-Mss51: (0.037_346 . . . 409_ . . . ); zn-ribbon_14: (0.25_370 . . . 386_ . . . ); zn-ribbon_14: (0.46_390 . . . 402_ . . . ) |
| 133 | 10 | *Bacillus* sp multi | OrfB_IS605: (9.2e-05_196 . . . 331_ . . . ); OrfB_Zn_ribbon: (9.5e-24_342 . . . 411_ . . . ); PUF: (0.0044_301 . . . 328_ . . . ); RNA_POL_M_15KD : (3.1_366 . . . 381_ . . . ); RNA_POL_M_15KD: (3.3_372 . . . 403_ . . . ); zf-Mss51: (0.044_347 . . . 408_ . . . ); zn-ribbon_14: (0.25_370 . . . 386_ . . . ); zn-ribbon_14: (0.46_390 . . . 402_ . . . ) |
| 134 | 11 | *Bacillus thuringiensis* | C1_1: (0.00067_368 . . . 414_ . . . ); OrfB_IS605: (9.6e-05_203 . . . 338_ . . . ); OrfB_Zn_ribbon: (4e-23_349 . . . 418_ . . . ); PUF: (0.0052_308 . . . 335_ . . . ); RNA_POL_M_15KD: (2.6_379 . . . 410_ . . . ); RNA_POL_M_15KD: (3.8_374 . . . 388_ . . . ); zf-Mss51: (0.039_353 . . . 416_ . . .); zn-ribbon_14: (0.25_377 . . . 393_ . . . ); zn-ribbon_14: (0.47_397 . . . 409_ . . . ) |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| 135 | 12 | *Bacillus* sp. multi | OrfB_IS605: (9.5e−05_203 . . . 338_ . . . ); OrfB_Zn_ribbon: (9.7e−24_349 . . . 418_ . . . ); PUF: (0.0044_308 . . . 335_ . . . ); RNA_POL_M_15KD: (3.2_373 . . . 388_ . . . ); RNA_POL_M_15KD: (3.4_379 . . . 410_ . . . ); zf-Mss51: (0.045_354 . . . 415_ . . . ); zn-ribbon_14: (0.25_377 . . . 393_ . . . ); zn-ribbon_14: (0.47_397 . . . 409_ . . . ) |
| 136 | 13 | *Bacillus* sp. multi | OrfB_IS605: (9.5e−05_203 . . . 338_ . . . ); OrfB_Zn_ribbon: (9.7e−24_349 . . . 418_ . . . ); PUF: (0.0044_308 . . . 335_ . . . ); RNA_POL_M_15KD: (3.2_373 . . . 388_ . . . ); RNA_POL_M_15KD: (3.4_379 . . . 410_ . . . ); zf-Mss51: (0.045_354 . . . 415_ . . . ); zn-ribbon_14: (0.25_377 . . . 393_ . . . ); zn-ribbon_14: (0.47_397 . . . 409_ . . . ) |
| 137 | 14 | *Bacillus* sp. multi | OrfB_IS605: (9.5e−05_203 . . . 338_ . . . ); OrfB_Zn_ribbon: (9.7e−24_349 . . . 418_ . . . ); PUF: (0.0044_308 . . . 335_ . . . ); RNA_POL_M_15KD: (3.2_373 . . . 388_ . . . ); RNA_POL_M_15KD: (3.4_379 . . . 410_ . . . ); zf-Mss51: (0.045_354 . . . 415_ . . . ); zn-ribbon_14: (0.25_377 . . . 393_ . . . ); zn-ribbon_14: (0.47_397 . . . 409_ . . . ) |
| 138 | 15 | *Bacillus* sp. multi | C1_1: (0.00065_361 . . . 407_ . . . ); OrfB_IS605: (0.00014_196 . . . 331_ . . . ); OrfB_Zn_ribbon: (3.9e−23_342 . . . 411_ . . . ); PUF: (0.0051_301 . . . 328_ . . . ); RNA_POL_M_15KD: (2.5_372 . . . 403_ . . . ); RNA_POL_M_15KD: (3.7_367 . . . 381_ . . . ); zf-Mss51: (0.037_346 . . . 409_ . . . ); zn-ribbon_14: (0.25_370 . . . 386_ . . . ); zn-ribbon_14: (0.46_390 . . . 402_ . . . ) |
| 139 | 16 | *Bacillus* sp. multi | C1_1: (0.00065_361 . . . 407_ . . . ); OrfB_IS605: (9.3e−05_196 . . . 331_ . . . ); OrfB_Zn_ribbon: (3.9e−23_342 . . . 411_ . . . ); PUF: (0.0051_301 . . . 328_ . . . ); RNA_POL_M_15KD: (2.5_372 . . . 403_ . . . ); RNA_POL_M_15KD: (3.7_367 . . . 381_ . . . ); zf-Mss51: (0.037_346 . . . 409_ . . . ); zn-ribbon_14: (0.25_370 . . . 386_ . . . ); zn-ribbon_14: (0.46_390 . . . 402_ . . . ) |
| 140 | 17 | *Bacillus* sp. multi | C1_1: (0.00068_368 . . . 414_ . . . ); OrfB_IS605: (0.00018_204 . . . 338_ . . . ); OrfB_Zn_ribbon: (4.8e−24_349 . . . 418_ . . . ); PUF: (0.0044_308 . . . 335_ . . . ); RNA_POL_M_15KD: (2.6_379 . . . 410_ . . . ); RNA_POL_M_15KD: (3.8_374 . . . 388_ . . . ); zf-Mss51: (0.033_353 . . . 415_ . . . ); zn-ribbon_14: (0.25_377 . . . 393_ . . . ); zn-ribbon_14: (0.47_397 . . . 409_ . . . ) |
| 141 | 18 | *Bacillus* sp. multi | C1_1: (0.00067_361 . . . 407_ . . . ); OrfB_IS605: (0.00017_197 . . . 331_ . . . ); OrfB_Zn_ribbon: (4.7e−24_342 . . . 411_ . . . ); PUF: (0.0044_301 . . . 328_ . . . ); RNA_POL_M_15KD: (2.5_372 . . . 403_ . . . ); RNA_POL_M_15KD: (3.7_367 . . . 381_ . . . ); zf-Mss51: (0.03_346 . . . 408_ . . . ); zn-ribbon_14: (0.25_370 . . . 386_ . . . ); zn-ribbon_14: (0.46_390 . . . 402_ . . . ) |
| 142 | 19 | *Bacillus* sp. multi | C1_1: (0.00067_361 . . . 405_ . . . ); OrfB_IS605: (0.00026_195 . . . 331_ . . . ); OrfB_Zn_ribbon: (6e−24_342 . . . 411_ . . . ); PUF: (0.005_301 . . . 328_ . . . ); RNA_POL_M_15KD: (2_372 . . . 403_ . . . ); RNA_POL_M_15KD: (3.4_366 . . . 381_ . . . ); zf-Mss51: (0.047_346 . . . 409_ . . . ); zn-ribbon_14: (0.25_370 . . . 386_ . . . ); zn-ribbon_14: (0.46_390 . . . 402_ . . . ) |
| 143 | 20 | *Bacillus* sp. multi | OrfB_IS605: (9.5e−05_203 . . . 338_ . . . ); OrfB_Zn_ribbon: (9.7e−24_349 . . . 418_ . . . ); PUF: (0.0044_308 . . . 335_ . . . ); RNA_POL_M_15KD: (3.2_373 . . . 388_ . . . ); RNA_POL_M_15KD: (3.4_379 . . . 410_ . . . ); zf-Mss51: (0.045_354 . . . 415_ . . . ); zn-ribbon_14: (0.25_377 . . . 393_ . . . ); zn-ribbon_14: (0.47_397 . . . 409_ . . . ) |
| 144 | 21 | *Bacillus* sp. multi | C1_1: (0.00068_368 . . . 414_ . . . ); OrfB_IS605: (0.00018_204 . . . 338_ . . . ); OrfB_Zn_ribbon: (4.8e−24_349 . . . 418_ . . . ); PUF: (0.0044_308 . . . 335_ . . . ); RNA_POL_M_15KD: (2.6_379 . . . 410_ . . . ); RNA_POL_M_15KD: (3.8_374 . . . 388_ . . . ); zf-Mss51: (0.033_353 . . . 415_ . . . ); |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| | | | zn-ribbon_14: (0.25_377 . . . 393_ . . . ); zn-ribbon_14: (0.47_397 . . . 409_ . . . ) |
| 145 | 22 | *Bacillus* sp. multi | OrfB_IS605: (0.0014_203 . . . 338_ . . . ); OrfB_Zn_ribbon: (9.7e-24_349 . . . 418_ . . . ); PUF: (0.0044_308 . . . 335_ . . . ); RNA_POL_M_15KD: (3.2_373 . . . 388_ . . . ); RNA_POL_M_15KD: (3.4_379 . . . 410_ . . . ); zf-Mss51: (0.045_354 . . . 415_ . . . ); zn-ribbon_14: (0.25_377 . . . 393_ . . . ); zn-ribbon_14: (0.47_397 . . . 409_ . . . ) |
| 146 | 23 | *Bacillus* sp. multi | OrfB_IS605: (0.00036_204 . . . 338_ . . . ); OrfB_Zn_ribbon: (9.7e-24_349 . . . 418_ . . . ); PUF: (0.0044_308 . . . 335_ . . . ); RNA_POL_M_15KD: (3.2_373 . . . 388_ . . . ); RNA_POL_M_15KD: (3.4_379 . . . 410_ . . . ); zf-Mss51: (0.048_353 . . . 417_ . . . ); zn-ribbon_14: (0.25_377 . . . 393_ . . . ); zn-ribbon_14: (0.47_397 . . . 409_ . . . ) |
| 147 | 24 | *Bacillus* sp. multi | C1_1: (0.00068_361 . . . 405_ . . . ); OrfB_IS605: (0.00016_196 . . . 331_ . . . ); OrfB_Zn_ribbon: (1.4e-23_342 . . . 411_ . . . ); PUF: (0.018_301 . . . 328_ . . . ); RNA_POL_M_15KD: (2.1_372 . . . 403_ . . . ); RNA_POL_M_15KD: (3.4_366 . . . 381_ . . . ); zf-Mss51: (0.037_347 . . . 407_ . . . ); zn-ribbon_14: (0.25_370 . . . 386_ . . . ); zn-ribbon_14: (0.46_390 . . . 402_ . . . ) |
| 148 | 25 | *Bacillus* sp. multi | C1_1: (0.00073_368 . . . 414_ . . . ); OrfB_IS605: (0.00018_204 . . . 338_ . . . ); OrfB_Zn_ribbon: (7.3e-23_349 . . . 418_ . . . ); PUF: (0.0044_308 . . . 335_ . . . ); RNA_POL_M_15KD: (2.6_379 . . . 410_ . . . ); RNA_POL_M_15KD: (3.8_374 . . . 388_ . . . ); zf-Mss51: (0.037_354 . . . 414_ . . . ); zn-ribbon_14: (0.25_377 . . . 393_ . . . ); zn-ribbon_14: (0.47_397 . . . 409_ . . . ) |
| 149 | 26 | *Bacillus* sp. multi | C1_1: (0.00066_361 . . . 407_ . . . ); OrfB_IS605: (9.1e-05_196 . . . 331_ . . . ); OrfB_Zn_ribbon: (1.8e-23_342 . . . 411_ . . . ); PUF: (0.0044_301 . . . 328_ . . . ); RNA_POL_M_15KD: (2.1_372 . . . 403_ . . . ); RNA_POL_M_15KD: (3.4_366 . . . 381_ . . . ); zf-Mss51: (0.044_346 . . . 409_ . . . ); zn-ribbon_14: (0.25_370 . . . 386_ . . . ); zn-ribbon_14: (0.46_390 . . . 402_ . . . ) |
| 150 | 27 | *Bacillus* sp. multi | C1_1: (0.00089_361 . . . 407_ . . . ); OrfB_IS605: (0.00022_195 . . . 331_ . . . ); OrfB_Zn_ribbon: (3.2e-23_342 . . . 411_ . . . ); PUF: (0.0051_301 . . . 328_ . . . ); RNA_POL_M_15KD: (2.8_367 . . . 380_ . . . ); RNA_POL_M_15KD: (3.1_372 . . . 403_ . . . ); zf-Mss51: (0.091_350 . . . 407_ . . . ); zn-ribbon_14: (0.26_370 . . . 385_ . . . ); zn-ribbon_14: (0.46_390 . . . 402_ . . . ) |
| 151 | 28 | *Bacillus* sp. multi | OrfB_IS605: (9.7e-05_203 . . . 338_ . . . ); OrfB_Zn_ribbon: (9.7e-24_349 . . . 418_ . . . ); PUF: (0.0044_308 . . . 335_ . . . ); RNA_POL_M_15KD: (3.2_373 . . . 388_ . . . ); RNA_POL_M_15KD: (3.4_379 . . . 410_ . . . ); zf-Mss51: (0.045_354 . . . 415_ . . . ); zn-ribbon_14: (0.25_377 . . . 393_ . . . ); zn-ribbon_14: (0.47_397 . . . 409_ . . . ) |
| 152 | 29 | *Bacillus* sp. multi | OrfB_IS605: (0.00018_196 . . . 331_ . . . ); OrfB_Zn_ribbon: (2.1e-23_342 . . . 411_ . . . ); PUF: (0.0044_301 . . . 328_ . . . ); RNA_POL_M_15KD: (3.3_367 . . . 381_ . . . ); RNA_POL_M_15KD: (3.4_372 . . . 403_ . . . ); zf-Mss51: (0.028_346 . . . 410_ . . . ); zn-ribbon_14: (0.25_370 . . . 386_ . . . ); zn-ribbon_14: (0.46_390 . . . 402_ . . . ) |
| 153 | 30 | *Bacillus* sp. multi | C1_1: (0.00067_368 . . . 414_ . . . ); OrfB_IS605: (0.00011_203 . . . 338_ . . . ); OrfB_Zn_ribbon: (3.2e-23_349 . . . 418_ . . . ); PUF: (0.0052_308 . . . 335_ . . . ); RNA_POL_M_15KD: (2.6_379 . . . 410_ . . . ); RNA_POL_M_15KD: (3.8_374 . . . 388_ . . . ); zf-Mss51: (0.036_355 . . . 417_ . . . ); zn-ribbon_14: (0.25_377 . . . 393_ . . . ); zn-ribbon_14: (0.47_397 . . . 409_ . . . ) |
| 154 | 31 | *Bacillus* sp. multi | C1_1: (0.00068_368 . . . 414_ . . . ); OrfB_IS605: (0.00014_204 . . . 338_ . . . ); OrfB_Zn_ribbon: (4.8e-24_349 . . . 418_ . . . ); PUF: (0.0044_308 . . . 335_ . . . ); RNA_POL_M_15KD: (2.6_379 . . . 410_ . . . ); |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| | | | RNA_POL_M_15KD: (3.8_374 . . . 388_ . . . );
zf-Mss51: (0.033_353 . . . 415_ . . . );
zn-ribbon_14: (0.25_377 . . . 393_ . . . );
zn-ribbon_14: (0.47_397 . . . 409_ . . . ) |
| 155 | 32 | *Bacillus* sp. multi | HypA: (0.0032_322 . . . 415_ . . . );
OrfB_IS605: (0.0002_196 . . . 331_ . . . );
OrfB_Zn_ribbon: (4.8e-23_342 . . . 410_ . . . );
PUF: (0.0044_301 . . . 328_ . . . );
RNA_POL_M_15KD: (3.2_372 . . . 403_ . . . );
RNA_POL_M_15KD: (3.4_367 . . . 381_ . . . );
zf-Mss51: (0.083_349 . . . 407_ . . . );
zn-ribbon_14: (0.26_370 . . . 385_ . . . );
zn-ribbon_14: (0.46_390 . . . 402_ . . . ) |
| 156 | 33 | *Bacillus* sp. multi | OrfB_IS605: (0.00018_196 . . . 331_ . . . ); OrfB_Zn_ribbon: (9.5e-24_342 . . . 411_ . . . ); PUF: (0.0044_301 . . . 328_ . . . );
RNA_POL_M_15KD: (3.1_366 . . . 381_ . . . );
RNA_POL_M_15KD: (3.3_372 . . . 403_ . . . );
zf-Mss51: (0.046_346 . . . 410_ . . . );
zn-ribbon_14: (0.25_370 . . . 386_ . . . );
zn-ribbon_14: (0.46_390 . . . 402_ . . . ) |
| 157 | 34 | *Bacillus* sp. multi | OrfB_IS605: (7.4e-05_195 . . . 331_ . . . ); OrfB_Zn_ribbon: (6.3e-24_342 . . . 411_ . . . ); PUF: (0.0051_301 . . . 328_ . . . );
RNA_POL_M_15KD: (2.5_372 . . . 403_ . . . );
RNA_POL_M_15KD: (3_366 . . . 381_ . . . );
zf-Mss51: (0.1_346 . . . 410_ . . . ); zn-ribbon_14: (0.26_370 . . . 385_ . . . ); zn-ribbon_14: (0.46_390 . . . 402_ . . . ) |
| 158 | 35 | *Bacillus* sp. multi | OrfB_IS605: (0.00018_204 . . . 338_ . . . ); OrfB_Zn_ribbon: (2.2e-23_349 . . . 418_ . . . ); PUF: (0.0044_308 . . . 335_ . . . );
RNA_POL_M_15KD: (3.3_374 . . . 388_ . . . );
RNA_POL_M_15KD: (3.4_379 . . . 410_ . . . );
zf-Mss51: (0.03_353 . . . 417_ . . . );
zn-ribbon_14: (0.25_377 . . . 393_ . . . );
zn-ribbon_14: (0.47_397 . . . 409_ . . . ) |
| 159 | 36 | *Bacillus* sp. multi | C1_1: (0.00068_361 . . . 405_ . . . ); OrfB_IS605: (0.00027_195 . . . 331_ . . . ); OrfB_Zn_ribbon: (6.1e-24_342 . . . 411_ . . . ); PUF: (0.0051_301 . . . 328_ . . . );
RNA_POL_M_15KD: (2.1_372 . . . 403_ . . . );
RNA_POL_M_15KD: (3.4_366 . . . 381_ . . . );
zf-Mss51: (0.046_346 . . . 409_ . . . );
zn-ribbon_14: (0.25_370 . . . 386_ . . . );
zn-ribbon_14: (0.46_390 . . . 402_ . . . ) |
| 160 | 37 | *Bacillus* sp. multi | C1_1: (0.00089_361 . . . 407_ . . . ); OrfB_IS605: (0.00012_195 . . . 331_ . . . ); OrfB_Zn_ribbon: (3.2e-23_342 . . . 411_ . . . ); PUF: (0.0051_301 . . . 328_ . . . );
RNA_POL_M_15KD: (2.8_367 . . . 380_ . . . );
RNA_POL_M_15KD: (3.1_372 . . . 403_ . . . );
zf-Mss51: (0.091_350 . . . 407_ . . . );
zn-ribbon_14: (0.26_370 . . . 385_ . . . );
zn-ribbon_14: (0.46_390 . . . 402_ . . . ) |
| 161 | 38 | *Bacillus* sp. multi | C1_1: (0.00067_368 . . . 414_ . . . ); OrfB_IS605: (9.4e-05_204 . . . 338_ . . . ); OrfB_Zn_ribbon: (1.9e-23_349 . . . 418_ . . . ); PUF: (0.0025_308 . . . 335_ . . . );
RNA_POL_M_15KD: (2.1_379 . . . 410_ . . . );
RNA_POL_M_15KD: (3.4_373 . . . 388_ . . . );
zf-Mss51: (0.043_353 . . . 416_ . . . );
zn-ribbon_14: (0.25_377 . . . 393_ . . . );
zn-ribbon_14: (0.47_397 . . . 409_ . . . ) |
| 162 | 39 | *Bacillus* sp. multi | C1_1: (0.00066_362 . . . 408_ . . . ); OrfB_IS605: (4.3e-05_203 . . . 332_ . . . ); OrfB_Zn_ribbon: (1.8e-23_343 . . . 412_ . . . ); PUF: (0.0044_302 . . . 329_ . . . );
RNA_POL_M_15KD: (2.1_373 . . . 404_ . . . );
RNA_POL_M_15KD: (3.4_367 . . . 382_ . . . );
zf-Mss51: (0.04_348 . . . 409_ . . . ); zn-ribbon_14: (0.25_371 . . . 387_ . . . ); zn-ribbon_14: (0.46_391 . . . 403_ . . . ) |
| 163 | 40 | *Bacillus* sp. multi | C1_1: (0.00067_368 . . . 414_ . . . ); OrfB_IS605: (9.3e-05_200 . . . 338_ . . . ); OrfB_Zn_ribbon: (1.9e-23_349 . . . 418_ . . . ); PUF: (0.0052_308 . . . 335_ . . . );
RNA_POL_M_15KD: (2.1_379 . . . 410_ . . . );
RNA_POL_M_15KD: (3.4_373 . . . 388_ . . . );
zf-Mss51: (0.043_353 . . . 416_ . . . );
zn-ribbon_14: (0.25_377 . . . 393_ . . . );
zn-ribbon_14: (0.47_397 . . . 409_ . . . ) |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| 164 | 41 | *Bacillus* sp. multi | C1_1: (0.00089_361 . . . 407_ . . . ); OrfB_IS605: (8.3e−06_197 . . . 331_ . . . ); OrfB_Zn_ribbon: (1.5e−23_342 . . . 411_ . . . ); PUF: (0.0051_301 . . . 328_ . . . ); RNA_POL_M_15KD: (3_366 . . . 381_ . . . ); RNA_POL_M_15KD: (3_372 . . . 403_ . . . ); TipE: (1.7e−05_358 . . . 441_ . . . ); zf-Mss51: (0.1_348 . . . 407_ . . . ); zn-ribbon_14: (0.26_370 . . . 385_ . . . ); zn-ribbon_14: (0.46_390 . . . 402_ . . . ) |
| 165 | 42 | *Bacillus* sp. multi | C1_1: (0.00067_368 . . . 414_ . . . ); OrfB_IS605: (9.4e−05_204 . . . 338_ . . . ); OrfB_Zn_ribbon: (1.9e−23_349 . . . 418_ . . . ); PUF: (0.0025_308 . . . 335_ . . . ); RNA_POL_M_15KD: (2.1_379 . . . 410_ . . . ); RNA_POL_M_15KD: (3.4_373 . . . 388_ . . . ); zf-Mss51: (0.043_353 . . . 416_ . . . ); zn-ribbon_14: (0.25_377 . . . 393_ . . . ); zn-ribbon_14: (0.47_397 . . . 409_ . . . ) |
| 166 | 43 | *Bacillus* sp. multi | OrfB_IS605: (7.9e−05_195 . . . 331_ . . . ); OrfB_Zn_ribbon: (9.5e−23_342 . . . 411_ . . . ); PUF: (0.0051_301 . . . 328_ . . . ); RNA_POL_M_15KD: (2.5_372 . . . 403_ . . . ); RNA_POL_M_15KD: (3_366 . . . 381_ . . . ); zf-Mss51: (0.1_346 . . . 407_ . . . ); zf-Mss51: (9.6_268 . . . 296_ . . . ); zn-ribbon_14: (0.26_370 . . . 385_ . . . ); zn-ribbon_14: (0.46_390 . . . 402_ . . . ) |
| 167 | 44 | *Bacillus* sp. multi | C1_1: (0.00066_361 . . . 407_ . . . ); OrfB_IS605: (9.2e−05_197 . . . 331_ . . . ); OrfB_Zn_ribbon: (1.8e−23_342 . . . 411_ . . . ); PUF: (0.0025_301 . . . 328_ . . . ); RNA_POL_M_15KD: (2.1_372 . . . 403_ . . . ); RNA_POL_M_15KD: (3.4_366 . . . 381_ . . . ); zf-Mss51: (0.044_346 . . . 409_ . . . ); zn-ribbon_14: (0.25_370 . . . 386_ . . . ); zn-ribbon_14: (0.46_390 . . . 402_ . . . ) |
| 168 | 45 | *Bacillus* sp. multi | C1_1: (0.0019_368 . . . 414_ . . . ); DUF3336: (0.0094_292 . . . 335_ . . . ); DUF3336: (0.65_177 . . . 226_ . . . ); DUF3336: (8.2e−05_407 . . . 455_ .]); OrfB_IS605: (9.7e−05_203 . . . 338_ . . . ); OrfB_Zn_ribbon: (9.9e−24_349 . . . 418_ . . . ); PUF: (0.0045_308 . . . 335_ . . . ); RNA_POL_M_15KD: (3.2_373 . . . 388_ . . . ); RNA_POL_M_15KD: (3.4_379 . . . 410_ . . . ); zf-Mss51: (0.043_354 . . . 415_ . . . ); zn-ribbon_14: (0.26_377 . . . 393_ . . . ); zn-ribbon_14: (0.48_397 . . . 409_ . . . ) |
| 169 | 46 | *Bacillus* sp. multi | OrfB_IS605: (0.00012_197 . . . 331_ . . . ); OrfB_Zn_ribbon: (6.3e−24_342 . . . 411_ . . . ); RNA_POL_M_15KD: (2.5_372 . . . 403_ . . . ); RNA_POL_M_15KD: (3_366 . . . 381_ . . . ); zf-Mss51: (0.1_346 . . . 410_ . . . ); zn-ribbon_14: (0.26_370 . . . 385_ . . . ); zn-ribbon_14: (0.46_390 . . . 402_ . . . ) |
| 170 | 47 | *Bacillus* sp. multi | OrfB_IS605: (4.3e−05_203 . . . 332_ . . . ); OrfB_Zn_ribbon: (9.5e−24_343 . . . 412_ . . . ); PUF: (0.0044_302 . . . 329_ . . . ); RNA_POL_M_15KD: (3.1_367 . . . 382_ . . . ); RNA_POL_M_15KD: (3.4_373 . . . 404_ . . . ); zf-Mss51: (0.044_348 . . . 409_ . . . ); zn-ribbon_14: (0.25_371 . . . 387_ . . . ); zn-ribbon_14: (0.46_391 . . . 403_ . . . ) |
| 171 | 48 | *Bacillus* sp. multi | OrfB_IS605: (4.3e−05_203 . . . 332_ . . . ); OrfB_Zn_ribbon: (9.5e−24_343 . . . 412_ . . . ); PUF: (0.0044_302 . . . 329_ . . . ); RNA_POL_M_15KD: (3.1_367 . . . 382_ . . . ); RNA_POL_M_15KD: (3.4_373 . . . 404_ . . . ); zf-Mss51: (0.044_348 . . . 409_ . . . ); zn-ribbon_14: (0.25_371 . . . 387_ . . . ); zn-ribbon_14: (0.46_391 . . . 403_ . . . ) |
| 172 | 49 | *Bacillus* sp. multi | DsrC: (0.023_36 . . . 109_ . . . ); DsrC: (5.8e−05_146 . . . 203_ . . . ); HypA: (0.0062_340 . . . 422_ . . . ); OrfB_IS605: (0.00022_203 . . . 338_ . . . ); OrfB_Zn_ribbon: (2.7e−22_349 . . . 417_ . . . ); PUF: (0.0044_308 . . . 335_ . . . ); RNA_POL_M_15KD: (3.2_379 . . . 410_ . . . ); RNA_POL_M_15KD: (3.5_374 . . . 388_ . . . ); zf-Mss51: (0.098_357 . . . 414_ . . . ); zn-ribbon_14: (0.27_377 . . . 392_ . . . ); zn-ribbon_14: (0.47_397 . . . 409_ . . . ) |
| 173 | 50 | *Bacillus* sp. multi | OrfB_IS605: (1.5e−05_196 . . . 325_ . . . ); OrfB_Zn_ribbon: (9.3e−24_336 . . . 405_ . . . ); PUF: (0.0043_295 . . . 322_ . . . ); RNA_POL_M_15KD: (3.1_360 . . . 375_ . . . ); RNA_POL_M_15KD: (3.3_366 . . . 397_ . . . ); zf-Mss51: (0.042_341 . . . 404_ . . . ); zn-ribbon_14: (0.25_364 . . . 380_ . . . ); zn-ribbon_14: (0.46_384 . . . 396_ . . . ) |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| 174 | 51 | *Bacillus* sp. multi | HypA: (0.0039_330 . . . 415_ . . . ); OrfB_IS605: (0.00017_196 . . . 331_ . . . ); OrfB_Zn_ribbon: (4.8e−23_342 . . . 410_ . . . ); PUF: (0.0044_301 . . . 328_ . . . ); RNA_POL_M_15KD: (3.2_372 . . . 403_ . . . ); RNA_POL_M_15KD: (3.4_367 . . . 381_ . . . ); zf-Mss51: (0.083_349 . . . 407_ . . . ); zn-ribbon_14: (0.26_370 . . . 385_ . . . ); zn-ribbon_14: (0.46_390 . . . 402_ . . . ) |
| 175 | 52 | *Bacillus* sp. multi | OrfB_IS605: (4.3e−05_203 . . . 332_ . . . ); OrfB_Zn_ribbon: (9.5e−24_343 . . . 412_ . . . ); PUF: (0.0044_302 . . . 329_ . . . ); RNA_POL_M_15KD: (3.1_367 . . . 382_ . . . ); RNA_POL_M_15KD: (3.4_373 . . . 404_ . . . ); zf-Mss51: (0.044_348 . . . 409_ . . . ); zn-ribbon_14: (0.25_371 . . . 387_ . . . ); zn-ribbon_14: (0.46_391 . . . 403_ . . . ) |
| 176 | 53 | *Paenibacillus* sp. novel | OrfB_IS605: (1.6e−05_203 . . . 332_ . . . ); OrfB_Zn_ribbon: (9.5e−24_343 . . . 412_ . . . ); PUF: (0.0044_302 . . . 329_ . . . ); RNA_POL_M_15KD: (3.1_367 . . . 382_ . . . ); RNA_POL_M_15KD: (3.4_373 . . . 404_ . . . ); zf-Mss51: (0.044_348 . . . 409_ . . . ); zn-ribbon_14: (0.25_371 . . . 387_ . . . ); zn-ribbon_14: (0.46_391 . . . 403_ . . . ) |
| 177 | 54 | *Bacillus thuringiensis* | C1_1: (0.00079_360 . . . 405_ . . . ); OrfB_IS605: (0.00014_195 . . . 331_ . . . ); OrfB_Zn_ribbon: (6.4e−23_342 . . . 411_ . . . ); PUF: (0.0025_301 . . . 328_ . . . ); RNA_POL_M_15KD: (0.018_378 . . . 403_ . . . ); RNA_POL_M_15KD: (3.3_364 . . . 381_ . . . ); zf-Mss51: (0.11_350 . . . 408_ . . . ); zn-ribbon_14: (0.26_370 . . . 385_ . . . ); zn-ribbon_14: (0.46_390 . . . 402_ . . . ) |
| 178 | 55 | *Bacillus* sp. multi | C1_1: (0.00081_367 . . . 412_ . . . ); OrfB_IS605: (0.00016_203 . . . 338_ . . . ); OrfB_Zn_ribbon: (6.6e−23_349 . . . 418_ . . . ); PUF: (0.0025_308 . . . 335_ . . . ); RNA_POL_M_15KD: (0.019_385 . . . 410_ . . . ); RNA_POL_M_15KD: (3.4_371 . . . 388_ . . . ); zf-Mss51: (0.12_358 . . . 417_ . . . ); zn-ribbon_14: (0.27_377 . . . 392_ . . . ); zn-ribbon_14: (0.47_397 . . . 409_ . . . ) |
| 179 | 56 | *Bacillus* sp. multi | C1_1: (0.00079_360 . . . 405_ . . . ); OrfB_IS605: (0.00016_196 . . . 331_ . . . ); OrfB_Zn_ribbon: (6.4e−23_342 . . . 411_ . . . ); PUF: (0.0025_301 . . . 328_ . . . ); RNA_POL_M_15KD: (0.018_378 . . . 403_ . . . ); RNA_POL_M_15KD: (3.3_364 . . . 381_ . . . ); zf-Mss51: (0.11_350 . . . 408_ . . . ); zn-ribbon_14: (0.26_370 . . . 385_ . . . ); zn-ribbon_14: (0.46_390 . . . 402_ . . . ) |
| 180 | 57 | *Bacillus* sp. multi | C1_1: (0.00079_360 . . . 405_ . . . ); OrfB_IS605: (0.00016_195 . . . 331_ . . . ); OrfB_Zn_ribbon: (6.4e−23_342 . . . 411_ . . . ); PUF: (0.0025_301 . . . 328_ . . . ); RNA_POL_M_15KD: (0.018_378 . . . 403_ . . . ); RNA_POL_M_15KD: (3.3_364 . . . 381_ . . . ); zf-Mss51: (0.11_350 . . . 408_ . . . ); zn-ribbon_14: (0.26_370 . . . 385_ . . . ); zn-ribbon_14: (0.46_390 . . . 402_ . . . ) |
| 181 | 58 | *Bacillus* sp. multi | C1_1: (0.00079_360 . . . 405_ . . . ); OrfB_IS605: (0.0001_196 . . . 331_ . . . ); OrfB_Zn_ribbon: (6.4e−23_342 . . . 411_ . . . ); PUF: (0.0025_301 . . . 328_ . . . ); RNA_POL_M_15KD: (0.018_378 . . . 403_ . . . ); RNA_POL_M_15KD: (3.3_364 . . . 381_ . . . ); zf-Mss51: (0.11_350 . . . 408_ . . . ); zn-ribbon_14: (0.26_370 . . . 385_ . . . ); zn-ribbon_14: (0.46_390 . . . 402_ . . . ) |
| 182 | 59 | *Bacillus* sp. multi | C1_1: (0.0018_362 . . . 408_ . . . ); OrfB_IS605: (1.5e−05_203 . . . 332_ . . . ); OrfB_Zn_ribbon: (9.3e−24_343 . . . 412_ . . . ); PUF: (0.0043_302 . . . 329_ . . . ); RNA_POL_M_15KD: (3.2_367 . . . 382_ . . . ); RNA_POL_M_15KD: (3.2_373 . . . 404_ . . . ); zf-Mss51: (0.042_348 . . . 411_ . . . ); zn-ribbon_14: (0.25_371 . . . 387_ . . . ); zn-ribbon_14: (0.46_391 . . . 403_ . . . ) |
| 183 | 60 | *Bacillus* sp. multi | C1_1: (0.0008_360 . . . 405_ . . . ); DUF3336: (0.012_283 . . . 327_ . . . ); DUF3336: (0.35_164 . . . 220_ . . . ); DUF3336: (7e−05_397 . . . 448_.]); OrfB_IS605: (0.00016_196 . . . 331_ . . . ); OrfB_Zn_ribbon: (6.5e−23_342 . . . 411_ . . . ); PUF: (0.0025_301 . . . 328_ . . . ); RNA_POL_M_15KD: (0.019_378 . . . 403_ . . . ); RNA_POL_M_15KD: (3.3_364 . . . 381_ . . . ); zf-Mss51: (0.12_351 . . . 410_ . . . ); zn-ribbon_14: (0.27_370 . . . 385_ . . . ); zn-ribbon_14: (0.47_390 . . . 402_ . . . ) |
| 184 | 61 | *Bacillus* sp. multi | C1_1: (0.0016_313 . . . 359_ . . . ); OrfB_IS605: (3.5e−05_153 . . . 283_ . . . ); OrfB_Zn_ribbon: (8e−24_294 . . . 363_ . . . ); PUF: (0.0038_253 . . . 280_ . . . ); RNA_POL_M_15KD: (3_318 . . . 333_ . . . ); |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| | | | RNA_POL_M_15KD: (3_324 . . . 355_ . . . ); zf-Mss51: (0.041_298 . . . 362_ . . . ); zn-ribbon_14: (0.22_322 . . . 338_ . . . ); zn-ribbon_14: (0.41_342 . . . 354_ . . . ) |
| 185 | 62 | *Bacillus* sp. multi | C1_1: (0.0015_368 . . . 413_ . . . ); C1_2: (0.0013_362 . . . 407_ . . . ); HypA: (0.0022_316 . . . 421_ . . . ); Lar_restr_allev: (0.006_371 . . . 420_ . . . ); Lar_restr_allev: (0.031_90 . . . 111_ . . . ); Lar_restr_allev: (2.2_299 . . . 346_ . . . ); OrfB_Zn_ribbon: (1.4e−24_348 . . . 416_ . . . ); PUF: (0.00047_307 . . . 333_ . . . ); PUF: (1_36 . . . 55_ . . . ); Tnp_zf-ribbon_2: (0.0001_376 . . . 406_ . . . ); Tnp_zf-ribbon_2: (3.3_276 . . . 327_ . . . ) |
| 186 | 63 | *Bacillus* sp. multi | C1_1: (0.002_361 . . . 404_ . . . ); C1_2: (0.00047_355 . . . 400_ . . . ); C1_3: (0.019_369 . . . 400_ . . . ); HypA: (0.0015_309 . . . 414_ . . . ); OrfB_IS605: (0.00069_204 . . . 330_ . . . ); OrfB_Zn_ribbon: (1.9e−24_341 . . . 410_ . . . ); PUF: (0.51_29 . . . 49_ . . . ); PUF: (3.1e−05_300 . . . 327_ . . . ); PUF: (6.6_414 . . . 431_ . . . ); Tnp_zf-ribbon_2: (2.4_292 . . . 320_ . . . ); Tnp_zf-ribbon_2: (3.6e−05_344 . . . 399_ . . . ) |
| 187 | 64 | *Bacillus* sp. multi | C1_1: (0.0021_371 . . . 414_ . . . ); C1_2: (0.00048_365 . . . 410_ . . . ); C1_3: (0.02_379 . . . 410_ . . . ); HypA: (0.0015_319 . . . 424_ . . . ); OrfB_IS605: (0.00072_214 . . . 340_ . . . ); OrfB_Zn_ribbon: (1.9e−24_351 . . . 420_ . . . ); PUF: (0.53_39 . . . 59_ . . . ); PUF: (3.1e−05_310 . . . 337_ . . . ); PUF: (6.7_424 . . . 441_ . . . ); Tnp_zf-ribbon_2: (2.4_302 . . . 330_ . . . ); Tnp_zf-ribbon_2: (3.7e−05_354 . . . 409_ . . . ) |
| 188 | 65 | *Bacillus* sp. multi | C1_1: (0.002_368 . . . 411_ . . . ); C1_2: (0.00048_362 . . . 407_ . . . ); C1_3: (0.019_376 . . . 407_ . . . ); HypA: (0.0015_316 . . . 421_ . . . ); OrfB_IS605: (0.00071_211 . . . 337_ . . . ); OrfB_Zn_ribbon: (1.9e−24_348 . . . 417_ . . . ); PUF: (0.52_36 . . . 56_ . . . ); PUF: (3.1e−05_307 . . . 334_ . . . ); PUF: (6.7_421 . . . 438_ . . . ); Tnp_zf-ribbon_2: (2.4_299 . . . 327_ . . . ); Tnp_zf-ribbon_2: (3.7e−05_351 . . . 406_ . . . ) |
| 189 | 66 | *Bacillus* sp. multi | C1_1: (0.0019_362 . . . 405_ . . . ); C1_2: (0.00053_355 . . . 400_ . . . ); C1_3: (0.019_369 . . . 400_ . . . ); C1_3: (5.7_364 . . . 379_ . . . ); CEBP_ZZ: (0.051_358 . . . 410_ . . . ); CEBP_ZZ: (1.1_283 . . . 324_ . . . ); OrfB_IS605: (0.0007_204 . . . 330_ . . . ); OrfB_Zn_ribbon: (3e−25_341 . . . 410_ . . . ); PUF: (0.51_29 . . . 49_ . . . ); PUF: (3.1e−05_300 . . . 327_ . . . ); Tnp_zf-ribbon_2: (2.4_292 . . . 320_ . . . ); Tnp_zf-ribbon_2: (3.6e−05_344 . . . 399_ . . . ) |
| 190 | 67 | *Bacillus* sp. multi | C1_1: (0.0018_369 . . . 411_ . . . ); C1_2: (0.00054_362 . . . 407_ . . . ); C1_3: (0.021_376 . . . 407_ . . . ); C1_3: (5.8_371 . . . 386_ . . . ); CEBP_ZZ: (0.053_365 . . . 416_ . . . ); CEBP_ZZ: (1.1_290 . . . 331_ . . . ); HypA: (0.0012_316 . . . 421_ . . . ); OrfB_IS605: (0.00071_211 . . . 337_ . . . ); OrfB_Zn_ribbon: (3.4e−25_348 . . . 417_ . . . ); PUF: (0.52_36 . . . 56_ . . . ); PUF: (3.1e−05_307 . . . 334_ . . . ); PUF: (6.7_421 . . . 438_ . . . ); Tnp_zf-ribbon_2: (2.4_299 . . . 327_ . . . ); Tnp_zf-ribbon_2: (3.6e−05_351 . . . 406_ . . . ) |
| 191 | 68 | *Bacillus* sp. multi | C1_1: (0.0018_369 . . . 411_ . . . ); C1_2: (0.00054_362 . . . 407_ . . . ); C1_3: (0.021_376 . . . 407_ . . . ); C1_3: (5.8_371 . . . 386_ . . . ); CEBP_ZZ: (0.053_365 . . . 416_ . . . ); CEBP_ZZ: (1.1_290 . . . 331_ . . . ); HypA: (0.0012_316 . . . 421_ . . . ); OrfB_IS605: (0.00071_211 . . . 337_ . . . ); OrfB_Zn_ribbon: (3.4e−25_348 . . . 417_ . . . ); PUF: (0.46_36 . . . 56_ . . . ); PUF: (3.1e−05_307 . . . 334_ . . . ); PUF: (6.7_421 . . . 438_ . . . ); Tnp_zf-ribbon_2: (2.4_299 . . . 327_ . . . ); Tnp_zf-ribbon_2: (3.6e−05_351 . . . 406_ . . . ) |
| 192 | 69 | *Bacillus* sp. multi | C1_1: (0.0017_362 . . . 404_ . . . ); C1_2: (0.00053_355 . . . 400_ . . . ); C1_3: (0.019_369 . . . 400_ . . . ); C1_3: (5.7_364 . . . 379_ . . . ); CEBP_ZZ: (0.052_358 . . . 409_ . . . ); CEBP_ZZ: (1.1_283 . . . 324_ . . . ); HypA: (0.0012_309 . . . 414_ . . . ); OrfB_IS605: (0.00069_204 . . . 330_ . . . ); OrfB_Zn_ribbon: (3.3e−25_341 . . . 410_ . . . ); PUF: (0.51_29 . . . 49_ . . . ); PUF: (3.1e−05_300 . . . 327_ . . . ); PUF: (6.6_414 . . . 431_ . . . ); Tnp_zf-ribbon_2: (2.4_292 . . . 320_ . . . ); Tnp_zf-ribbon_2: (3.6e−05_344 . . . 399_ . . . ) |
| 193 | 70 | *Bacillus* sp. multi | C1_2: (0.0011_362 . . . 407_ . . . ); C1_3: (0.0092_376 . . . 407_ . . . ); DCAF15_WD40: (0.53_146 . . . 224_ . . . ); DCAF15_WD40: (1.6e−06_345 . . . 429_ . . . ); OrfB_IS605: (0.00066_211 . . . 337_ . . . ); OrfB_Zn_ribbon: (1.4e−24_348 . . . 417_ . . . ); PUF: (0.75_36 . . . 56_ . . . ); |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| 194 | 71 | Bacillus sp. multi | PUF: (3.1e-05_307 . . . 334_ . . . ); Tnp_zf-ribbon_2: (0.0086_376 . . . 406_ . . . ); Tnp_zf-ribbon_2: (1.2_351 . . . 383_ . . . ); Tnp_zf-ribbon_2: (2.4_299 . . . 327_ . . . ) C1_1: (0.0011_369 . . . 411_ . . . ); C1_2: (0.00048_360 . . . 407_ . . . ); C1_3: (0.02_376 . . . 407_ . . . ); C1_3: (6_372 . . . 386_ . . . ); CEBP_ZZ: (0.048_365 . . . 416_ . . . ); CEBP_ZZ: (1.1_290 . . . 331_ . . . ); HypA: (0.0012_316 . . . 421_ . . . ); OrfB_IS605: (0.00093_211 . . . 337_ . . . ); OrfB_Zn_ribbon: (3.9e-25_348 . . . 417_ . . . ); PUF: (0.52_36 . . . 56_ . . . ); PUF: (3.6e-05_307 . . . 333_ . . . ); Salp15: (2.5_269 . . . 428_ . . . ); Tnp_zf-ribbon_2: (2_297 . . . 327_ . . . ); Tnp_zf-ribbon_2: (7.6e-05_376 . . . 406_ . . . ) |
| 195 | 72 | Bacillus thuringiensis | C1_1: (0.0018_369 . . . 411_ . . . ); C1_2: (0.00051_361 . . . 407_ . . . ); C1_3: (0.021_376 . . . 407_ . . . ); C1_3: (5.8_371 . . . 386_ . . . ); CEBP_ZZ: (0.053_365 . . . 416_ . . . ); CEBP_ZZ: (1.1_290 . . . 331_ . . . ); HypA: (0.00089_315 . . . 421_ . . . ); OrfB_IS605: (0.00071_211 . . . 337_ . . . ); OrfB_Zn_ribbon: (3e-25_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (2.4_299 . . . 327_ . . . ); Tnp_zf-ribbon_2: (3.9e-05_351 . . . 406_ . . . ) |
| 196 | 73 | Bacillus sp. multi | C1_1: (0.0018_369 . . . 411_ . . . ); C1_2: (0.00054_362 . . . 407_ . . . ); C1_3: (0.021_376 . . . 407_ . . . ); C1_3: (5.8_371 . . . 386_ . . . ); CEBP_ZZ: (0.053_365 . . . 416_ . . . ); CEBP_ZZ: (1.1_290 . . . 331_ . . . );HypA: (0.0012_316 . . . 421_ . . . ); OrfB_IS605: (0.00071_211 . . . 337_ . . . ); OrfB_Zn_ribbon: (3.4e-25_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (2.4_299 . . . 327_ . . . ); Tnp_zf-ribbon_2: (3.6e-05_351 . . . 406_ . . . ) |
| 197 | 74 | Bacillus sp. multi | C1_1: (0.0018_369 . . . 411_ . . . ); C1_2: (0.00054_362 . . . 407_ . . . ); C1_3: (0.021_376 . . . 407_ . . . ); C1_3: (5.8_371 . . . 386_ . . . ); CEBP_ZZ: (0.052_365 . . . 416_ . . . ); CEBP_ZZ: (1.1_290 . . . 331_ . . . ); HypA: (0.0017_316 . . . 421_ . . . ); OrfB_IS605: (0.00071_211 . . . 337_ . . . ); OrfB_Zn_ribbon: (2.3e-25_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (2.4_299 . . . 327_ . . . ); Tnp_zf-ribbon_2: (3.6e-05_351 . . . 406_ . . . ) |
| 198 | 75 | Bacillus sp. multi | C1_1: (0.00092_317 . . . 359_ . . . ); C1_2: (0.00041_309 . . . 355_ . . . ); C1_3: (0.017_324 . . . 355_ . . . ); C1_3: (5.6_320 . . . 333_ . . . ); CEBP_ZZ: (0.044_313 . . . 364_ . . . ); CEBP_ZZ: (0.94_238 . . . 279_ . . . ); HypA: (0.00094_262 . . . 369_ . . . ); OrfB_IS605: (0.0012_159 . . . 285_ . . . ); OrfB_Zn_ribbon: (1.4e-25_296 . . . 365_ . . . ); PUF: (3.1e-05_255 . . . 281_ . . . ); Salp15: (3.8_219 . . . 376_ . . . ); Tnp_zf-ribbon_2: (0.00028_324 . . . 354_ . . . ); Tnp_zf-ribbon_2: (1.1_299 . . . 331_ . . . ); Tnp_zf-ribbon_2: (1.8_245 . . . 275_ . . . ) |
| 199 | 76 | Bacillus sp. multi | C1_1: (0.0011_369 . . . 411_ . . . ); C1_2: (0.00039_361 . . . 407_ . . . ); C1_3: (0.02_376 . . . 407_ . . . ); C1_3: (5.7_370 . . . 386_ . . . ); HypA: (0.00079_315 . . . 421_ . . . ); OrfB_IS605: (0.00071_211 . . . 337_ . . . ); OrfB_Zn_ribbon: (7.3e-25_348 . . . 417_ . . . ); PUF: (0.52_36 . . . 56_ . . . ); PUF: (3.1e-05_307 . . . 334_ . . . ); Salp15: (3.2_274 . . . 427_ . . . ); Tnp_zf-ribbon_2: (2.4_299 . . . 327_ . . . ); Tnp_zf-ribbon_2: (6.4e-06_351 . . . 406_ . . . ) |
| 200 | 77 | Bacillus sp. multi | C1_1: (0.0018_369 . . . 411_ . . . ); C1_2: (0.00054_362 . . . 407_ . . . ); C1_3: (0.021_376 . . . 407_ . . . ); C1_3: (5.8_371 . . . 386_ . . . ); CEBP_ZZ: (0.052_365 . . . 416_ . . . ); CEBP_ZZ: (1.1_290 . . . 331_ . . . ) ; HypA: (0.0017_316 . . . 421_ . . . ); OrfB_IS605: (0.00041_211 . . . 337_ . . . ); OrfB_Zn_ribbon: (2.3e-25_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (2.4_299 . . . 327_ . . . ); Tnp_zf-ribbon_2: (3.6e-05_351 . . . 406_ . . . ) |
| 201 | 78 | Bacillus sp. multi | C1_1: (0.00046_360 . . . 413_ . . . ); C1_2: (0.0009_358 . . . 407_ . . . ); HypA: (0.00096_314 . . . 421_ . . . ); Lar_restr_allev: (0.0052_365 . . . 421_ . . . ); Lar_restr_allev: (0.027_87 . . . 111_ . . . ); Lar_restr_allev: (8.6_303 . . . 339_ . . . ); OrfB_IS605: (0.00029_210 . . . 337_ . . . ); OrfB_Zn_ribbon: (3.3e-25_348 . . . 416_ . . . ); PUF: (1.3_36 . . . 56_ . . . ); PUF: (4.1e-05_307 . . . 333_ . . . ); Tnp_zf-ribbon_2: (1.2e-05_351 . . . 406_ . . . ); Tnp_zf-ribbon_2: (2.5_299 . . . 327_ . . . ) |
| 202 | 79 | Bacillus sp. multi | C1_1: (0.0029_369 . . . 411_ . . . ); C1_2: (0.001_362 . . . 407_ . . . ); C1_3: (0.13_378 . . . 407_ . . . ); C1_3: (2.8_370 . . . 387_ . . . ); CEBP_ZZ: (0.053_365 . . . 416_ . . . ); CEBP_ZZ: (1.1_290 . . . 331_ . . . ); OrfB_IS605: (0.00081_211 . . . 337_ . . . ); OrfB_Zn_ribbon: (5.4e-24_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (0.0034_376 . . . 406_ . . . ); Tnp_zf-ribbon_2: (2.1_351 . . . 383_ . . . ); Tnp_zf-ribbon_2: (2.4_299 . . . 327_ . . . ) |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| 203 | 80 | Bacillus sp. multi | C1_1: (0.0018_369 . . . 411_ . . . ); C1_2: (0.00054_362 . . . 407_ . . . ); C1_3: (0.021_376 . . . 407_ . . . ); C1_3: (5.8_371 . . . 386_ . . . ); CEBP_ZZ: (0.053_365 . . . 416_ . . . ); CEBP_ZZ: (1.1_290 . . . 331_ . . . ); HypA: (0.0012_316 . . . 421_ . . . ); OrfB_IS605: (0.00071_211 . . . 337_ . . . ); OrfB_Zn_ribbon: (3.4e-25_348 . . . 417_ . . . ); PUF: (0.75_36 . . . 56_ . . . ); PUF: (3.1e-05_307 . . . 334_ . . . ); PUF: (6.7_421 . . . 438_ . . . ); Tnp_zf-ribbon_2: (2.4_299 . . . 327_ . . . ); Tnp_zf-ribbon_2: (3.6e-05_351 . . . 406_ . . . ) |
| 204 | 81 | Bacillus sp. multi | C1_1: (0.0029_369 . . . 411_ . . . ); C1_2: (0.001_362 . . . 407_ . . . ); C1_3: (0.13_378 . . . 407_ . . . ); C1_3: (2.8_370 . . . 387_ . . . ); CEBP_ZZ: (0.053_365 . . . 416_ . . . ); CEBP_ZZ: (1.1_290 . . . 331_ . . . ); OrfB_IS605: (0.00071_211 . . . 337_ . . . ); OrfB_Zn_ribbon: (5.4e-24_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (0.0034_376 . . . 406_ . . . ); Tnp_zf-ribbon_2: (2.1_351 . . . 383_ . . . ); Tnp_zf-ribbon_2: (2.4_299 . . . 327_ . . . ) |
| 205 | 82 | Bacillus sp. multi | C1_2: (0.0011_355 . . . 400_ . . . ); C1_3: (0.0091_369 . . . 400_ . . . ); DCAF15_WD40: (0.91_140 . . . 214_ . . . ); DCAF15_WD40: (4.2e-06_338 . . . 421_ . . . ); OrfB_IS605: (0.0008_204 . . . 330_ . . . ); OrfB_Zn_ribbon: (1.4e-24_341 . . . 410_ . . . ); PUF: (0.74_29 . . . 49_ . . . ); PUF: (3.1e-05_300 . . . 327_ . . . ); Tnp_zf-ribbon_2: (0.0091_369 . . . 399_ . . . ); Tnp_zf-ribbon_2: (0.79_344 . . . 378_ . . . ); Tnp_zf-ribbon_2: (2.4_292 . . . 320_ . . . ) |
| 206 | 83 | Bacillus sp. multi | C1_1: (0.0018_369 . . . 411_ . . . ); C1_2: (0.00054_362 . . . 407_ . . . ); C1_3: (0.021_376 . . . 407_ . . . ); C1_3: (5.8_371 . . . 386_ . . . ); CEBP_ZZ: (0.053_365 . . . 416_ . . . ); CEBP_ZZ: (0.92_290 . . . 334_ . . . ); HypA: (0.0012_316 . . . 421_ . . . ); OrfB_IS605: (0.0013_211 . . . 337_ . . . ); OrfB_Zn_ribbon: (3.4e-25_348 . . . 417_ . . . ); PUF: (0.00031_307 . . . 333_ . . . ); PUF: (0.52_36 . . . 56_ . . . ); PUF: (6.7_421 . . . 438_ . . . ); Tnp_zf-ribbon_2: (2.4_299 . . . 327_ . . . ); Tnp_zf-ribbon_2: (3.6e-05_351 . . . 406_ . . . ) |
| 207 | 84 | Bacillus sp. multi | C1_1: (0.0011_362 . . . 404_ . . . ); C1_2: (0.00047_354 . . . 400_ . . . ); C1_3: (0.02_369 . . . 400_ . . . ); C1_3: (6_365 . . . 379_ . . . ); CEBP_ZZ: (0.047_358 . . . 409_ . . . ); CEBP_ZZ: (1.1_283 . . . 324_ . . . ); HypA: (0.0011_308 . . . 414_ . . . ); OrfB_IS605: (0.00065_204 . . . 330_ . . . ); OrfB_Zn_ribbon: (1.6e-25_341 . . . 410_ . . . ); PUF: (0.51_29 . . . 49_ . . . ); PUF: (3.5e-05_300 . . . 326_ . . . ); Salp15: (3.6_262 . . . 418_ . . . ); Tnp_zf-ribbon_2: (2.1_290 . . . 320_ . . . ); Tnp_zf-ribbon_2: (8.7e-06_344 . . . 399_ . . . ) |
| 208 | 85 | Bacillus sp. multi | C1_1: (0.0011_369 . . . 411_ . . . ); C1_2: (0.00048_361 . . . 407_ . . . ); C1_3: (0.02_376 . . . 407_ . . . ); C1_3: (6_372 . . . 386_ . . . ); CEBP_ZZ: (0.048_365 . . . 416_ . . . ); CEBP_ZZ: (1.1_290 . . . 331_ . . . ); HypA: (0.0012_315 . . . 421_ . . . ); OrfB_IS605: (0.00067_211 . . . 337_ . . . ); OrfB_Zn_ribbon: (1.6e-25_348 . . . 417_ . . . ); PUF: (0.52_36 . . . 56_ . . . ); PUF: (3.6e-05_307 . . . 333_ . . . ); Salp15: (3.6_266 . . . 427_ . . . ); Tnp_zf-ribbon_2: (2.2_297 . . . 327_ . . . ); Tnp_zf-ribbon_2: (8.9e-06_351 . . . 406_ . . . ) |
| 209 | 86 | Bacillus sp. multi | C1_1: (0.0011_369 . . . 411_ . . . ); C1_2: (0.00048_361 . . . 407_ . . . ); C1_3: (0.02_376 . . . 407_ . . . ); C1_3: (6_372 . . . 386_ . . . ); CEBP_ZZ: (0.048_365 . . . 416_ . . . ); CEBP_ZZ: (1.1_290 . . . 331_ . . . ); HypA: (0.0012_315 . . . 421_ . . . ); OrfB_IS605: (0.00067_211 . . . 337_ . . . ); OrfB_Zn_ribbon: (1.6e-25_348 . . . 417_ . . . ); PUF: (0.52_36 . . . 56_ . . . ); PUF: (3.6e-05_307 . . . 333_ . . . ); Salp15: (3.7_269 . . . 425_ . . . ); Tnp_zf-ribbon_2: (2.2_297 . . . 327_ . . . ); Tnp_zf-ribbon_2: (8.9e-06_351 . . . 406_ . . . ) |
| 210 | 87 | Bacillus sp. multi | C1_1: (0.0029_369 . . . 411_ . . . ); C1_2: (0.001_362 . . . 407_ . . . ); C1_3: (0.13_378 . . . 407_ . . . ); C1_3: (2.8_370 . . . 387_ . . . ); CEBP_ZZ: (0.053_365 . . . 416_ . . . ); CEBP_ZZ: (1.1_290 . . . 331_ . . . ); OrfB_IS605: (0.00071_211 . . . 337_ . . . ); OrfB_Zn_ribbon: (5.4e-24_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (0.0034_376 . . . 406_ . . . ); Tnp_zf-ribbon_2: (2.1_351 . . . 383_ . . . ); Tnp_zf-ribbon_2: (2.4_299 . . . 327_ . . . ) |
| 211 | 88 | Bacillus sp. multi | C1_2: (0.0016_362 . . . 407_ . . . ); CEBP_ZZ: (0.06_365 . . . 415_ . . . ); CEBP_ZZ: (1.1_289 . . . 331_ . . . ); DUF5118: (1.2e-05_182 . . . 219_ . . . ); HypA: (0.00072_314 . . . 421_ . . . ); Lar_restr_allev: (0.015_368 . . . 420_ . . . ); Lar_restr_allev: (0.027_87 . . . 111_ . . . ); Lar_restr_allev: (8.9_304 . . . 339_ . . . ); OrfB_IS605: (0.00012_210 . . . 337_ . . . ); OrfB_Zn_ribbon: (1.8e-25_348 . . . 416_ . . . ); PUF: (0.52_36 . . . 56_ . . . ); PUF: (3.1e-05_307 . . . 334_ . . . ); Tnp_zf-ribbon_2: (1.8_276 . . . 327_ . . . ); Tnp_zf-ribbon_2: (7e-05_351 . . . 406_ . . . ) |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| 212 | 89 | *Bacillus* sp. multi | C1_1: (0.0011_369 . . . 411_ . . . ); C1_2: (0.00048_361 . . . 407_ . . . ); C1_3: (0.02_376 . . . 407_ . . . ); C1_3: (6_372 . . . 386_ . . . ); CEBP_ZZ: (0.048_365 . . . 416_ . . . ); CEBP_ZZ: (1.1_290 . . . 331_ . . . ); HypA: (0.0012_315 . . . 421_ . . . ); OrfB_IS605: (0.00068_211 . . . 337_ . . . ); OrfB_Zn_ribbon: (1.6e-25_348 . . . 417_ . . . ); PUF: (0.52_36 . . . 56_ . . . ); PUF: (3.6e-05_307 . . . 333_ . . . ); Salp15: (4.4_268 . . . 425_ . . . ); Tnp_zf-ribbon_2: (2.2_297 . . . 327_ . . . ); Tnp_zf-ribbon_2: (8.9e-06_351 . . . 406_ . . . ) |
| 213 | 90 | *Bacillus* sp. multi | C1_1: (0.0029_369 . . . 411_ . . . ); C1_2: (0.001_362 . . . 407_ . . . ); C1_3: (0.13_378 . . . 407_ . . . ); C1_3: (2.8_370 . . . 387_ . . . ); CEBP_ZZ: (0.053_365 . . . 416_ . . . ); CEBP_ZZ: (1.1_290 . . . 331_ . . . ); OrfB_IS605: (0.00071_211 . . . 337_ . . . ); OrfB_Zn_ribbon: (5.4e-24_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (0.0034_376 . . . 406_ . . . ); Tnp_zf-ribbon_2: (2.1_351 . . . 383_ . . . ); Tnp_zf-ribbon_2: (2.4_299 . . . 327_ . . . ) |
| 214 | 91 | *Bacillus* sp. multi | C1_2: (0.0013_354 . . . 400_ . . . ); C1_3: (0.014_369 . . . 400_ . . . ); OrfB_IS605: (0.00069_204 . . . 330_ . . . ); OrfB_Zn_ribbon: (8.7e-25_341 . . . 410_ . . . ); PUF: (0.51_29 . . . 49_ . . . ); PUF: (6.8e-05_300 . . . 326_ . . . ); Tnp_zf-ribbon_2: (0.049_369 . . . 399_ . . . ); Tnp_zf-ribbon_2: (2.2_344 . . . 376_ . . . ) |
| 215 | 92 | *Bacillus* sp. multi | C1_1: (0.0028_369 . . . 411_ . . . ); C1_2: (0.00058_362 . . . 407_ . . . ); C1_3: (0.082_376 . . . 407_ . . . ); C1_3: (3.1_371 . . . 387_ . . . ); CEBP_ZZ: (0.054_365 . . . 416_ . . . ); CEBP_ZZ: (1.1_290 . . . 331_ . . . ); OrfB_IS605: (0.00081_211 . . . 337_ . . . ); OrfB_Zn_ribbon: (6.7e-24_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (0.00021_376 . . . 406_ . . . ); Tnp_zf-ribbon_2: (2.4_299 . . . 327_ . . . ) |
| 216 | 93 | *Bacillus* sp. multi | C1_1: (0.0029_369 . . . 411_ . . . ); C1_2: (0.001_362 . . . 407_ . . . ); C1_3: (0.13_378 . . . 407_ . . . ); C1_3: (2.8_370 . . . 387_ . . . ); CEBP_ZZ: (0.053_365 . . . 416_ . . . ); CEBP_ZZ: (1.1_290 . . . 331_ . . . ); OrfB_IS605: (0.00071_211 . . . 337_ . . . ); OrfB_Zn_ribbon: (5.4e-24_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (0.0034_376 . . . 406_ . . . ); Tnp_zf-ribbon_2: (2.1_351 . . . 383_ . . . ); Tnp_zf-ribbon_2: (2.4_299 . . . 327_ . . . ) |
| 217 | 94 | *Bacillus* sp. multi | C1_1: (0.014_372 . . . 413_ . . . ); C1_2: (0.0062_366 . . . 409_ . . . ); C1_3: (0.019_378 . . . 409_ . . . ); DUF5118: (3.6e-05_184 . . . 218_ . . . ); HypA: (0.0025_317 . . . 423_ . . . ); OrfB_IS605: (3.7e-05_211 . . . 339_ . . . ); OrfB_Zn_ribbon: (6.4e-25_350 . . . 419_ . . . ); PUF: (0.46_38 . . . 58_ . . . ); PUF: (3.6e-05_309 . . . 335_ . . . ); Tnp_zf-ribbon_2: (0.00017_353 . . . 408_ . . . ); Tnp_zf-ribbon_2: (9.3_278 . . . 329_ . . . ) |
| 218 | 95 | *Bacillus* sp. multi | C1_2: (0.0016_362 . . . 407_ . . . ); HypA: (0.0016_316 . . . 421_ . . . ); OrfB_IS605: (0.003_211 . . . 337_ . . . ); OrfB_Zn_ribbon: (1.5e-25_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (0.00012_351 . . . 406_ . . . ); Tnp_zf-ribbon_2: (2.4_299 . . . 327_ . . . ); Zn_Tnp_IS1595: (0.00084_372 . . . 403_ . . . ) |
| 219 | 96 | *Bacillus* sp. multi | C1_1: (0.0019_370 . . . 413_ . . . ); C1_2: (0.00055_364 . . . 409_ . . . ); C1_3: (0.021_378 . . . 409_ . . . ); C1_3: (5.8_373 . . . 388_ . . . ); CEBP_ZZ: (0.053_367 . . . 418_ . . . ); CEBP_ZZ: (1.1_291 . . . 333_ . . . ); DUF5118: (3.6e-05_184 . . . 218_ . . . ); HypA: (0.0012_317 . . . 423_ . . . ); OrfB_IS605: (0.00024_212 . . . 339_ . . . ); OrfB_Zn_ribbon: (3.9e-25_350 . . . 419_ . . . ); PUF: (1.7_38 . . . 58_ . . . ); PUF: (3.6e-05_309 . . . 335_ . . . ); Tnp_zf-ribbon_2: (2_278 . . . 329_ . . . ); Tnp_zf-ribbon_2: (3.6e-05_353 . . . 408_ . . . ) |
| 220 | 97 | *Bacillus* sp. multi | C1_1: (0.00066_360 . . . 413_ . . . ); C1_2: (0.0015_358 . . . 407_ . . . ); HypA: (0.0012_313 . . . 421_ . . . ); Lar_restr_allev: (0.0081_365 . . . 421_ . . . ); Lar_restr_allev: (0.027_87 . . . 111_ . . . ); Lar_restr_allev: (8.6_303 . . . 339_ . . . ); OrfB_IS605: (0.00018_210 . . . 337_ . . . ); OrfB_Zn_ribbon: (2.5e-25_348 . . . 416_ . . . ); PUF: (1.3_36 . . . 56_ . . . ); PUF: (4.1e-05_307 . . . 333_ . . . ); Tnp_zf-ribbon_2: (2.5_298 . . . 327_ . . . ); Tnp_zf-ribbon_2: (5e-05_351 . . . 406_ . . . ) |
| 221 | 98 | *Bacillus* sp. multi | CDC50: (1.4e-05_97 . . . 280_ . . . ); HTH_7: (1.3e-07_287 . . . 321_ . . . ); HTH_Tnp_ISL3: (1.7e-05_296 . . . 328_ . . . ); PDDEXK_2: (1.3e-84_40 . . . 278_ . . . ) |
| 222 | 99 | *Bacillus* sp. multi | HTH_15: (2e-05_299 . . . 331_1); PDDEXK_2: (7.2e-84_48 . . . 286_ . . . ) |
| 223 | 100 | *Bacillus thuringiensis* | DUF2802: (4.1e-05_232 . . . 328_ . . . ); PDDEXK_2: (7.2e-84_48 . . . 286_ . . . ) |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| 224 | 101 | *Bacillus megaterium* | Atg14: (0.054_322 . . . 399_ . . . ); Atg14: (1.3e-05_5 . . . 247_ . . . ); DUF1311: (0.042_14 . . . 160_ . . . ); DUF1311: (0.31_322 . . . 373_ . . . ); DUF1896: (4.4e-07_76 . . . 197_ . . . ); MADF_DNA_bdg: (0.00064_66 . . . 146_ . . . ); MADF_DNA_bdg: (0.13_332 . . . 399_ . . . ); MADF_DNA_bdg: (0.17_321 . . . 362_ . . . ); OmpH: (0.00021_51 . . . 178_ . . . ); OmpH: (0.091_315 . . . 388_ . . . ); OrfB_IS605: (5.1_92 . . . 158_ . . . ); OrfB_IS605: (6.9e-07_275 . . . 401_ . . . ); OrfB_Zn_ribbon: (7.1e-22_413 . . . 487_ . . . ); Seryl_tRNA_N: (0.00081_37 . . . 151_ . . . ); Seryl_tRNA_N: (0.11_321 . . . 382_ . . . ); Seryl_tRNA_N: (0.51_394 . . . 445_ . . . ); zf-tcix: (1.8e-05_441 . . . 476_ . . . ) |
| 225 | 102 | *Bacillus* sp. multi | Amidase: (0.00058_9 . . . 120_ . . . ); Amidase: (0.21_297 . . . 481_ . . . ); DUF2098: (0.021_22 . . . 119_ . . . ); DUF2098: (0.06_443 . . . 495_ . . . ); DUF2385: (0.00041_31 . . . 134_ . . . ); DUF2385: (0.91_290 . . . 314_ . . . ); OmpH: (0.00027_19 . . . 135_ . . . ); OmpH: (0.029_292 . . . 366_ . . . ); OmpH: (0.38_387 . . . 485_ . . . ); OrfB_IS605: (6.9e-06_247 . . . 369_ . . . ); OrfB_Zn_ribbon: (4e-22_383 . . . 452_ . . . ) |
| 226 | 103 | *Bacillus* sp. multi | Amidase: (0.0012_9 . . . 120_ . . . ); Amidase: (0.14_327 . . . 490_ . . . ); NuA4: (0.32_298 . . . 316_ . . . ); NuA4: (0.64_445 . . . 487_ . . . ); NuA4: (7e-06_64 . . . 159_ . . . ); OmpH: (0.00025_18 . . . 133_ . . . ); OmpH: (0.075_292 . . . 366_ . . . ); OmpH: (0.23_415 . . . 487_ . . . ); OrfB_IS605: (8.1e-06_247 . . . 369_ . . . ); OrfB_Zn_ribbon: (2.7e-23_383 . . . 452_ . . . ); Seryl_tRNA_N: (0.0014_20 . . . 118_ . . . ); Seryl_tRNA_N: (0.096_439 . . . 492_ . . . ); Seryl_tRNA_N: (0.15_292 . . . 346_ . . . ); Zn_Tnp_IS1595: (0.00011_406 . . . 438_ . . . ) |
| 227 | 104 | *Bacillus* sp. multi | NuA4: (0.32_298 . . . 316_ . . . ); NuA4: (0.64_445 . . . 487_ . . . ); NuA4: (1.4e-05_64 . . . 159_ . . . ); OmpH: (0.00038_18 . . . 133_ . . . ); OmpH: (0.075_292 . . . 366_ . . . ); OmpH: (0.23_415 . . . 487_ . . . ); OrfB_IS605: (8.1e-06_247 . . . 369_ . . . ); OrfB_Zn_ribbon: (2.7e-23_383 . . . 452_ . . . ); Seryl_tRNA_N: (0.00073_20 . . . 119_ . . . ); Seryl_tRNA_N: (0.096_439 . . . 492_ . . . ); Seryl_tRNA_N: (0.15_292 . . . 346_ . . . ); Zn_Tnp_IS1595: (0.00011_406 . . . 438_ . . . ) |
| 228 | 105 | *Paenibacillus thiaminolyticus* (multi) | Transposase_31: (6.9e-37_13 . . . 224_ . . . ); Yae1_N: (7.7e-05_292 . . . 319_ . . . ); Yae1_N: (9.6e-06_267 . . . 296_ . . . ) |
| 229 | 106 | *Paenibacillus thiaminolyticus* (multi) | Transposase_31: (6.7e-37_13 . . . 224_ . . . ); Yae1_N: (1.2e-06_267 . . . 307_ . . . ); Yae1_N: (5e-05_286 . . . 317_ . . . ) |
| 230 | 107 | *Paenibacillus* sp. multi | Transposase_31: (8.1e-37_13 . . . 224_ . . . ); Yae1_N: (7.8e-05_263 . . . 306_ . . . ) |
| 231 | 108 | *Paenibacillus lentimorbus* (multi) | Transposase_31: (3.8e-36_13 . . . 224_ . . . ); Yae1_N: (4.6e-06_267 . . . 291_ . . . ); Yae1_N: (6.8e-06_284 . . . 319_ . . . ) |
| 232 | 109 | *Paenibacillus thiaminolyticus* (multi) | Transposase_31: (1.2e-35_13 . . . 224_ . . . ); Yae1_N: (2.2e-05_267 . . . 295_ . . . ) |
| 233 | 110 | *Paenibacillus thiaminolyticus* (multi) | Transposase_31: (4.4e-37_13 . . . 224_ . . . ); Yae1_N: (6.2e-06_263 . . . 309_ . . . ) |
| 234 | 111 | *Paenibacillus thiaminolyticus* (multi) | Transposase_31: (6.7e-37_13 . . . 224_ . . . ); Yae1_N: (1.4e-06_288 . . . 315_ . . . ); Yae1_N: (1.8e-05_267 . . . 291_ . . . ) |
| 235 | 112 | *Paenibacillus terrae* | Transposase_31: (9.6e-37_13 . . . 224_ . . . ); Yae1_N: (1.2e-05_267 . . . 292_ . . . ); Yae1_N: (1.4e-06_290 . . . 319_ . . . ) |
| 236 | 113 | *Paenibacillus thiaminolyticus* (multi) | Transposase_31: (9.1e-37_13 . . . 224_ . . . ) |
| 237 | 114 | *Paenibacillus thiaminolyticus* (multi) | DEDD_Tnp_IS110: (2.3e-43_23 . . . 183_ . . . ); Transposase_20: (5.8e-26_290 . . . 376_ . . . ) |
| 238 | 115 | *Bacillus* sp. multi | AAA_11: (0.0012_3 . . . 147_ . . . ); AAA_11: (0.042_295 . . . 477_ . . . ); DUF2526: (0.25_443 . . . 476_ . . . ); DUF2526: (0.91_361 . . . 390_ . . . ); DUF2526: (6e-05_2 . . . 64_ . . . ); DUF4407: (0.00022_1 . . . 186_[.); HIPIP: (0.00015_387 . . . 440_ . . . ); HIPIP: (0.36_446 . . . 473_ . . . ); OrfB_Zn_ribbon: (1e-24_383 . . . 452_ . . . ); PRP1_N: (0.00042_20 . . . 160_ . . . ); PRP1_N: (0.19_292 . . . 344_ . . . ) |
| 239 | 116 | *Bacillus* sp. multi | DUF106: (0.0022_43 . . . 162_ . . . ); DUF106: (0.017_279 . . . 370_ . . . ); DUF16: (0.0066_14 . . . 145_ . . . ); DUF16: (0.011_439 . . . 473_ . . . ); DUF16: (0.017_132 . . . 178_ . . . ); DUF16: (1_203 . . . 234_ . . . ); DUF4337: (0.0016_55 . . . 140_ . . . ); DUF4337: (0.28_349 . . . 397_ . . . ); DUF632: (2.6e-05_11 . . . 149_ . . . ); NPV_P10: (0.0013_56 . . . 122_ . . . ); NPV_P10: (0.039_239 . . . 300_ . . . ); NPV_P10: (0.15_108 . . . 155_ . . . ); |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| | | | OrfB_IS605: (1.3e−05_249 . . . 370_ . . . ); OrfB_Zn_ribbon: (8.3e−24_384 . . . 453_ . . . ); zf-AD: (0.069_321 . . . 363_ . . . ); zf-AD: (0.17_289 . . . 312_ . . . ); zf-AD: (2.2e−05_386 . . . 460_ . . . ); Zn_Tnp_IS1595: (0.00027_407 . . . 439_ . . . ) |
| 240 | 117 | *Streptomyces* sp. multi | DEDD_Tnp_IS110: (0.57_212 . . . 287_ . . . ); DEDD_Tnp_IS110: (1.1_324 . . . 369_ . . . ); DEDD_Tnp_IS110: (7.9e−50_6 . . . 160_ . . . ); ROK: (0.0038_177 . . . 264_ . . . ); ROK: (0.16_79 . . . 112_ . . . ); ROK: (4.5e−05_5 . . . 55_ . . . ); Transposase_20: (0.34_76 . . . 121_ . . . ); Transposase_20: (1.4e−23_265 . . . 352_ . . . ) |
| 241 | 118 | *Bacillus* sp. multi | Phage_integrase: (0.41_86 . . . 140_ . . . ); Phage_integrase: (1.2e−34_172 . . . 353_ . . . ); Phage_int_SAM_1: (0.75_143 . . . 200_ . . . ); Phage_int_SAM_1: (1.5e−11_27 . . . 122_ . . . ); Phage_int_SAM_4: (0.14_88 . . . 160_ . . . ); Phage_int_SAM_4: (1.5e−07_28 . . . 122_ . . . ) |
| 242 | 119 | *Bacillus* sp. multi | 4HB_MCP_1: (0.017_111 . . . 207_ . . . ); 4HB_MCP_1: (3.2e−06_492 . . . 559_ . . . ); DDE_Tnp_Tn3: (9.8e−154_597 . . . 983_ . . . ); DUF4158: (3e−34_1 . . . 167_[.); DUF4337: (0.00016_282 . . . 360_ . . . ); DUF4337: (0.017_181 . . . 288_ . . . ); DUF4337: (0.79_378 . . . 432_ . . . ); TPR_21: (1.4e−06_154 . . . 283_ . . . ); UPF0054: (0.28_270 . . . 350_ . . . ); UPF0054: (4e−06_497 . . . 600_ . . . ) |
| 243 | 120 | *Bacillus* sp. multi | HypA: (0.00065_358 . . . 462_ . . . ); OrfB_IS605: (1.9e−06_259 . . . 384_ . . . ); OrfB_IS605: (2.1_54 . . . 146_ . . . ); OrfB_Zn_ribbon: (6.9e−24_397 . . . 466_ . . . ) |
| 244 | 121 | *Bacillus* sp. multi | HypA: (0.00061_356 . . . 462_ . . . ); OrfB_IS605: (1.2_52 . . . 146_ . . . ); OrfB_IS605: (2.8e−07_259 . . . 384_ . . . ); OrfB_Zn_ribbon: (6.9e−24_397 . . . 466_ . . . ) |
| 245 | 122 | *Bacillus* sp. multi | Bap31: (0.00011_40 . . . 129_ . . . ); Bap31: (0.054_303 . . . 372_ . . . ); Coat_F: (0.00032_119 . . . 165_ . . . ); Coat_F: (0.0075_55 . . . 79_ . . . ); Coat_F: (0.13_347 . . . 362_ . . . ); Coat_F: (0.23_92 . . . 121_ . . . ); DUF1548: (0.025_361 . . . 427_ . . . ); DUF1548: (0.38_337 . . . 372_ . . . ); DUF1548: (4.5e−05_27 . . . 120_ . . . ); HypA: (0.00023_349 . . . 463_ . . . ); IncA: (0.00029_44 . . . 154_ . . . ); IncA: (0.08_303 . . . 398_ . . . ); OrfB_IS605: (8.1e−07_253 . . . 384_ . . . ); OrfB_Zn_ribbon: (3.9e−26_397 . . . 466_ . . . ); TF_Zn_Ribbon: (2.6e−05_425 . . . 462_ . . . ) |
| 246 | 123 | *Lysinibacillus* sp. multi | ERp29: (0.079_480 . . . 542_ . . . ); ERp29: (0.15_552 . . . 603_ . . . ); ERp29: (1.5e−05_364 . . . 442_ . . . ); HTH_24: (6.9e−06_385 . . . 410_ . . . ); HTH_29: (0.55_242 . . . 265_ . . . ); HTH_29: (2.1e−05_377 . . . 411_ . . . ); HTH_38: (0.39_420 . . . 434_ . . . ); HTH_38: (0.57_10 . . . 25_ . . . ); HTH_38: (7.4e−07_377 . . . 411_ . . . ); HTH_Tnp_ISL3: (4e−05_379 . . . 412_ . . . ); Sigma70_r4: (2.5e−05_380 . . . 413_ . . . ); TniQ: (0.12_355 . . . 448_ . . . ); TniQ: (1.3e−16_3 . . . 155_ . . . ); TnsD: (1.1e−61_194 . . . 551_ . . . ) |
| 275 | 604 | *Bacillus* sp. multi | Caskin-Pro-rich: (1.2e−05_246 . . . 329_ . . . ); DDE_Tnp_1: (6.7e−52_118 . . . 385_ . . . ); DUF2489: (0.17_281 . . . 312_ . . . ); DUF2489: (2.5e−06_382 . . . 469_ . . . ) |
| 276 | 605 | *Streptomyces* sp. multi | DDE_Tnp_1: (0.085_63 . . . 101_ . . . ); DDE_Tnp_1: (1.4e−15_102 . . . 260_ . . . ); DDE_Tnp_1_2: (3.2e−16_182 . . . 262_ . . . ); DUF4096: (2.2e−31_11 . . . 92_ . . . ) |
| 277 | 606 | *Bacillus* sp. multi | C1_1: (0.0028_362 . . . 404_ . . . ); C1_2: (0.001_355 . . . 400_ . . . ); C1_3: (0.13_371 . . . 400_ . . . ); C1_3: (2.8_363 . . . 380_ . . . ); CEBP_ZZ: (0.052_358 . . . 409_ . . . ); CEBP_ZZ: (1.1_283 . . . 324_ . . . ); OrfB_IS605: (0.00069_204 . . . 330_ . . . ); OrfB_Zn_ribbon: (5.3e−24_341 . . . 410_ . . . ); PUF: (0.51_29 . . . 49_ . . . ); PUF: (3.1e−05_300 . . . 327_ . . . ); PUF: (6.6_414 . . . 431_ . . . ); Tnp_zf-ribbon_2: (0.0034_369 . . . 399_ . . . ); Tnp_zf-ribbon_2: (1.7_344 . . . 377_ . . . ); Tnp_zf-ribbon_2: (2.4_292 . . . 320_ . . . ) |
| 278 | 612 | *Bacillus* sp. multi | C1_1: (0.0029_372 . . . 414_ . . . ); C1_2: (0.0011_365 . . . 410_ . . . ); C1_3: (0.13_381 . . . 410_ . . . ); C1_3: (2.8_373 . . . 390_ . . . ); CEBP_ZZ: (0.053_368 . . . 419_ . . . ); CEBP_ZZ: (1.1_293 . . . 334_ . . . ); OrfB_IS605: (0.00072_214 . . . 340_ . . . ); OrfB_Zn_ribbon: (5.4e−24_351 . . . 420_ . . . ); PUF: (0.53_39 . . . 59_ . . . ); PUF: (3.1e−05_310 . . . 337_ . . . ); PUF: (6.7_424 . . . 441_ . . . ); Tnp_zf-ribbon_2: (0.0035_379 . . . 409_ . . . ); Tnp_zf-ribbon_2: (2.1_354 . . . 386_ . . . ); Tnp_zf-ribbon_2: (2.4_302 . . . 330_ . . . ) |
| 279 | 613 | *Bacillus* sp. multi | C1_1: (0.00059_189 . . . 232_ . . . ); C1_2: (0.00024_181 . . . 227_ . . . ); C1_3: (0.012_196 . . . 227_ . . . ); C1_3: (3.6_190 . . . 205_ . . . ); CEBP_ZZ: (0.027_185 . . . 236_ . . . ); CEBP_ZZ: (0.54_109 . . . 152_ . . . ); HypA: (0.00043_131 . . . 241_ . . . ); OrfB_IS605: (0.00053_31 . . . 157_ . . . ); OrfB_Zn_ribbon: (7.1e−26_168 . . . 237_ . . . ); PUF: (1.9e−05_127 . . . 153_ . . . ); Salp15: (0.092_93 . . . 182_ . . . ); Salp15: (0.15_172 . . . 246_ . . . ); Tnp_zf-ribbon_2: (0.00019_196 . . . 226_ . . . ); Tnp_zf-ribbon_2: (0.6_171 . . . 204_ . . . ); Tnp_zf-ribbon_2: (1.1_117 . . . 147_ . . . ) |

TABLE 5-continued

Pfam annotation of the transposases (SEQ ID NOs: 124-246, 275-287).

| PRT SEQ ID NO | DNA SEQ ID NO | Organism | Pfam domainID: (domain E-value_from . . . to_endpoint coordinate symbols) Pfam domains are separated by ";" |
|---|---|---|---|
| 280 | 614 | Bacillus sp. multi | C1_1: (0.0018_369 . . . 411_ . . . ); C1_2: (0.00054_362 . . . 407_ . . . ); C1_3: (0.021_376 . . . 407_ . . . ); C1_3: (5.8_371 . . . 386_ . . . ); CEBP_ZZ: (0.053_365 . . . 416_ . . . ); CEBP_ZZ: (1.1_290 . . . 331_ . . . ); HypA: (0.0012_316 . . . 421_ . . . ); OrfB_IS605: (0.00071_211 . . . 337_ . . . ); OrfB_Zn_ribbon: (3.4e-25_348 . . . 417_ . . . ); PUF: (0.52_36 . . . 56_ . . . ); PUF: (3.1e-05_307 . . . 334_ . . . ); PUF: (6.7_421 . . . 438_ . . . ); Tnp_zf-ribbon_2: (2.4_299 . . . 327_ . . . ); Tnp_zf-ribbon_2: (3.6e-05_351 . . . 406_ . . . ) |
| 281 | 621 | Bacillus sp. multi | C1_1: (0.00023_18 . . . 63_ . . . ); C1_2: (0.00066_14 . . . 57_ . . . ); C1_3: (0.0015_35 . . . 57_ . . . ); C1_3: (0.19_17 . . . 37_ . . . ); DUF2387: (0.003_7 . . . 69_ . . . ); DUF2387: (0.02_25 . . . 100_.]); HypA: (0.00028_3 . . . 71_ . . . ); OrfB_Zn_ribbon: (2.2e-25_1 . . . 67_[.); Tnp_zf-ribbon_2: (0.0064_26 . . . 56_ . . . ); Tnp_zf-ribbon_2: (0.11_1 . . . 35_[.); zf-C2H2_11: (0.0031_23 . . . 34_ . . . ); zf-C2H2_11: (0.0058_41 . . . 53_ . . . ); zf-Mss51: (0.024_4 . . . 63_ . . . ); zf-Mss51: (5_78 . . . 100_.]) |
| 282 | 622 | Bacillus sp. multi | C1_2: (0.0011_355 . . . 400_ . . . ); C1_3: (0.0091_369 . . . 400_ . . . ); DCAF15_WD40: (0.52_139 . . . 217_ . . . ); DCAF15_WD40: (1.6e-06_338 . . . 422_ . . . ); OrfB_IS605: (0.00064_204 . . . 330_ . . . ); OrfB_Zn_ribbon: (1.4e-24_341 . . . 410_ . . . ); PUF: (0.74_29 . . . 49_ . . . ); PUF: (3.1e-05_300 . . . 327_ . . . ); Tnp_zf-ribbon_2: (0.0091_369 . . . 399_ . . . ); Tnp_zf-ribbon_2: (0.79_344 . . . 378_ . . . ); Tnp_zf-ribbon_2: (2.4_292 . . . 320_ . . . ) |
| 283 | 623 | Bacillus sp. multi | C1_1: (0.0018_369 . . . 411_ . . . ); C1_2: (0.00054_362 . . . 407_ . . . ); C1_3: (0.021_376 . . . 407_ . . . ); C1_3: (5.8_371 . . . 386_ . . . ); CEBP_ZZ: (0.053_365 . . . 416_ . . . ); CEBP_ZZ: (0.085_290 . . . 332_ . . . ); HypA: (0.00085_313 . . . 421_ . . . ); OrfB_IS605: (0.0014_215 . . . 337_ . . . );. OrfB_Zn_ribbon: (34e-25_348 . . . 417_ . . . ); PUF: (0.52_36 . . . 56_ . . . ); PUF: (1.8e-05_307 . . . 334_ . . . ); PUF: (6.7_421 . . . 438_ . . . ); Tnp_zf-ribbon_2: (2.5_299 . . . 327_ . . . ); Tnp_zf-ribbon_2: (3.6e-05_351 . . . 406_ . . . ) |
| 284 | 624 | Paenibacillus thiaminolyticus (multi) | FoP_duplication: (2.2e-06_124 . . . 181_ . . . ); Transposase_31: (2.4e-09_1 . . . 88_[.); Uso1_p115_head: (1.1e-05_10 . . . 132_ . . . ); Yae1_N: (9.5e-06_127 . . . 168_ . . .) |
| 285 | 625 | Paenibacillus lentimorbus (multi) | Transposase_31: (5.6e-20_1 . . . 129_[.); Yae1_N: (3.1e-05_172 . . . 198_ . . . ) |
| 286 | 626 | Paenibacillus thiaminolyticus (multi) | Transposase_31: (1.7e-17_2 . . . 113_ . . . ); Uso1_p115_head: (8.4e-06_30 . . . 159_ . . . ) |
| 287 | 627 | Stenotrophomonas sp. multi | Y1_Tnp: (2.3e-16_14 . . . 127_ . . . ) |

Protein Clustering

The CRISPR-associated transposase protein sequences (SEQ ID NOs: 124-246, 275-287) were aligned using the USEARCH tool at 50% sequence identity cutoff (Edgar, 2010) and 13 sequence alignment clusters were identified, as shown in Table 6. The majority of the identified transposases belong to cluster 1, and the Pfam annotation in Table 5 indicates that the cluster 1 member proteins comprise the OrfB_IS605, OrfB_Zn_ribbon, and Puf domains.

TABLE 6

Protein sequence alignment clusters identified for SEQ ID NOs: 124-246, 275-287.

| Cluster ID | Protein Sequences (SEQ ID NO:) | Unique protein count |
|---|---|---|
| 1 | 124-220, 277-283 | 104 |
| 2 | 221-223 | 3 |
| 3 | 224-227, 238-239 | 6 |
| 4 | 228-236, 284-286 | 12 |
| 5 | 276 | 1 |
| 6 | 237 | 1 |
| 7 | 287 | 1 |
| 8 | 240 | 1 |
| 9 | 241 | 1 |
| 10 | 242 | 1 |
| 11 | 243-245 | 3 |
| 12 | 246 | 1 |
| 13 | 275 | 1 |

Polynucleotide Sequences Encoding Transposases

For the transposase proteins SEQ ID NOs: 124-246, 275-287, the corresponding polynucleotide coding regions were also identified, see Table 7. A single protein sequence may be encoded by one or more different nucleotide sequences because the sequences were identified from different bacterial species or strains. For example, for protein SEQ ID NO: 127, the corresponding DNA sequences are SEQ ID NO: 4, 288, 289, 290, and 291.

TABLE 7

Protein sequences SEQ ID NOs: 124-246, 275-287 and the corresponding DNA sequence of the respective coding region.

| PRT (SEQ ID NO:) | DNA (SEQ ID NO:) |
|---|---|
| 124 | 1 |
| 125 | 2 |
| 126 | 3 |
| 127 | 4 |
| 127 | 288 |
| 127 | 289 |
| 127 | 290 |
| 127 | 291 |
| 128 | 5 |
| 129 | 6 |
| 129 | 292 |
| 129 | 293 |
| 129 | 294 |
| 130 | 7 |
| 130 | 295 |
| 130 | 296 |
| 130 | 297 |
| 130 | 298 |
| 131 | 8 |
| 132 | 9 |
| 132 | 299 |
| 132 | 300 |
| 132 | 301 |
| 132 | 302 |
| 133 | 10 |
| 134 | 11 |
| 134 | 303 |
| 135 | 12 |
| 136 | 13 |
| 136 | 304 |
| 136 | 305 |
| 136 | 306 |
| 136 | 307 |
| 136 | 308 |
| 136 | 309 |
| 136 | 310 |
| 136 | 311 |
| 136 | 312 |
| 136 | 313 |
| 136 | 314 |
| 136 | 315 |
| 136 | 316 |
| 136 | 317 |
| 136 | 318 |
| 136 | 319 |
| 136 | 320 |
| 136 | 321 |
| 136 | 322 |
| 136 | 323 |
| 137 | 14 |
| 138 | 15 |
| 139 | 16 |
| 140 | 17 |
| 140 | 324 |
| 140 | 325 |
| 140 | 326 |
| 140 | 327 |
| 140 | 328 |
| 141 | 18 |
| 141 | 329 |
| 141 | 330 |
| 142 | 19 |
| 143 | 20 |
| 143 | 331 |
| 143 | 332 |
| 143 | 333 |
| 143 | 334 |
| 144 | 21 |
| 144 | 335 |
| 144 | 336 |
| 144 | 337 |
| 144 | 338 |
| 144 | 339 |
| 144 | 340 |
| 144 | 341 |
| 144 | 342 |
| 144 | 343 |
| 144 | 344 |
| 144 | 345 |
| 144 | 346 |
| 144 | 347 |
| 144 | 348 |
| 144 | 349 |
| 144 | 350 |
| 144 | 351 |
| 144 | 352 |
| 144 | 353 |
| 144 | 354 |
| 144 | 355 |
| 144 | 356 |
| 144 | 357 |
| 144 | 358 |
| 144 | 359 |
| 144 | 360 |
| 144 | 361 |
| 144 | 362 |
| 144 | 363 |
| 144 | 364 |
| 144 | 365 |
| 144 | 366 |
| 144 | 367 |
| 144 | 368 |
| 144 | 369 |
| 144 | 370 |
| 144 | 371 |
| 144 | 372 |
| 144 | 373 |
| 144 | 374 |
| 144 | 375 |
| 144 | 376 |
| 144 | 377 |
| 144 | 378 |
| 144 | 379 |
| 144 | 380 |
| 144 | 381 |
| 144 | 382 |
| 144 | 383 |
| 144 | 384 |
| 144 | 385 |
| 144 | 386 |
| 144 | 387 |
| 144 | 388 |
| 144 | 389 |
| 144 | 390 |
| 144 | 391 |
| 144 | 392 |
| 144 | 393 |
| 144 | 394 |
| 144 | 395 |
| 144 | 396 |
| 144 | 397 |
| 144 | 398 |
| 144 | 399 |
| 144 | 400 |
| 144 | 401 |
| 144 | 402 |
| 144 | 403 |
| 144 | 404 |
| 144 | 405 |
| 144 | 406 |
| 144 | 407 |
| 144 | 408 |
| 144 | 409 |
| 144 | 410 |

TABLE 7-continued

Protein sequences SEQ ID NOs: 124-246, 275-287 and the corresponding DNA sequence of the respective coding region.

| PRT (SEQ ID NO:) | DNA (SEQ ID NO:) |
|---|---|
| 144 | 411 |
| 144 | 412 |
| 144 | 413 |
| 144 | 414 |
| 144 | 415 |
| 144 | 416 |
| 144 | 417 |
| 144 | 418 |
| 144 | 419 |
| 144 | 420 |
| 144 | 421 |
| 144 | 422 |
| 144 | 423 |
| 144 | 424 |
| 144 | 425 |
| 144 | 426 |
| 144 | 427 |
| 144 | 428 |
| 144 | 429 |
| 144 | 430 |
| 144 | 431 |
| 144 | 432 |
| 144 | 433 |
| 144 | 434 |
| 144 | 435 |
| 144 | 436 |
| 144 | 437 |
| 144 | 438 |
| 144 | 439 |
| 144 | 440 |
| 144 | 441 |
| 144 | 442 |
| 144 | 443 |
| 144 | 444 |
| 144 | 445 |
| 144 | 446 |
| 144 | 447 |
| 144 | 448 |
| 145 | 22 |
| 146 | 23 |
| 147 | 24 |
| 148 | 25 |
| 149 | 26 |
| 149 | 449 |
| 150 | 27 |
| 151 | 28 |
| 151 | 450 |
| 151 | 451 |
| 152 | 29 |
| 153 | 30 |
| 154 | 31 |
| 154 | 452 |
| 155 | 32 |
| 156 | 33 |
| 156 | 453 |
| 157 | 34 |
| 157 | 454 |
| 158 | 35 |
| 159 | 36 |
| 160 | 37 |
| 160 | 455 |
| 160 | 456 |
| 160 | 457 |
| 160 | 458 |
| 160 | 459 |
| 161 | 38 |
| 162 | 39 |
| 163 | 40 |
| 164 | 41 |
| 165 | 42 |
| 165 | 460 |
| 166 | 43 |
| 167 | 44 |
| 168 | 45 |
| 169 | 46 |
| 170 | 47 |
| 171 | 48 |
| 171 | 461 |
| 171 | 462 |
| 171 | 463 |
| 171 | 464 |
| 171 | 465 |
| 171 | 466 |
| 171 | 467 |
| 172 | 49 |
| 173 | 50 |
| 173 | 468 |
| 174 | 51 |
| 174 | 469 |
| 174 | 470 |
| 175 | 52 |
| 175 | 471 |
| 175 | 472 |
| 175 | 473 |
| 176 | 53 |
| 176 | 474 |
| 176 | 475 |
| 176 | 476 |
| 176 | 477 |
| 176 | 478 |
| 176 | 479 |
| 176 | 480 |
| 176 | 481 |
| 177 | 54 |
| 178 | 55 |
| 178 | 482 |
| 178 | 483 |
| 179 | 56 |
| 179 | 484 |
| 179 | 485 |
| 179 | 486 |
| 179 | 487 |
| 179 | 488 |
| 179 | 489 |
| 179 | 490 |
| 179 | 491 |
| 179 | 492 |
| 179 | 493 |
| 179 | 494 |
| 179 | 495 |
| 179 | 496 |
| 179 | 497 |
| 179 | 498 |
| 179 | 499 |
| 179 | 500 |
| 179 | 501 |
| 179 | 502 |
| 179 | 503 |
| 179 | 504 |
| 180 | 57 |
| 181 | 58 |
| 182 | 59 |
| 183 | 60 |
| 184 | 61 |
| 185 | 62 |
| 186 | 63 |
| 186 | 505 |
| 187 | 64 |
| 188 | 65 |
| 188 | 506 |
| 188 | 507 |
| 188 | 508 |
| 188 | 509 |
| 188 | 510 |

TABLE 7-continued

Protein sequences SEQ ID NOs: 124-246, 275-287 and the corresponding DNA sequence of the respective coding region.

| PRT (SEQ ID NO:) | DNA (SEQ ID NO:) |
|---|---|
| 188 | 511 |
| 188 | 512 |
| 188 | 513 |
| 188 | 514 |
| 188 | 515 |
| 188 | 516 |
| 188 | 517 |
| 189 | 66 |
| 190 | 67 |
| 191 | 68 |
| 192 | 69 |
| 192 | 518 |
| 193 | 70 |
| 193 | 519 |
| 193 | 520 |
| 193 | 521 |
| 193 | 522 |
| 194 | 71 |
| 194 | 523 |
| 194 | 524 |
| 194 | 525 |
| 194 | 526 |
| 194 | 527 |
| 194 | 528 |
| 194 | 529 |
| 194 | 530 |
| 194 | 531 |
| 195 | 72 |
| 196 | 73 |
| 197 | 74 |
| 197 | 532 |
| 197 | 533 |
| 197 | 534 |
| 197 | 535 |
| 197 | 536 |
| 197 | 537 |
| 197 | 538 |
| 197 | 539 |
| 197 | 540 |
| 197 | 541 |
| 197 | 542 |
| 198 | 75 |
| 198 | 543 |
| 198 | 544 |
| 198 | 545 |
| 198 | 546 |
| 198 | 547 |
| 198 | 548 |
| 198 | 549 |
| 198 | 550 |
| 198 | 551 |
| 198 | 552 |
| 198 | 553 |
| 198 | 554 |
| 198 | 555 |
| 198 | 556 |
| 198 | 557 |
| 198 | 558 |
| 199 | 76 |
| 200 | 77 |
| 201 | 78 |
| 201 | 559 |
| 201 | 560 |
| 201 | 561 |
| 202 | 79 |
| 203 | 80 |
| 204 | 81 |
| 205 | 82 |
| 205 | 562 |
| 206 | 83 |
| 207 | 84 |
| 208 | 85 |
| 209 | 86 |
| 210 | 87 |
| 210 | 563 |
| 210 | 564 |
| 210 | 565 |
| 210 | 566 |
| 210 | 567 |
| 210 | 568 |
| 210 | 569 |
| 210 | 570 |
| 210 | 571 |
| 210 | 572 |
| 210 | 573 |
| 210 | 574 |
| 210 | 575 |
| 210 | 576 |
| 210 | 577 |
| 210 | 578 |
| 210 | 579 |
| 210 | 580 |
| 210 | 581 |
| 210 | 582 |
| 210 | 583 |
| 211 | 88 |
| 211 | 584 |
| 212 | 89 |
| 213 | 90 |
| 213 | 585 |
| 213 | 586 |
| 213 | 587 |
| 213 | 588 |
| 213 | 589 |
| 213 | 590 |
| 214 | 91 |
| 215 | 92 |
| 216 | 93 |
| 216 | 591 |
| 216 | 592 |
| 216 | 593 |
| 217 | 94 |
| 218 | 95 |
| 219 | 96 |
| 220 | 97 |
| 220 | 594 |
| 221 | 98 |
| 222 | 99 |
| 223 | 100 |
| 223 | 595 |
| 223 | 596 |
| 223 | 597 |
| 224 | 101 |
| 225 | 102 |
| 225 | 598 |
| 226 | 103 |
| 227 | 104 |
| 228 | 105 |
| 229 | 106 |
| 230 | 107 |
| 231 | 108 |
| 232 | 109 |
| 232 | 599 |
| 232 | 600 |
| 232 | 601 |
| 233 | 110 |
| 234 | 111 |
| 235 | 112 |
| 236 | 113 |
| 237 | 114 |
| 238 | 115 |
| 238 | 602 |
| 239 | 116 |
| 240 | 117 |

TABLE 7-continued

Protein sequences SEQ ID NOs: 124-246, 275-287 and the corresponding DNA sequence of the respective coding region.

| PRT (SEQ ID NO:) | DNA (SEQ ID NO:) |
|---|---|
| 241 | 118 |
| 241 | 603 |
| 242 | 119 |
| 243 | 120 |
| 244 | 121 |
| 245 | 122 |
| 246 | 123 |
| 275 | 604 |
| 276 | 605 |
| 277 | 606 |
| 277 | 607 |
| 277 | 608 |
| 277 | 609 |
| 277 | 610 |
| 277 | 611 |
| 278 | 612 |
| 279 | 613 |
| 280 | 614 |
| 281 | 615 |
| 281 | 616 |
| 281 | 617 |
| 281 | 618 |
| 281 | 619 |
| 281 | 620 |
| 281 | 621 |
| 282 | 622 |
| 283 | 623 |
| 284 | 624 |
| 285 | 625 |
| 286 | 626 |
| 287 | 627 |

CRISPR Sequences Associated with the Transposases

CRISPR sequences associated with the transposes were identified, see Table 8. Each CRISPR sequence includes 50 nucleotides of genomic sequence extended from both the upstream 5' end and the downstream 3' end of the CRISPR region (except for SEQ ID NO: 816, which does not contain the extra 50 nucleotides at the 5' end). For some transposases, multiple associated CRISPR sequences were identified, for example, the polynucleotide sequence (SEQ ID NO: 559 encoding protein sequence of SEQ ID NO: 201) is associated with two CRISPR sequences—SEQ ID NOs: 987 and 988. Additionally, a single CRISPR sequence may be associated with two or more transposase protein coding regions, for example, the polynucleotide sequences SEQ ID NO: 98 and SEQ ID NO: 16 are associated with the same CRISPR sequence of SEQ ID NO: 679. This is also observed for the polynucleotide pairs of SEQ ID NOs: 99 and 9 are both associated with CRISPR sequence SEQ ID NO: 647, SEQ ID NOs: 100 and 301 are both associated with CRISPR sequence SEQ ID NO: 647, SEQ ID NOs: 595 and 11 are both associated with CRISPR sequence SEQ ID NO: 653, SEQ ID NOs: 596 and 302 are both associated with CRISPR sequence SEQ ID NO: 651, and SEQ ID NOs: 597 and 303 are both associated with CRISPR sequence SEQ ID NO: 654.

TABLE 8

CRISPR sequences associated with transposases (SEQ ID NOs: 124-246, 275-287).

| PRT (SEQ ID NO:) | DNA (SEQ ID NO:) | Associated CRISPR (SEQ ID NO:) |
|---|---|---|
| 124 | 1 | 628 |
| 125 | 2 | 629 |
| 126 | 3 | 630 |
| 127 | 4 | 631 |
| 127 | 288 | 632 |
| 127 | 289 | 633 |
| 127 | 290 | 634 |
| 127 | 291 | 635 |
| 128 | 5 | 636 |
| 129 | 6 | 637 |
| 129 | 292 | 638 |
| 129 | 293 | 639 |
| 129 | 294 | 640 |
| 130 | 7 | 641 |
| 130 | 295 | 642 |
| 130 | 296 | 643 |
| 130 | 297 | 644 |
| 130 | 298 | 645 |
| 131 | 8 | 646 |
| 132 | 9 | 647 |
| 132 | 299 | 648 |
| 132 | 300 | 649 |
| 132 | 301 | 650 |
| 132 | 302 | 651 |
| 133 | 10 | 652 |
| 134 | 11 | 653 |
| 134 | 303 | 654 |
| 135 | 12 | 655 |
| 136 | 13 | 656 |
| 136 | 305 | 657 |
| 136 | 306 | 658 |
| 136 | 307 | 659 |
| 136 | 308 | 660 |
| 136 | 309 | 661 |
| 136 | 304 | 662 |
| 136 | 310 | 663 |
| 136 | 311 | 664 |
| 136 | 312 | 665 |
| 136 | 313 | 666 |
| 136 | 314 | 667 |
| 136 | 315 | 668 |
| 136 | 316 | 669 |
| 136 | 317 | 670 |
| 136 | 318 | 671 |
| 136 | 319 | 672 |
| 136 | 320 | 673 |
| 136 | 321 | 674 |
| 136 | 322 | 675 |
| 136 | 323 | 676 |
| 137 | 14 | 677 |
| 138 | 15 | 678 |
| 139 | 16 | 679 |
| 140 | 17 | 680 |
| 140 | 324 | 681 |
| 140 | 325 | 682 |
| 140 | 326 | 683 |
| 140 | 327 | 684 |
| 140 | 328 | 685 |
| 141 | 18 | 686 |
| 141 | 329 | 687 |
| 141 | 330 | 688 |
| 142 | 19 | 689 |
| 143 | 20 | 690 |
| 143 | 331 | 691 |
| 143 | 332 | 692 |
| 143 | 333 | 693 |
| 143 | 334 | 694 |
| 144 | 21 | 695 |
| 144 | 335 | 696 |
| 144 | 336 | 697 |
| 144 | 337 | 698 |
| 144 | 338 | 699 |
| 144 | 339 | 700 |

TABLE 8-continued

CRISPR sequences associated with transposases
(SEQ ID NOs: 124-246, 275-287).

| PRT (SEQ ID NO:) | DNA (SEQ ID NO:) | Associated CRISPR (SEQ ID NO:) |
|---|---|---|
| 144 | 340 | 701 |
| 144 | 341 | 702 |
| 144 | 342 | 703 |
| 144 | 343 | 704 |
| 144 | 344 | 705 |
| 144 | 345 | 706 |
| 144 | 346 | 707 |
| 144 | 347 | 708 |
| 144 | 348 | 709 |
| 144 | 349 | 710 |
| 144 | 350 | 711 |
| 144 | 351 | 712 |
| 144 | 352 | 713 |
| 144 | 353 | 714 |
| 144 | 354 | 715 |
| 144 | 355 | 716 |
| 144 | 356 | 717 |
| 144 | 357 | 718 |
| 144 | 358 | 719 |
| 144 | 359 | 720 |
| 144 | 360 | 721 |
| 144 | 361 | 722 |
| 144 | 362 | 723 |
| 144 | 363 | 724 |
| 144 | 364 | 725 |
| 144 | 365 | 726 |
| 144 | 366 | 727 |
| 144 | 367 | 728 |
| 144 | 368 | 729 |
| 144 | 369 | 730 |
| 144 | 370 | 731 |
| 144 | 371 | 732 |
| 144 | 372 | 733 |
| 144 | 373 | 734 |
| 144 | 374 | 735 |
| 144 | 375 | 736 |
| 144 | 376 | 737 |
| 144 | 377 | 738 |
| 144 | 378 | 739 |
| 144 | 379 | 740 |
| 144 | 380 | 741 |
| 144 | 381 | 742 |
| 144 | 382 | 743 |
| 144 | 383 | 744 |
| 144 | 384 | 745 |
| 144 | 385 | 746 |
| 144 | 386 | 747 |
| 144 | 387 | 748 |
| 144 | 388 | 749 |
| 144 | 389 | 750 |
| 144 | 390 | 751 |
| 144 | 391 | 752 |
| 144 | 392 | 753 |
| 144 | 393 | 754 |
| 144 | 394 | 755 |
| 144 | 395 | 756 |
| 144 | 396 | 757 |
| 144 | 397 | 758 |
| 144 | 398 | 759 |
| 144 | 399 | 760 |
| 144 | 400 | 761 |
| 144 | 401 | 762 |
| 144 | 402 | 763 |
| 144 | 403 | 764 |
| 144 | 404 | 765 |
| 144 | 405 | 766 |
| 144 | 406 | 767 |
| 144 | 407 | 768 |
| 144 | 408 | 769 |
| 144 | 409 | 770 |
| 144 | 410 | 771 |
| 144 | 411 | 772 |
| 144 | 412 | 773 |
| 144 | 413 | 774 |
| 144 | 414 | 775 |
| 144 | 415 | 776 |
| 144 | 416 | 777 |
| 144 | 417 | 778 |
| 144 | 418 | 779 |
| 144 | 419 | 780 |
| 144 | 420 | 781 |
| 144 | 421 | 782 |
| 144 | 422 | 783 |
| 144 | 423 | 784 |
| 144 | 424 | 785 |
| 144 | 425 | 786 |
| 144 | 426 | 787 |
| 144 | 427 | 788 |
| 144 | 428 | 789 |
| 144 | 429 | 790 |
| 144 | 430 | 791 |
| 144 | 431 | 792 |
| 144 | 432 | 793 |
| 144 | 433 | 794 |
| 144 | 434 | 795 |
| 144 | 435 | 796 |
| 144 | 436 | 797 |
| 144 | 437 | 798 |
| 144 | 438 | 799 |
| 144 | 439 | 800 |
| 144 | 440 | 801 |
| 144 | 441 | 802 |
| 144 | 442 | 803 |
| 144 | 443 | 804 |
| 144 | 444 | 805 |
| 144 | 445 | 806 |
| 144 | 446 | 807 |
| 144 | 447 | 808 |
| 144 | 448 | 809 |
| 145 | 22 | 810 |
| 146 | 23 | 811 |
| 147 | 24 | 812 |
| 148 | 25 | 813 |
| 149 | 26 | 814 |
| 149 | 449 | 815 |
| 150 | 27 | 816 |
| 151 | 28 | 817 |
| 151 | 450 | 818 |
| 151 | 451 | 819 |
| 152 | 29 | 820 |
| 153 | 30 | 821 |
| 154 | 31 | 822 |
| 154 | 452 | 823 |
| 155 | 32 | 824 |
| 156 | 33 | 825 |
| 156 | 453 | 826 |
| 157 | 34 | 827 |
| 157 | 454 | 828 |
| 158 | 35 | 829 |
| 159 | 36 | 830 |
| 160 | 37 | 831 |
| 160 | 455 | 832 |
| 160 | 456 | 833 |
| 160 | 457 | 834 |
| 160 | 458 | 835 |
| 160 | 459 | 836 |
| 161 | 38 | 837 |
| 162 | 39 | 838 |
| 163 | 40 | 839 |
| 164 | 41 | 840 |
| 165 | 42 | 841 |
| 165 | 460 | 842 |
| 166 | 43 | 843 |
| 167 | 44 | 844 |
| 168 | 45 | 845 |
| 169 | 46 | 846 |

TABLE 8-continued

CRISPR sequences associated with transposases
(SEQ ID NOs: 124-246, 275-287).

| PRT (SEQ ID NO:) | DNA (SEQ ID NO:) | Associated CRISPR (SEQ ID NO:) |
|---|---|---|
| 170 | 47 | 847 |
| 171 | 48 | 848 |
| 171 | 461 | 849 |
| 171 | 462 | 850 |
| 171 | 463 | 851 |
| 171 | 464 | 852 |
| 171 | 465 | 853 |
| 171 | 466 | 854 |
| 171 | 467 | 855 |
| 172 | 49 | 856 |
| 173 | 50 | 857 |
| 173 | 468 | 858 |
| 174 | 51 | 859 |
| 174 | 469 | 860 |
| 174 | 470 | 861 |
| 175 | 52 | 862 |
| 175 | 471 | 863 |
| 175 | 472 | 864 |
| 175 | 473 | 865 |
| 176 | 53 | 866 |
| 176 | 474 | 867 |
| 176 | 475 | 868 |
| 176 | 476 | 869 |
| 176 | 477 | 870 |
| 176 | 478 | 871 |
| 176 | 479 | 872 |
| 176 | 480 | 873 |
| 176 | 481 | 874 |
| 177 | 54 | 875 |
| 178 | 55 | 876 |
| 178 | 482 | 877 |
| 178 | 483 | 878 |
| 179 | 56 | 879 |
| 179 | 484 | 880 |
| 179 | 485 | 881 |
| 179 | 486 | 882 |
| 179 | 487 | 883 |
| 179 | 488 | 884 |
| 179 | 489 | 885 |
| 179 | 490 | 886 |
| 179 | 491 | 887 |
| 179 | 492 | 888 |
| 179 | 493 | 889 |
| 179 | 494 | 890 |
| 179 | 495 | 891 |
| 179 | 496 | 892 |
| 179 | 497 | 893 |
| 179 | 498 | 894 |
| 179 | 499 | 895 |
| 179 | 500 | 896 |
| 179 | 501 | 897 |
| 179 | 502 | 898 |
| 179 | 503 | 899 |
| 179 | 504 | 900 |
| 180 | 57 | 901 |
| 181 | 58 | 902 |
| 182 | 59 | 903 |
| 183 | 60 | 904 |
| 184 | 61 | 905 |
| 185 | 62 | 906 |
| 186 | 63 | 907 |
| 186 | 505 | 908 |
| 187 | 64 | 909 |
| 188 | 65 | 910 |
| 188 | 506 | 911 |
| 188 | 507 | 912 |
| 188 | 508 | 913 |
| 188 | 509 | 914 |
| 188 | 510 | 915 |
| 188 | 511 | 916 |
| 188 | 512 | 917 |
| 188 | 513 | 918 |
| 188 | 514 | 919 |
| 188 | 515 | 920 |
| 188 | 516 | 921 |
| 188 | 517 | 922 |
| 189 | 66 | 923 |
| 190 | 67 | 924 |
| 191 | 68 | 925 |
| 191 | 68 | 926 |
| 192 | 69 | 927 |
| 192 | 518 | 928 |
| 193 | 519 | 929 |
| 193 | 520 | 930 |
| 193 | 521 | 931 |
| 193 | 70 | 932 |
| 193 | 522 | 933 |
| 194 | 71 | 934 |
| 194 | 523 | 935 |
| 194 | 524 | 936 |
| 194 | 525 | 937 |
| 194 | 526 | 938 |
| 194 | 527 | 939 |
| 194 | 528 | 940 |
| 194 | 529 | 941 |
| 194 | 530 | 942 |
| 194 | 531 | 943 |
| 194 | 531 | 944 |
| 195 | 72 | 945 |
| 196 | 73 | 946 |
| 196 | 73 | 947 |
| 197 | 74 | 948 |
| 197 | 532 | 949 |
| 197 | 532 | 950 |
| 197 | 533 | 951 |
| 197 | 533 | 952 |
| 197 | 534 | 953 |
| 197 | 534 | 954 |
| 197 | 535 | 955 |
| 197 | 535 | 956 |
| 197 | 536 | 957 |
| 197 | 536 | 958 |
| 197 | 537 | 959 |
| 197 | 537 | 960 |
| 197 | 538 | 961 |
| 197 | 539 | 962 |
| 197 | 540 | 963 |
| 197 | 541 | 964 |
| 197 | 542 | 965 |
| 198 | 75 | 966 |
| 198 | 543 | 967 |
| 198 | 544 | 968 |
| 198 | 545 | 969 |
| 198 | 546 | 970 |
| 198 | 547 | 971 |
| 198 | 548 | 972 |
| 198 | 549 | 973 |
| 198 | 550 | 974 |
| 198 | 551 | 975 |
| 198 | 552 | 976 |
| 198 | 553 | 977 |
| 198 | 554 | 978 |
| 198 | 555 | 979 |
| 198 | 556 | 980 |
| 198 | 557 | 981 |
| 198 | 558 | 982 |
| 199 | 76 | 983 |
| 200 | 77 | 984 |
| 201 | 78 | 985 |
| 201 | 78 | 986 |
| 201 | 559 | 987 |
| 201 | 559 | 988 |
| 201 | 560 | 989 |
| 201 | 560 | 990 |
| 201 | 561 | 991 |
| 201 | 561 | 992 |

TABLE 8-continued

CRISPR sequences associated with transposases
(SEQ ID NOs: 124-246, 275-287).

| PRT (SEQ ID NO:) | DNA (SEQ ID NO:) | Associated CRISPR (SEQ ID NO:) |
|---|---|---|
| 202 | 79 | 993 |
| 202 | 79 | 994 |
| 203 | 80 | 995 |
| 204 | 81 | 996 |
| 205 | 82 | 997 |
| 205 | 562 | 998 |
| 206 | 83 | 999 |
| 207 | 84 | 1000 |
| 208 | 85 | 1001 |
| 209 | 86 | 1002 |
| 210 | 573 | 1003 |
| 210 | 574 | 1004 |
| 210 | 87 | 1005 |
| 210 | 575 | 1006 |
| 210 | 576 | 1007 |
| 210 | 577 | 1008 |
| 210 | 563 | 1009 |
| 210 | 564 | 1010 |
| 210 | 565 | 1011 |
| 210 | 578 | 1012 |
| 210 | 579 | 1013 |
| 210 | 566 | 1014 |
| 210 | 567 | 1015 |
| 210 | 568 | 1016 |
| 210 | 580 | 1017 |
| 210 | 569 | 1018 |
| 210 | 581 | 1019 |
| 210 | 570 | 1020 |
| 210 | 571 | 1021 |
| 210 | 582 | 1022 |
| 210 | 572 | 1023 |
| 210 | 583 | 1024 |
| 211 | 88 | 1025 |
| 211 | 584 | 1026 |
| 212 | 89 | 1027 |
| 212 | 89 | 1028 |
| 213 | 90 | 1029 |
| 213 | 90 | 1030 |
| 213 | 585 | 1031 |
| 213 | 586 | 1032 |
| 213 | 587 | 1033 |
| 213 | 588 | 1034 |
| 213 | 588 | 1035 |
| 213 | 589 | 1036 |
| 213 | 589 | 1037 |
| 213 | 590 | 1038 |
| 213 | 590 | 1039 |
| 214 | 91 | 1040 |
| 214 | 91 | 1041 |
| 215 | 92 | 1042 |
| 216 | 93 | 1043 |
| 216 | 93 | 1044 |
| 216 | 591 | 1045 |
| 216 | 591 | 1046 |
| 216 | 592 | 1047 |
| 216 | 592 | 1048 |
| 216 | 593 | 1049 |
| 216 | 593 | 1050 |
| 217 | 94 | 1051 |
| 218 | 95 | 1052 |
| 218 | 95 | 1053 |
| 219 | 96 | 1054 |
| 220 | 97 | 1055 |
| 220 | 594 | 1056 |
| 221 | 98 | 679 |
| 222 | 99 | 647 |
| 223 | 100 | 650 |
| 223 | 595 | 653 |
| 223 | 596 | 651 |
| 223 | 597 | 654 |
| 224 | 101 | 1057 |
| 225 | 598 | 1058 |
| 225 | 102 | 1059 |
| 226 | 103 | 1060 |
| 227 | 104 | 1061 |
| 228 | 105 | 1062 |
| 229 | 106 | 1063 |
| 230 | 107 | 1064 |
| 230 | 107 | 1065 |
| 231 | 108 | 1066 |
| 231 | 108 | 1067 |
| 232 | 599 | 1068 |
| 232 | 109 | 1069 |
| 232 | 600 | 1070 |
| 232 | 601 | 1071 |
| 233 | 110 | 1072 |
| 233 | 110 | 1073 |
| 234 | 111 | 1074 |
| 234 | 111 | 1075 |
| 235 | 112 | 1076 |
| 236 | 113 | 1077 |
| 237 | 114 | 1078 |
| 237 | 114 | 1079 |
| 238 | 602 | 1080 |
| 238 | 115 | 1081 |
| 239 | 116 | 1082 |
| 240 | 117 | 1083 |
| 241 | 118 | 1084 |
| 241 | 118 | 1085 |
| 241 | 603 | 1086 |
| 241 | 603 | 1087 |
| 242 | 119 | 1088 |
| 243 | 120 | 1089 |
| 244 | 121 | 1090 |
| 245 | 122 | 1091 |
| 246 | 123 | 1092 |
| 276 | 605 | 1093 |
| 277 | 606 | 1094 |
| 277 | 607 | 1095 |
| 277 | 608 | 1096 |
| 277 | 609 | 1097 |
| 277 | 610 | 1098 |
| 277 | 611 | 1099 |
| 278 | 612 | 1100 |
| 279 | 613 | 1101 |
| 280 | 614 | 1102 |
| 281 | 615 | 1103 |
| 281 | 616 | 1104 |
| 281 | 617 | 1105 |
| 281 | 618 | 1106 |
| 281 | 619 | 1107 |
| 281 | 620 | 1108 |
| 281 | 621 | 1109 |
| 282 | 622 | 1110 |
| 283 | 623 | 1111 |
| 284 | 624 | 1112 |
| 285 | 625 | 1113 |
| 286 | 626 | 1114 |
| 287 | 627 | 1115 |

CRIPSR Repeat and Spacer Coordinates within Each CRISPR Sequence

The repeat and spacer positions within each CRIPSR sequence were identified using bioinformatic analysis. For a representative CRISPR sequence selected for each transposase, The repeat and spacer sequences of the CRISPR regions were identified using the CRISPR recognition tool (Bland, 2007), then the sequences were manually examined to adjust the repeat and spacer sequences. The curated repeat and spacer sequence coordinates are provided in Table 9 for a representative CRISPR sequence selected for each transposase (SEQ ID NOs: 124-246, 275-287).

TABLE 9

Repeat and spacer coordinates identified for a representative CRISPR sequence for each transposase (SEQ ID NOs: 124-246, 275-287).

| PRT SEQ ID NO | DNA SEQ ID NO | CRISPR SEQ ID NO | Repeat coordinates within CRISPR | Spacer coordinates within CRISPR |
|---|---|---|---|---|
| 124 | 1 | 628 | [51 . . . 73]; [139 . . . 161]; [197 . . . 226]; [263 . . . 292]; [329 . . . 358] | [74 . . . 138]; [162 . . . 196]; [227 . . . 262]; [293 . . . 328]; [359 . . . 394] |
| 125 | 2 | 629 | [51 . . . 73]; [139 . . . 161]; [197 . . . 226]; [263 . . . 292]; [329 . . .358] | [74 . . . 138]; [162 . . . 196]; [227 . . . 262]; [293 . . . 328]; [359 . . . 394] |
| 126 | 3 | 630 | [51 . . . 73]; [107 . . . 138]; [173 . . . 204] | [74 . . . 106]; [139 . . . 172]; [205 . . . 238] |
| 127 | 4 | 631 | [51 . . . 71]; [108 . . . 136]; [174 . . . 203]; [239 . . . 268]; [303 . . . 332]; [368 . . . 397] | [72 . . . 107]; [137 . . . 173]; [204 . . . 238]; [269 . . . 302]; [333 . . . 367]; [398 . . . 434] |
| 128 | 5 | 636 | [51 . . . 71]; [108 . . . 136]; [174 . . . 203]; [239 . . . 268]; [303 . . . 332]; [368 . . . 397] | [72 . . . 107]; [137 . . . 173]; [204 . . . 238]; [269 . . . 302]; [333 . . . 367]; [398 . . . 434] |
| 129 | 6 | 637 | [51 . . . 71]; [108 . . . 136]; [174 . . . 203]; [239 . . . 268]; [303 . . . 332]; [368 . . . 397] | [72 . . . 107]; [137 . . . 173]; [204 . . . 238]; [269 . . . 302]; [333 . . . 367]; [398 . . . 434] |
| 130 | 7 | 641 | [51 . . . 71]; [108 . . . 136]; [174 . . . 230] [239 . . . 268]; [303 . . . 332]; [368 . . . 397] | [72 . . . 107]; [137 . . . 173]; [204 . . . 238] [269 . . . 302]; [333 . . . 367]; [398 . . . 434] |
| 131 | 8 | 646 | [51 . . . 80]; [116 . . . 145]; [180 . . . 209] | [81 . . . 115]; [146 . . . 179]; [210 . . . 238] |
| 132 | 9 | 647 | [51 . . . 71]; [110 . . . 138]; [174 . . . 203]; [239 . . . 268]; [303 . . . 332]; [368 . . . 397]; [433 . . . 462]; [499 . . . 528] | [72 . . . 109]; [139 . . . 173]; [204 . . . 238]; [269 . . . 302]; [333 . . . 367]; [398 . . . 432]; [463 . . . 498]; [529 . . . 550] |
| 133 | 10 | 652 | [51 . . . 71]; [108 . . . 136]; [174 . . . 203]; [239 . . . 268]; [303 . . . 332]; [368 . . . 397] | [72 . . . 107]; [137 . . . 173]; [204 . . . 238]; [269 . . . 302]; [333 . . . 367]; [398 . . . 434] |
| 134 | 11 | 653 | [51 . . . 72]; [110 . . . 139]; [175 . . . 204]; [240 . . . 269]; [304 . . . 333]; [369 . . . 398]; [434 . . . 463] | [73 . . . 109]; [140 . . . 174]; [205 . . . 239]; [270 . . . 303]; [334 . . . 368]; [399 . . . 433]; [464 . . . 499] |
| 135 | 12 | 655 | [51 . . . 71]; [108 . . . 136]; [172 . . . 201] | [72 . . . 107]; [137 . . . 171]; [202 . . . 238] |
| 136 | 304 | 662 | [42 . . . 71]; [107 . . . 136]; [174 . . . 203]; [239 . . . 268]; [304 . . . 333] | [72 . . . 106]; [137 . . . 173]; [204 . . . 238]; [269 . . . 303]; [334 . . . 370] |
| 137 | 14 | 677 | [51 . . . 73]; [110 . . . 138]; [174 . . . 203]; [241 . . . 270]; [306 . . . 335]; [370 . . . 399]; [435 . . . 464] | [74 . . . 109]; [139 . . . 173]; [204 . . . 240]; [271 . . . 305]; [336 . . . 369]; [400 . . . 434]; [465 . . . 501] |
| 138 | 15 | 678 | [51 . . . 72]; [111 . . . 139]; [175 . . . 204]; [240 . . . 269]; [304 . . . 333]; [369 . . . 398]; [435 . . . 464] | [73 . . . 110]; [140 . . . 174]; [205 . . . 239]; [270 . . . 303]; [334 . . . 368]; [399 . . . 434]; [465 . . . 500] |
| 139 | 16 | 679 | [51 . . . 72]; [111 . . . 139]; [175 . . . 204]; [240 . . . 269]; [304 . . . 333]; [369 . . . 398]; [435 . . . 464] | [73 . . . 110]; [140 . . . 174]; [205 . . . 239]; [270 . . . 303]; [334 . . . 368]; [399 . . . 434]; [465 . . . 500] |
| 140 | 17 | 680 | [51 . . . 80]; [116 . . . 145]; [181 . . . 210]; [247 . . . 276]; [313 . . . 342] | [81 . . . 115]; [146 . . . 180]; [211 . . . 246]; [277 . . . 312]; [343 . . . 377] |
| 141 | 18 | 686 | [51 . . . 80]; [116 . . . 145]; [181 . . . 210]; [247 . . . 276]; [313 . . . 342] | [81 . . . 115]; [146 . . . 180]; [211 . . . 246]; [277 . . . 312]; [343 . . . 377] |
| 142 | 19 | 689 | [51 . . . 70]; [105 . . . 134]; [171 . . . 200] | [71 . . . 104]; [135 . . . 170]; [201 . . . 234] |
| 143 | 20 | 690 | [51 . . . 71]; [108 . . . 136]; [174 . . . 203]; [239 . . . 268]; [303 . . . 332]; [368 . . . 397] | [72 . . . 107]; [137 . . . 173]; [204 . . . 238]; [269 . . . 302]; [333 . . . 367]; [398 . . . 434] |
| 144 | 21 | 695 | [51 . . . 80]; [116 . . . 145]; [181 . . . 210]; [247 . . . 276]; [313 . . . 342] | [81 . . . 115]; [146 . . . 180]; [211 . . . 246]; [277 . . . 312]; [343 . . . 377] |
| 145 | 22 | 810 | [51 . . . 73]; [110 . . . 138]; [174 . . . 203]; [241 . . . 270]; [306 . . . 335]; [371 . . . 400] | [74 . . . 109]; [139 . . . 173]; [204 . . . 240]; [271 . . . 305]; [336 . . . 370]; [401 . . . 437] |
| 146 | 23 | 811 | [51 . . . 80]; [116 . . . 145]; [181 . . . 210]; [248 . . . 277]; [314 . . . 343]; [381 . . . 410] | [81 . . . 115]; [146 . . . 180]; [211 . . . 247]; [278 . . . 313]; [344 . . . 380]; [411 . . . 447] |
| 147 | 24 | 812 | [51 . . . 71]; [109 . . . 138]; [174 . . . 203]; [241 . . . 270]; [306 . . . 335]; [370 . . . 399] | [72 . . . 108]; [139 . . . 173]; [204 . . . 240]; [271 . . . 305]; [336 . . . 369]; [400 . . . 434] |
| 148 | 25 | 813 | [51 . . . 80]; [116 . . . 145] | [81 . . . 115]; [146 . . . 180] |
| 149 | 26 | 814 | [51 . . . 71]; [107 . . . 136]; [172 . . . 201]; [237 . . . 266]; [302 . . . 332] | [72 . . . 106]; [137 . . . 171]; [202 . . . 236]; [267 . . . 301]; [333 . . . 368] |
| 150 | 27 | 816 | [1 . . . 20]; [58 . . . 87]; [124 . . . 153]; [190 . . . 219]; [254 . . . 273] | [21 . . . 57]; [88 . . . 123]; [154 . . . 189]; [220 . . . 253]; [274 . . . 309] |
| 151 | 28 | 817 | [51 . . . 71]; [108 . . . 136]; [174 . . . 203]; [239 . . . 268]; [303 . . . 332]; [368 . . . 397] | [72 . . . 107]; [137 . . . 173]; [204 . . . 238]; [269 . . . 302]; [333 . . . 367]; [398 . . . 434] |
| 152 | 29 | 820 | [51 . . . 73]; [109 . . . 138]; [174 . . . 203]; [240 . . . 269]; [306 . . . 335] | [74 . . . 108]; [139 . . . 173]; [204 . . . 239]; [270 . . . 305]; [336 . . . 370] |
| 153 | 30 | 821 | [51 . . . 80]; [117 . . . 146]; [183 . . . 212]; [249 . . . 278]; [306 . . . 335] | [81 . . . 116]; [147 . . . 182]; [213 . . . 248]; [279 . . . 305]; [336 . . . 365] |
| 154 | 31 | 822 | [51 . . . 70]; [106 . . . 135]; [172 . . . 201]; [237 . . . 266]; [303 . . . 332]; [369 . . . 398] | [71 . . . 105]; [136 . . . 171]; [202 . . . 236]; [267 . . . 302]; [333 . . . 368]; [399 . . . 433] |
| 155 | 32 | 824 | [51 . . . 71]; [107 . . . 136]; [173 . . . 202]; [238 . . . 266]; [305 . . . 333] | [72 . . . 106]; [137 . . . 172]; [203 . . . 237]; [267 . . . 302]; [334 . . . 359] |
| 156 | 33 | 825 | [51 . . . 71]; [108 . . . 137]; [173 . . . 202]; [237 . . . 266]; [303 . . . 332] | [72 . . . 107]; [138 . . . 172]; [203 . . . 236]; [267 . . . 302]; [333 . . . 369] |
| 157 | 34 | 827 | [51 . . . 80]; [116 . . . 145]; [180 . . . 209] | [81 . . . 115]; [146 . . . 179]; [210 . . . 245] |
| 158 | 35 | 829 | [51 . . . 73]; [109 . . . 138]; [174 . . . 203]; [240 . . . 269]; [306 . . . 335] | [74 . . . 108]; [139 . . . 173]; [204 . . . 239]; [270 . . . 305]; [336 . . . 370] |
| 159 | 36 | 830 | [51 . . . 70]; [105 . . . 134]; [171 . . . 200] | [71 . . . 104]; [135 . . . 170]; [201 . . . 234] |
| 160 | 37 | 831 | [51 . . . 75]; [112 . . . 141]; [177 . . . 206]; [244 . . . 273]; [324 . . . 353]; [390 . . . 419]; [456 . . . 485] | [76 . . . 111]; [142 . . . 176]; [207 . . . 243]; [274 . . . 323]; [354 . . . 389]; [420 . . . 455]; [486 . . . 521] |

TABLE 9-continued

Repeat and spacer coordinates identified for a representative CRISPR sequence for each transposase (SEQ ID NOs: 124-246, 275-287).

| PRT SEQ ID NO | DNA SEQ ID NO | CRISPR SEQ ID NO | Repeat coordinates within CRISPR | Spacer coordinates within CRISPR |
|---|---|---|---|---|
| 161 | 38 | 837 | [51 . . . 80]; [115 . . . 144]; [170 . . . 199]; [235 . . . 264]; [300 . . . 329]; [366 . . . 395] | [81 . . . 114]; [145 . . . 169]; [200 . . . 234]; [265 . . . 299]; [330 . . . 365]; [396 . . . 429] |
| 162 | 39 | 838 | [51 . . . 71]; [108 . . . 136]; [174 . . . 203]; [239 . . . 268]; [303 . . . 332]; [368 . . . 397] | [72 . . . 107]; [137 . . . 173]; [204 . . . 238]; [269 . . . 302]; [333 . . . 367]; [398 . . . 434] |
| 163 | 40 | 839 | [51 . . . 79]; [115 . . . 144]; [179 . . . 209] | [80 . . . 114]; [145 . . . 178]; [210 . . . 243] |
| 164 | 41 | 840 | [51 . . . 79]; [115 . . . 144]; [179 . . . 209] | [80 . . . 114]; [145 . . . 178]; [210 . . . 245] |
| 165 | 42 | 841 | [51 . . . 81]; [115 . . . 145]; [170 . . . 200]; [235 . . . 265] | [82 . . . 114]; [146 . . . 169]; [201 . . . 234]; [266 . . . 298] |
| 166 | 43 | 843 | [51 . . . 80]; [116 . . . 145]; [180 . . . 209]; [245 . . . 274]; [311 . . . 340]; [377 . . . 406] | [81 . . . 115]; [146 . . . 179]; [210 . . . 244]; [275 . . . 310]; [341 . . . 376]; [407 . . . 442] |
| 167 | 44 | 844 | [51 . . . 80]; [115 . . . 144]; [170 . . . 199]; [235 . . . 264]; [300 . . . 329]; [366 . . . 395] | [81 . . . 114]; [145 . . . 169]; [200 . . . 234]; [265 . . . 299]; [330 . . . 365]; [396 . . . 429] |
| 168 | 45 | 845 | [51 . . . 71]; [107 . . . 136]; [174 . . . 203]; [238 . . . 267]; [303 . . . 332] | [72 . . . 106]; [137 . . . 173]; [204 . . . 237]; [268 . . . 302]; [333 . . . 369] |
| 169 | 46 | 846 | [51 . . . 70]; [106 . . . 135]; [172 . . . 201]; [237 . . . 266]; [303 . . . 332]; [369 . . . 398] | [71 . . . 105]; [136 . . . 171]; [202 . . . 236]; [267 . . . 302]; [333 . . . 368]; [399 . . . 433] |
| 170 | 47 | 847 | [51 . . . 73]; [110 . . . 138]; [174 . . . 203]; [241 . . . 270]; [306 . . . 335]; [371 . . . 400] | [74 . . . 109]; [139 . . . 173]; [204 . . . 240]; [271 . . . 305]; [336 . . . 370]; [401 . . . 437] |
| 171 | 461 | 849 | [51 . . . 71]; [108 . . . 136]; [174 . . . 203]; [239 . . . 268]; [304 . . . 333] | [72 . . . 107]; [137 . . . 173]; [204 . . . 238]; [269 . . . 303]; [334 . . . 370] |
| 172 | 49 | 856 | [51 . . . 71]; [107 . . . 136]; [173 . . . 202]; [238 . . . 266] | [72 . . . 106]; [137 . . . 172]; [203 . . . 237]; [267 . . . 304] |
| 173 | 50 | 857 | [51 . . . 71]; [107 . . . 136]; [174 . . . 203]; [239 . . . 268]; [303 . . . 332]; [368 . . . 397] | [72 . . . 106]; [137 . . . 173]; [204 . . . 238]; [269 . . . 302]; [333 . . . 367]; [398 . . . 434] |
| 174 | 51 | 859 | [51 . . . 71]; [107 . . . 136]; [173 . . . 202]; [238 . . . 266]; [305 . . . 333] | [72 . . . 106]; [137 . . . 172]; [203 . . . 237]; [267 . . . 304]; [334 . . . 368] |
| 175 | 52 | 862 | [51 . . . 71]; [107 . . . 136]; [174 . . . 203]; [239 . . . 268]; [303 . . . 332]; [368 . . . 397] | [72 . . . 106]; [137 . . . 173]; [204 . . . 238]; [269 . . . 302]; [333 . . . 367]; [398 . . . 434] |
| 176 | 53 | 866 | [51 . . . 73]; [110 . . . 138]; [174 . . . 203]; [241 . . . 270]; [306 . . . 335]; [370 . . . 399]; [435 . . . 464] | [74 . . . 109]; [139 . . . 173]; [204 . . . 240]; [271 . . . 305]; [336 . . . 369]; [400 . . . 434]; [465 . . . 501] |
| 177 | 54 | 875 | [51 . . . 76]; [112 . . . 141]; [177 . . . 206]; [244 . . . 273]; [329 . . . 358]; [394 . . . 424]; [460 . . . 490]; [519 . . . 544] | [77 . . . 111]; [142 . . . 176]; [207 . . . 243]; [274 . . . 328]; [359 . . . 393]; [425 . . . 459]; [491 . . . 518]; [545 . . . 581] |
| 178 | 55 | 876 | [51 . . . 76]; [112 . . . 141]; [177 . . . 206]; [244 . . . 273]; [324 . . . 353]; [389 . . . 419]; [455 . . . 485]; [514 . . . 539] | [77 . . . 111]; [142 . . . 176]; [207 . . . 243]; [274 . . . 323]; [354 . . . 388]; [420 . . . 454]; [486 . . . 513]; [540 . . . 576] |
| 179 | 56 | 879 | [51 . . . 76]; [112 . . . 141]; [177 . . . 206]; [244 . . . 273]; [324 . . . 353]; [389 . . . 419]; [455 . . . 485]; [514 . . . 539] | [77 . . . 111]; [142 . . . 176]; [207 . . . 243]; [274 . . . 323]; [354 . . . 388]; [420 . . . 454]; [486 . . . 513]; [540 . . . 576] |
| 180 | 57 | 901 | [51 . . . 76]; [112 . . . 141]; [177 . . . 206]; [244 . . . 273]; [324 . . . 353]; [389 . . . 419]; [455 . . . 485]; [514 . . . 539] | [77 . . . 111]; [142 . . . 176]; [207 . . . 243]; [274 . . . 323]; [354 . . . 388]; [420 . . . 454]; [486 . . . 513]; [540 . . . 576] |
| 181 | 58 | 902 | [51 . . . 80]; [117 . . . 146]; [182 . . . 211]; [246 . . . 275] | [81 . . . 116]; [147 . . . 181]; [212 . . . 245]; [276 . . . 311] |
| 182 | 59 | 903 | [51 . . . 71]; [109 . . . 138]; [174 . . . 203]; [239 . . . 268] | [72 . . . 108]; [139 . . . 173]; [204 . . . 238]; [269 . . . 305] |
| 183 | 60 | 904 | [51 . . . 76]; [112 . . . 141]; [177 . . . 206]; [244 . . . 273]; [324 . . . 353] | [77 . . . 111]; [142 . . . 176]; [207 . . . 243]; [274 . . . 323]; [354 . . . 388] |
| 184 | 61 | 905 | [51 . . . 74]; [111 . . . 139]; [175 . . . 204]; [242 . . . 271]; [307 . . . 336] | [75 . . . 110]; [140 . . . 174]; [205 . . . 241]; [272 . . . 306]; [337 . . . 373] |
| 185 | 62 | 906 | [51 . . . 77]; [114 . . . 143]; [180 . . . 209] | [78 . . . 113]; [144 . . . 179]; [210 . . . 246] |
| 186 | 63 | 907 | [51 . . . 80]; [109 . . . 146]; [175 . . . 210]; [248 . . . 277] | [81 . . . 108]; [147 . . . 174]; [211 . . . 247]; [278 . . . 312] |
| 187 | 64 | 909 | [51 . . . 80]; [117 . . . 146]; [181 . . . 210]; [248 . . . 277] | [81 . . . 116]; [147 . . . 180]; [211 . . . 247]; [278 . . . 312] |
| 188 | 65 | 910 | [51 . . . 80]; [117 . . . 146]; [181 . . . 210]; [248 . . . 277] | [81 . . . 116]; [147 . . . 180]; [211 . . . 247]; [278 . . . 312] |
| 189 | 66 | 923 | [51 . . . 70]; [107 . . . 136]; [173 . . . 202] | [71 . . . 106]; [137 . . . 172]; [203 . . . 237] |
| 190 | 67 | 924 | [51 . . . 81]; [116 . . . 146]; [184 . . . 214] | [82 . . . 115]; [147 . . . 183]; [215 . . . 248] |
| 191 | 68 | 925 | [51 . . . 74]; [109 . . . 139]; [173 . . . 203] | [75 . . . 108]; [140 . . . 172]; [204 . . . 237] |
| 191 | 68 | 926 | [51 . . . 70]; [105 . . . 134]; [170 . . . 199]; [237 . . . 267] | [71 . . . 104]; [135 . . . 169]; [200 . . . 236]; [268 . . . 302] |
| 192 | 69 | 927 | [51 . . . 81]; [116 . . . 146]; [184 . . . 214] | [82 . . . 115]; [147 . . . 183]; [215 . . . 248] |
| 193 | 519 | 929 | [51 . . . 80]; [116 . . . 145]; [181 . . . 210]; [247 . . . 276]; [312 . . . 341] | [81 . . . 115]; [146 . . . 180]; [211 . . . 246]; [277 . . . 311]; [342 . . . 376] |
| 194 | 71 | 934 | [51 . . . 81]; [117 . . . 147]; [182 . . . 212] | [82 . . . 116]; [148 . . . 181]; [213 . . . 246] |

TABLE 9-continued

Repeat and spacer coordinates identified for a representative CRISPR sequence for each transposase (SEQ ID NOs: 124-246, 275-287).

| PRT SEQ ID NO | DNA SEQ ID NO | CRISPR SEQ ID NO | Repeat coordinates within CRISPR | Spacer coordinates within CRISPR |
|---|---|---|---|---|
| 195 | 72 | 945 | [51 . . . 80]; [118 . . . 147]; [183 . . . 212]; [249 . . . 278] | [81 . . . 117]; [148 . . . 182]; [213 . . . 248]; 279 . . . 313] |
| 196 | 73 | 946 | [51 . . . 81]; [117 . . . 147]; [182 . . . 212]; [246 . . . 276] | [82 . . . 116]; [148 . . . 181]; [213 . . . 245]; [277 . . . 310] |
| 196 | 73 | 947 | [51 . . . 70]; [105 . . . 134]; [170 . . . 199]; [237 . . . 267] | [71 . . . 104]; [135 . . . 169]; [200 . . . 236]; [268 . . . 302[ |
| 197 | 532 | 949 | [51 . . . 80]; [118 . . . 147]; [183 . . . 212]; [249 . . . 278] | [81 . . . 117]; [148 . . . 182]; [213 . . . 248]; [279 . . . 313] |
| 197 | 532 | 950 | [51 . . . 80]; [115 . . . 144]; [180 . . . 209]; [246 . . . 275] | [81 . . . 114]; [145 . . . 179]; [210 . . . 245]; [276 . . . 324] |
| 198 | 547 | 971 | [51 . . . 81]; [117 . . . 147] | [82 . . . 116]; [148 . . . 181[ |
| 199 | 76 | 983 | [51 . . . 74]; [110 . . . 139]; [174 . . . 203] | [75 . . . 109]; [140 . . . 173]; [204 . . . 238] |
| 200 | 77 | 984 | [51 . . . 80]; [118 . . . 147]; [183 . . . 212]; [249 . . . 278] | [81 . . . 117]; [148 . . . 182]; [213 . . . 248]; [279 . . . 313] |
| 201 | 78 | 985 | [51 . . . 80]; [115 . . . 144]; [181 . . . 210]; [247 . . . 276]; [313 . . . 342] | [81 . . . 114]; [145 . . . 180]; [211 . . . 246]; [277 . . . 312]; [343 . . . 377] |
| 201 | 78 | 986 | [51 . . . 80]; [117 . . . 146]; [183 . . . 212]; [247 . . . 276]; [313 . . . 342]; [379 . . . 408]; [444 . . . 473] | [81 . . . 116]; [147 . . . 182]; [213 . . . 246]; [277 . . . 312]; [343 . . . 378]; [409 . . . 443]; [474 . . . 510] |
| 202 | 79 | 993 | [51 . . . 80]; [118 . . . 147]; [184 . . . 213]; [249 . . . 278] | [81 . . . 117]; [148 . . . 183]; [214 . . . 248]; [279 . . . 313] |
| 202 | 79 | 994 | [51 . . . 80]; [117 . . . 146]; [182 . . . 211] | [81 . . . 116]; [147 . . . 181]; [212 . . . 246] |
| 203 | 80 | 995 | [51 . . . 80]; [117 . . . 146]; [184 . . . 213] | [81 . . . 116]; [147 . . . 183]; [214 . . . 248] |
| 204 | 81 | 996 | [51 . . . 70]; [106 . . . 135]; [173 . . . 203] | [71 . . . 105]; [136 . . . 172]; [204 . . . 238] |
| 205 | 82 | 997 | [51 . . . 71]; [105 . . . 136] | [72 . . . 104]; [137 . . . 169] |
| 206 | 83 | 999 | [51 . . . 70]; [106 . . . 135]; [173 . . . 203] | [71 . . . 105]; [136 . . . 172]; [204 . . . 238] |
| 207 | 84 | 1000 | [51 . . . 78]; [116 . . . 144]; [181 . . . 209]; [247 . . . 276] | [79 . . . 115]; [145 . . . 180]; [210 . . . 246]; [277 . . . 311] |
| 208 | 85 | 1001 | [51 . . . 78]; [115 . . . 144]; [180 . . . 209]; [247 . . . 276]; [312 . . . 341] | [79 . . . 114]; [145 . . . 179]; [210 . . . 246]; [277 . . . 311]; [342 . . . 378]; |
| 209 | 86 | 1002 | [51 . . . 78]; [115 . . . 144]; [180 . . . 209]; [247 . . . 276] | [79 . . . 114]; [145 . . . 179]; [210 . . . 246]; [277 . . . 311] |
| 210 | 87 | 1005 | [51 . . . 70; [106 . . .135]; [173 . . . 203] | [71 . . . 105]; [136 . . . 172]; [204 . . . 238] |
| 211 | 88 | 1025 | [51 . . . 70; [106 . . .135]; [172 . . . 201]; [239 . . . 268] | [71 . . . 105]; [136 . . . 171]; [269 . . . 304] |
| 212 | 89 | 1027 | [51 . . . 80]; [116 . . . 145]; [183 . . . 212]; [248 . . . 266]; [293 . . . 322] | [81 . . . 115]; [146 . . . 182]; [213 . . . 247]; [267 . . . 292]; [323 . . . 357] |
| 212 | 89 | 1028 | [51 . . . 72]; [110 . . . 139] | [73 . . .109]; [140 . . . 175] |
| 213 | 90 | 1029 | [51 . . . 80]; [118 . . . 147]; [183 . . . 212]; [249 . . . 278] | [81 . . . 117]; [148 . . . 182]; [213 . . . 248]; [279 . . . 313] |
| 213 | 90 | 1030 | [51 . . . 80]; [117 . . . 146]; [182 . . . 211] | [81 . . . 116]; [147 . . . 181]; [212 . . . 246] |
| 214 | 91 | 1040 | [51 . . . 81]; [117 . . . 147]; [182 . . . 212] | [82 . . . 116]; [148 . . . 181]; 213 . . . 246] |
| 214 | 91 | 1041 | [51 . . . 80]; [117 . . . 146] | [81 . . . 116]; [147 . . . 181] |
| 215 | 92 | 1042 | [51 . . . 80]; [118 . . . 147]; [184 . . . 213]; [249 . . . 278] | [81 . . . 117]; [148 . . . 183]; [214 . . . 248]; [279 . . . 313] |
| 216 | 93 | 1043 | [51 . . . 80]; [118 . . . 147]; [184 . . . 213]; [249 . . . 278] | [81 . . . 117]; [148 . . . 182]; [213 . . . 248]; [279 . . . 313] |
| 216 | 93 | 1044 | [51 . . . 80]; [117 . . . 146]; [182 . . . 211]; | [81 . . . 116]; [147 . . . 181]; [212 . . . 246] |
| 217 | 94 | 1051 | [51 . . . 80]; [117 . . . 146]; [183 . . . 212]; [247 . . . 276] | [81 . . . 116]; [147 . . . 182]; [213 . . . 246]; [277 . . . 313] |
| 218 | 95 | 1052 | [51 . . . 80]; [118 . . . 147]; [183 . . . 212] | [81 . . . 117]; [148 . . . 182]; [213 . . . 247]; |
| 218 | 95 | 1053 | [51 . . . 81]; [116 . . . 146]; [180 . . . 210]; [247 . . . 277] | [82 . . . 115]; [147 . . . 179]; [211 . . . 246]; [278 . . . 310] |
| 219 | 96 | 1054 | [51 . . . 70; [106 . . . 135] | [71 . . . 105]; [136 . . . 171] |
| 220 | 97 | 1055 | [51 . . . 81]; [118 . . . 148]; [184 . . . 214] | [82 . . . 117]; [149 . . . 183]; [215 . . . 248] |
| 221 | 98 | 679 | [51 . . . 72]; [111 . . . 139]; [175 . . . 204]; [240 . . . 269]; [304 . . . 333]; [369 . . . 398]; [435 . . . 464] | [73 . . . 110]; [140 . . . 174]; [205 . . . 239]; [270 . . . 303]; [334 . . . 368]; [399 . . . 434]; [465 . . . 500] |
| 222 | 99 | 647 | [51 . . . 71]; [110 . . . 138]; [174 . . . 203]; [239 . . . 268]; [303 . . . 332]; [368 . . . 397]; [433 . . . 462]; [499 . . . 528] | [72 . . . 109]; [139 . . . 173]; [204 . . . 238]; [269 . . . 302]; [333 . . . 367]; [398 . . . 432]; [463 . . . 498]; [529 . . . 550] |
| 223 | 595 | 653 | [51 . . . 72]; [110 . . . 139]; [175 . . . 204]; [240 . . . 269]; [304 . . . 333]; [369 . . . 398]; [434 . . . 463] | [73 . . . 109]; [140 . . . 174]; [205 . . . 239]; [270 . . . 303]; [334 . . . 368]; [399 . . . 433]; [464 . . . 499] |
| 224 | 101 | 1057 | [51 . . . 83]; [118 . . . 150]; [185 . . . 217]; [252 . . . 284]; [318 . . . 350]; [384 . . . 416]; [450 . . . 482]; [516 . . . 548]; [582 . . . 614] | [84 . . . 117]; [151 . . . 184]; [218 . . . 251]; [285 . . . 317]; [351 . . . 383]; [417 . . . 449]; [483 . . . 515]; [549 . . . 581]; [615 . . . 648] |
| 225 | 598 | 1058 | [51 . . . 78]; [116 . . . 144]; [181 . . . 209] | [79 . . . 115]; [145 . . . 180]; [210 . . . 244] |

TABLE 9-continued

Repeat and spacer coordinates identified for a representative CRISPR sequence for each transposase (SEQ ID NOs: 124-246, 275-287).

| PRT SEQ ID NO | DNA SEQ ID NO | CRISPR SEQ ID NO | Repeat coordinates within CRISPR | Spacer coordinates within CRISPR |
|---|---|---|---|---|
| 226 | 103 | 1060 | [51 . . . 79]; [116 . . . 144]; [181 . . . 209]; [247 . . . 275]; [311 . . . 339]; [377 . . . 405]; [440 . . . 468]; [506 . . . 534]; [570 . . . 598]; [635 . . . 663]; [702 . . . 730]; [766 . . . 794]; [830 . . . 858]; [895 . . . 923]; [960 . . . 988]; [1025 . . . 1053]; [1091 . . . 1119] | [80 . . . 115]; [145 . . . 180]; [210 . . . 246]; [276 . . . 310]; [340 . . . 376]; [406 . . . 439]; [469 . . . 505]; [535 . . . 569]; [599 . . . 634]; [664 . . . 701]; [731 . . . 765]; [795 . . . 829]; [859 . . . 894]; [924 . . . 959]; [989 . . . 1024]; [1054 . . . 1090]; [1120 . . . 1155] |
| 227 | 104 | 1061 | [51 . . . 79]; [116 . . . 144]; [181 . . . 209]; [247 . . . 275]; [311 . . . 339]; [377 . . . 405]; [440 . . . 468]; [506 . . . 534]; [570 . . . 598]; [635 . . . 663]; [702 . . . 730]; [766 . . . 794]; [830 . . . 858]; [895 . . . 923]; [960 . . . 988]; [1025 . . . 1053]; [1091 . . . 1119] | [80 . . . 115]; [145 . . . 180]; [210 . . . 246]; [276 . . . 310]; [340 . . . 376]; [406 . . . 439]; [469 . . . 505]; [535 . . . 569]; [599 . . . 634]; [664 . . . 701]; [731 . . . 765]; [795 . . . 829]; [859 . . . 894]; [924 . . . 959]; [989 . . . 1024]; [1054 . . . 1090]; [1120 . . . 1155] |
| 228 | 105 | 1062 | [1 . . . 24]; [58 . . . 89]; [126 . . . 157]; [195 . . . 226]; [262 . . . 293]; [329 . . . 360]; [394 . . . 425]; [460 . . . 491]; [525 . . . 556]; [591 . . . 622]; [655 . . . 686]; [721 . . . 752]; [787 . . . 818]; [854 . . . 885]; [920 . . . 951]; [988 . . . 1019]; [1056 . . . 1087]; [1126 . . . 1157]; [1193 . . . 1224]; [1259 . . . 1290]; [1325 . . . 1356]; [1392 . . . 1423]; [1457 . . . 1488] | [25 . . . 57]; [90 . . . 125]; [158 . . . 194]; [227 . . . 261]; [294 . . . 328]; [361 . . . 393]; [426 . . . 459]; [492 . . . 524]; [557 . . . 590]; [623 . . . 654]; [687 . . . 720]; [753 . . . 786]; [819 . . . 853]; [886 . . . 919]; [952 . . . 987]; [1020 . . . 1055]; [1088 . . . 1125]; [1158 . . . 1192]; [1225 . . . 1258]; [1291 . . . 1324]; [1357 . . . 1391]; [1424 . . . 1456]; [1489 . . . 1521] |
| 229 | 106 | 1063 | [51 . . . 82]; [120 . . . 151]; [187 . . . 218]; [254 . . . 285]; [320 . . . 351]; [386 . . . 417]; [452 . . . 483]; [518 . . . 549]; [584 . . . 615]; [651 . . . 682] | [83 . . . 119]; [152 . . . 186]; [219 . . . 253]; [286 . . . 319]; [352 . . . 385]; [418 . . . 451]; [484 . . . 517]; [550 . . . 583]; [616 . . . 650]; [683 . . . 716] |
| 230 | 107 | 1064 | [1 . . . 25]; [60 . . . 91]; [126 . . . 157]; [193 . . . 224]; [260 . . . 291]; [327 . . . 358]; [392 . . . 423]; [457 . . . 488]; [522 . . . 553]; [590 . . . 621]; [658 . . . 689]; [724 . . . 755]; [790 . . . 821]; [860 . . . 891]; [927 . . . 958]; [993 . . . 1024]; [1061 . . . 1092]; [1126 . . . 1157]; [1192 . . . 1223]; [1259 . . . 1290]; [1325 . . . 1356]; [1391 . . . 1422]; [1458 . . . 1489] | [26 . . . 59]; [92 . . . 125]; [158 . . . 192]; [225 . . . 259]; [292 . . . 326]; [359 . . . 391]; [424 . . . 456]; [489 . . . 521]; [554 . . . 589]; [622 . . . 657]; [690 . . . 723]; [756 . . . 789]; [822 . . . 859]; [892 . . . 926]; [959 . . . 992]; [1025 . . . 1060]; [1093 . . . 1125]; [1158 . . . 1191]; [1224 . . . 1258]; [1291 . . . 1324]; [1357 . . . 1390]; [1423 . . . 1457]; [1490 . . . 1522] |
| 230 | 107 | 1065 | [51 . . . 82]; [120 . . . 151]; [190 . . . 221]; [259 . . . 290]; [325 . . . 356]; [391 . . . 422] | [83 . . . 119]; [152 . . . 189]; [222 . . . 258]; [291 . . . 324]; [357 . . . 390]; [423 . . . 456] |
| 231 | 108 | 1066 | [51 . . . 82]; [118 . . . 149]; [184 . . . 215]; [249 . . . 280]; [315 . . . 346]; [380 . . . 411]; [447 . . . 478]; [516 . . . 547]; [581 . . . 612]; [650 . . . 681]; [716 . . . 747]; [783 . . . 814]; [849 . . . 880]; [915 . . . 946]; [980 . . . 1011]; [1044 . . . 1075]; [1112 . . . 1143]; [1177 . . . 1208]; [1245 . . . 1276]; [1311 . . . 1342]; [1377 . . . 1408]; [1445 . . . 1476]; [1510 . . . 1541]; [1576 . . . 1607]; [1642 . . . 1673]; [1709 . . . 1740]; [1776 . . . 1807]; [1842 . . . 1873]; [1908 . . . 1939]; [1974 . . . 2005]; [2041 . . . 2072]; [2107 . . . 2138]; [2174 . . . 2205]; [2240 . . . 2271]; [2307 . . . 2338]; [2374 . . . 2405]; [2439 . . . 2470]; [2507 . . . 2538] | [83 . . . 117]; [150 . . . 183]; [216 . . . 248]; [281 . . . 314]; [347 . . . 379]; [412 . . . 446]; [479 . . . 515]; [548 . . . 580]; [613 . . . 649]; [682 . . . 715]; [748 . . . 782]; [815 . . . 848]; [881 . . . 914]; [947 . . . 979]; [1012 . . . 1043]; [1076 . . . 1111]; [1144 . . . 1176]; [1209 . . . 1244]; [1277 . . . 1310]; [1343 . . . 1376]; [1409 . . . 1444]; [1477 . . . 1509]; [1542 . . . 1575]; [1608 . . . 1641]; [1674 . . . 1708]; [1741 . . . 1775]; [1808 . . . 1841]; [1874 . . . 1907]; [1940 . . . 1973]; [2006 . . . 2040]; [2073 . . . 2106]; [2139 . . . 2173]; [2206 . . . 2239]; [2272 . . . 2306]; [2339 . . . 2373]; [2406 . . . 2438]; [2471 . . . 2506]; [2539 . . . 2572] |
| 231 | 108 | 1067 | [51 . . . 82]; [118 . . . 149]; [183 . . . 214]; [250 . . . 281]; [318 . . . 349]; [386 . . . 417]; [452 . . . 483]; [519 . . . 550]; [585 . . . 616]; [653 . . . 684]; [720 . . . 751]; [787 . . . 818]; [853 . . . 884]; [919 . . . 950]; [984 . . . 1015]; [1049 . . . 1080]; [1114 . . . 1145]; [1180 . . . 1211]; [1246 . . . 1277]; [1311 . . . 1342]; [1378 . . . 1409]; | [83 . . . 117]; [150 . . . 182]; [215 . . . 249]; [282 . . . 317]; [350 . . . 385]; [418 . . . 451]; [484 . . . 518]; [551 . . . 584]; [617 . . . 652]; [685 . . . 719]; [752 . . . 786]; [819 . . . 852]; [885 . . . 918]; [951 . . . 983]; [1016 . . . 1048]; [1081 . . . 1113]; [1146 . . . 1179]; [1212 . . . 1245]; [1278 . . . 1310]; [1343 . . . 1377]; [1410 . . . 1444]; [1477 . . . 1512]; |

TABLE 9-continued

Repeat and spacer coordinates identified for a representative CRISPR sequence for each transposase (SEQ ID NOs: 124-246, 275-287).

| PRT SEQ ID NO | DNA SEQ ID NO | CRISPR SEQ ID NO | Repeat coordinates within CRISPR | Spacer coordinates within CRISPR |
|---|---|---|---|---|
| | | | [1445 . . . 1476]; [1513 . . . 1544]; [1578 . . . 1609]; [1645 . . . 1676]; [1712 . . . 1743]; | [1545 . . . 1577]; [1610 . . . 1644]; [1677 . . . 1711]; [1744 . . . 1779] |
| 232 | 600 | 1070 | [51 . . . 82]; [117 . . . 148]; [185 . . . 216]; [252 . . . 283]; [318 . . . 349]; [386 . . . 417]; [451 . . . 482]; [515 . . . 546]; [580 . . . 611]; [645 . . . 676]; [712 . . . 743]; [778 . . . 809]; [844 . . . 875]; [909 . . . 940]; [976 . . . 1007] | [83 . . . 116]; [149 . . . 184]; [217 . . . 251]; [284 . . . 317]; [350 . . . 385]; [418 . . . 450]; [483 . . . 514]; [547 . . . 579]; [612 . . . 644]; [677 . . . 711]; [744 . . . 777]; [810 . . . 843]; [876 . . . 908]; [941 . . . 975]; [1008 . . . 1042] |
| 233 | 110 | 1072 | [51 . . . 82]; [117 . . . 148]; [182 . . . 213]; [249 . . . 280]; [315 . . . 346]; [382 . . . 413]; [447 . . . 478];[513 . . . 544]; [580 . . . 611]; [647 . . . 678]; [712 . . . 743]; [780 . . . 811]; [847 . . . 878]; [914 . . . 945]; [979 . . . 1010]; [1044 . . . 1075]; [1110 . . . 1141] | [83 . . . 116]; [149 . . . 181]; [214 . . . 248]; [281 . . . 314]; [347 . . . 381]; [414 . . . 446]; [479 . . . 512]; [545 . . . 579]; [612 . . . 646]; [679 . . . 711]; [744 . . . 779]; [812 . . . 846]; [879 . . . 913]; [946 . . . 978]; [1011 . . . 1043]; [1076 . . . 1109]; [1142 . . . 1175] |
| 233 | 110 | 1073 | [51 . . . 82]; [115 . . . 146]; [180 . . . 211]; [244 . . . 275]; [311 . . . 342]; [379 . . . 410]; [446 . . . 477] | [83 . . . 114]; [147 . . . 179]; [212 . . . 243]; [276 . . . 310]; [343 . . . 378]; [411 . . . 445]; [478 . . . 511] |
| 234 | 111 | 1074 | [51 . . . 82]; [117 . . . 148]; [182 . . . 213]; [247 . . . 278]; [314 . . . 345]; [380 . . . 411]; [446 . . . 477]; [512 . . . 543]; [579 . . . 610] | [83 . . . 116]; [149 . . . 181]; [214 . . . 246]; [279 . . . 313]; [346 . . . 379]; [412 . . . 445]; [478 . . . 511]; [544 . . . 578]; [611 . . . 643] |
| 234 | 111 | 1075 | [51 . . . 82]; [118 . . . 149] | [83 . . . 117]; [150 . . . 184] |
| 235 | 112 | 1076 | [51 . . . 82]; [117 . . . 148]; [183 . . . 214]; [248 . . . 279]; [313 . . . 344]; [379 . . . 410]; [445 . . . 476]; [513 . . . 544]; [578 . . . 609]; [644 . . . 675]; [710 . . . 741]; [775 . . . 806]; [841 . . . 872]; [906 . . . 937]; [972 . . . 1003]; [1037 . . . 1068]; [1102 . . . 1133]; [1167 . . . 1198] | [83 . . . 116]; [149 . . . 182]; [215 . . . 247]; [280 . . . 312]; [345 . . . 378]; [411 . . . 444];[477 . . . 512]; [545 . . . 577]; [610 . . . 643]; [676 . . . 709]; [742 . . . 774]; [807 . . . 840]; [873 . . . 905]; [938 . . . 971]; [1004 . . . 1036]; [1069 . . . 1101]; [1134 . . . 1166]; [1199 . . . 1232] |
| 236 | 113 | 1077 | [51 . . . 82]; [119 . . . 150]; [187 . . . 218]; [253 . . . 284]; [319 . . . 350]; [384 . . . 415]; [449 . . . 480]; [516 . . . 547] | [83 . . . 118]; [151 . . . 186]; [219 . . . 252]; [285 . . . 318]; [351 . . . 383]; [416 . . . 448]; [481 . . . 515]; [548 . . . 581] |
| 237 | 114 | 1078 | [51 . . . 82]; [118 . . . 149]; [184 . . . 215]; [249 . . . 280]; [314 . . . 345]; [380 . . . 411]; [446 . . . 477]; [512 . . . 543]; [578 . . . 609]; [643 . . . 674]; [709 . . . 740]; [775 . . . 806]; [842 . . . 873] | [83 . . . 117]; [150 . . . 183]; [216 . . . 248]; [281 . . . 313]; [346 . . . 379]; [412 . . . 445]; [478 . . . 511]; [544 . . . 577]; [610 . . . 642]; [675 . . . 708]; [741 . . . 774]; [807 . . . 841]; [874 . . . 908] |
| 237 | 114 | 1079 | [51 . . . 83]; [117 . . . 149] | [84 . . . 116]; [150 . . . 183] |
| 238 | 115 | 1081 | [51 . . . 71]; [112 . . . 136] | [72 . . . 111]; [137 . . . 176] |
| 239 | 116 | 1082 | [51 . . . 79]; [116 . . . 144]; [181 . . . 209]; [246 . . . 274] | [80 . . . 115]; [145 . . . 180]; [210 . . . 245]; [275 . . . 309] |
| 240 | 117 | 1083 | [51 . . . 77]; [112 . . . 138]; [173 . . . 199] | [78 . . . 111]; [139 . . . 172]; [200 . . . 233] |
| 241 | 118 | 1084 | [51 . . . 85]; [116 . . . 150]; [182 . . . 216]; [248 . . . 282]; [314 . . . 348]; [380 . . . 414]; [445 . . . 479] | [86 . . . 115]; [151 . . . 181]; [217 . . . 247]; [283 . . . 313]; [349 . . . 379]; [415 . . . 444]; [480 . . . 510] |
| 241 | 118 | 1085 | [51 . . . 87]; [124 . . . 159]; [190 . . . 226]; [256 . . . 292]; [322 . . . 356]; [387 . . . 423]; [453 . . . 489]; [519 . . . 555]; [585 . . . 621]; [651 . . . 687]; [717 . . . 753]; [782 . . . 818]; [848 . . . 884] | [88 . . . 123]; [160 . . . 189]; [227 . . . 255]; [293 . . . 321]; [357 . . . 386]; [424 . . . 452]; [490 . . . 518]; [556 . . . 584]; [622 . . . 650]; [688 . . . 716]; [754 . . . 781]; [819 . . . 847]; [885 . . . 913] |
| 242 | 119 | 1088 | [51 . . . 70]; [118 . . . 137]; [172 . . . 191]; [238 . . . 257]; [304 . . . 323]; [384 . . . 403]; [451 . . . 470] | [71 . . . 117]; [138 . . . 171]; [192 . . . 237]; [258 . . . 303]; [324 . . . 383]; [404 . . . 450]; [471 . . . 515] |
| 243 | 120 | 1089 | [51 . . . 78]; [116 . . . 143]; [181 . . . 208] | [79 . . . 115]; [144 . . . 180]; [209 . . . 244] |
| 244 | 121 | 1090 | [51 . . . 78]; [116 . . . 143]; [181 . . . 208] | [79 . . . 115]; [144 . . . 180]; [209 . . . 244] |

TABLE 9-continued

Repeat and spacer coordinates identified for a representative CRISPR sequence for each transposase (SEQ ID NOs: 124-246, 275-287).

| PRT SEQ ID NO | DNA SEQ ID NO | CRISPR SEQ ID NO | Repeat coordinates within CRISPR | Spacer coordinates within CRISPR |
|---|---|---|---|---|
| 245 | 122 | 1091 | [51 . . . 78]; [116 . . . 143]; [181 . . . 208]; [245 . . . 272]; [312 . . . 339]; [358 . . . 385] | [79 . . . 115]; [144 . . . 180]; [209 . . . 244]; [273 . . . 311]; [340 . . . 357]; [386 . . . 398] |
| 246 | 123 | 1092 | [51 . . . 69]; [108 . . . 126] | [70 . . . 107]; [127 . . . 173] |
| 276 | 605 | 1093 | [51 . . . 74]; [111 . . . 134]; [172 . . . 195]; [233 . . . 256] | [75 . . . 110]; [135 . . . 171]; [196 . . . 232]; [257 . . . 293] |
| 277 | 606 | 1094 | [51 . . . 70]; [106 . . . 135]; [173 . . . 203] | [71 . . . 105]; [136 . . . 172]; [204 . . . 238] |
| 278 | 612 | 1100 | [51 . . . 70]; [106 . . . 135]; [173 . . . 203] | [71 . . . 105]; [136 . . . 172]; [204 . . . 238] |
| 279 | 613 | 1101 | [51 . . . 70]; [107 . . . 136]; [173 . . . 202] | [71 . . . 106]; [137 . . . 172]; [203 . . . 239] |
| 280 | 614 | 1102 | [51 . . . 82]; [117 . . . 148]; [183 . . . 214]; [249 . . . 280]; [314 . . . 345]; [380 . . . 411]; [445 . . . 476] | [83 . . . 116]; [149 . . . 182]; [215 . . . 248]; [281 . . . 313]; [346 . . . 379]; [412 . . . 444]; [477 . . . 509] |
| 281 | 615 | 1103 | [51 . . . 80]; [117 . . . 146]; [183 . . . 212]; [249 . . . 278] | [81 . . . 116]; [147 . . . 182]; [213 . . . 248]; [279 . . . 315] |
| 282 | 622 | 1110 | [51 . . . 80]; [116 . . . 145]; [181 . . . 210]; [247 . . . 276]; [312 . . . 341] | [81 . . . 115]; [146 . . . 180]; [211 . . . 246]; [277 . . . 311]; [342 . . . 376] |
| 283 | 623 | 1111 | [51 . . . 70]; [106 . . . 135]; [173 . . . 203] | [71 . . . 105]; [136 . . . 172]; [204 . . . 238] |
| 284 | 624 | 1112 | [51 . . . 82]; [118 . . . 149]; [187 . . . 218]; [255 . . . 286]; [322 . . . 353]; [388 . . . 419]; [455 . . . 486]; [522 . . . 553]; [588 . . . 619]; [653 . . . 684]; [720 . . . 751]; [785 . . . 816]; [854 . . . 885]; [920 . . . 951]; [986 . . . 1017]; [1051 . . . 1082] | [83 . . . 117]; [150 . . . 186]; [219 . . . 254]; [287 . . . 321]; [354 . . . 387]; [420 . . . 454]; [487 . . . 521]; [554 . . . 587]; [620 . . . 652]; [685 . . . 719]; [752 . . . 784]; [817 . . . 853]; [886 . . . 919]; [952 . . . 985]; [1018 . . . 1050]; [1083 . . . 1116] |
| 285 | 625 | 1113 | [51 . . . 82]; [117 . . . 148]; [182 . . . 213]; [249 . . . 280]; [317 . . . 348]; [383 . . . 414]; [448 . . . 479]; [514 . . . 545]; [580 . . . 611]; [647 . . . 678]; [713 . . . 744]; [779 . . . 810] | [83 . . . 116]; [149 . . . 181]; [214 . . . 248]; [281 . . . 316]; [349 . . . 382]; [415 . . . 447]; [480 . . . 513]; [546 . . . 579]; [612 . . . 646]; [679 . . . 712]; [745 . . . 778]; [811 . . . 844] |
| 286 | 626 | 1114 | [51 . . . 82]; [115 . . . 146]; [180 . . . 211]; [248 . . . 279]; [317 . . . 348]; [381 . . . 412]; [445 . . . 476]; [511 . . . 542]; [577 . . . 608]; [643 . . . .674]; [709 . . . 740]; [774 . . . 805] | [83 . . . 114]; [147 . . . 179]; [212 . . . 247]; [280 . . . 316]; [349 . . . 380]; [413 . . . 444]; [477 . . . 510]; [543 . . . 576]; [609 . . . 642]; [675 . . . 708]; [741 . . . 773]; [806 . . . 839] |
| 287 | 627 | 1115 | [51 . . . 74]; [102 . . . 125]; [148 . . . 171]; [196 . . . 219]; [242 . . . 265]; [290 . . . 313]; [336 . . . 359]; [384 . . . 407] | [75 . . . 101]; [126 . . . 147]; [172 . . . 195]; [220 . . . 241]; [266 . . . 289]; [314 . . . 335]; [360 . . . 383]; [408 . . . 434] |

Prediction of PAM Motifs and Guide RNAs for the Transposases

The curated spacer sequences listed in Table 9 were used in blast searches against datasets of phage and viral genomic sequences. The viral genome dataset was downloaded from ENA (European Nucleotide Archive). The phage genome datasets were downloaded from ENA, NCBI (National Center for Biotechnology Information), and Actinobacteriophage (web page at phagesdb.org) databases. Hits that were 100% identical over 20 bp either from the 5' start or from the 3' end of the query spacer sequence were selected and aligned with the spacer sequence using clustalw. As an example, the spacer sequences associated with the cluster 1 proteins (spacer 1, SEQ ID NO: 2004; spacer 2, SEQ ID NO: 2005, spacer 3, SEQ ID NO: 2006) were searched and aligned with the phage sequence matches (KJ920400_1, SEQ ID NO: 2007; HE614281_1 SEQ ID NO: 2009; KJ024807_1, SEQ ID NO: 2010; NC 029008.1_1, SEQ ID NO: 2011), as shown in FIG. 2. This alignment suggested a PAM motif of nucleotide triplet 5'-TCA-3' is present at the 5' end of the spacer. Additionally, a PAM motif of nucleotide triplet 5'-TTA-3' is likely an alternative 5' PAM for cluster 1 proteins; a PAM motif of nucleotide triplet 5'-CCT-3' is predicted to be a 5' PAM for cluster 3 proteins, and the a PAM motif of nucleotide triplet 5'-CCA-3', or 5'-CCT-3', or 5'-ACA-3' is predicted to be a 5' PAM for cluster-11.

For at least one curated repeat sequence associated with each transposase, an analysis was done to predict secondary structure. All predicted structures showed a stem loop structure with differences in the length of the stem, with most of the repeats having a stem length ≥5 bp. As an example, FIG. 3 shows the predicted secondary structures for the first and second repeats (SEQ ID NOs: 2012 and 2013) associated with a transposase (PRT: SEQ ID NO: 136; DNA: SEQ ID NO: 304). The predicted secondary structure of the CRISPR repeat sequence illustrates that the repeat sequence is capable of forming a hairpin loop structure suggesting that the repeat sequence alone is sufficient to form an effective guide RNA.

The guide-RNA sequences for a transposase can be designed to comprise at least one of the associated repeat sequences (R) and at least one of the associated spacer sequences (S), including but not limited to the combinations and orientations such as R+S, antisense sequence of R+S, S+R, and antisense sequence of S+R. For example in Table 10, a pair of the repeat and spacer sequences is selected as a representative for each transposase and the potential guide-RNA sequences are constructed and listed. A guide-RNA sequence can also be generated based on the fragment of the repeat sequence and the spacer sequence. A guide-RNA sequence may be designed to comprise at least 20 nucleotides from a spacer sequence. One skilled in the art would be able to design various guide-RNAs using the CRISPR repeats and spacers identified for the transposases disclosed herein.

TABLE 10

Predicted guide-RNA sequences for the transposases.

| PRT SEQ ID | DNA SEQ ID NO | CRISPR SEQ ID NO | Repeat Within CRISPR | Repeat SEQ ID NO | Spacer Within CRISPR | Spacer SEQ ID NO | R + S SEQ ID NO | R + S Antisense SEQ ID NO | S + R SEQ ID NO | S + R Antisense SEQ ID NO |
|---|---|---|---|---|---|---|---|---|---|---|
| 124 | 1 | 628 | [197 . . . 226] | 1116 | [227 . . . 262] | 1264 | 1412 | 1560 | 1708 | 1856 |
| 125 | 2 | 629 | [197 . . . 226] | 1117 | [227 . . . 262] | 1265 | 1413 | 1561 | 1709 | 1857 |
| 126 | 3 | 630 | [107 . . . 138] | 1118 | [139 . . . 172] | 1266 | 1414 | 1562 | 1710 | 1858 |
| 127 | 4 | 631 | [174 . . . 203] | 1119 | [204 . . . 238] | 1267 | 1415 | 1563 | 1711 | 1859 |
| 128 | 5 | 636 | [174 . . . 203] | 1120 | [204 . . . 238] | 1268 | 1416 | 1564 | 1712 | 1860 |
| 129 | 6 | 637 | [174 . . . 203] | 1121 | [204 . . . 238] | 1269 | 1417 | 1565 | 1713 | 1861 |
| 129 | 6 | 637 | [303 . . . 332] | 1122 | [333 . . . 367] | 1270 | 1418 | 1566 | 1714 | 1862 |
| 130 | 7 | 641 | [174 . . . 203] | 1123 | [204 . . . 238] | 1271 | 1419 | 1567 | 1715 | 1863 |
| 131 | 8 | 646 | [51 . . . 80] | 1124 | [81 . . . 115] | 1272 | 1420 | 1568 | 1716 | 1864 |
| 132 | 9 | 647 | [239 . . . 268] | 1125 | [269 . . . 302] | 1273 | 1421 | 1569 | 1717 | 1865 |
| 133 | 10 | 652 | [239 . . . 268] | 1126 | [269 . . . 302] | 1274 | 1422 | 1570 | 1718 | 1866 |
| 134 | 11 | 653 | [304 . . . 333] | 1127 | [334 . . . 368] | 1275 | 1423 | 1571 | 1719 | 1867 |
| 135 | 12 | 655 | [172 . . . 201] | 1128 | [202 . . . 238] | 1276 | 1424 | 1572 | 1720 | 1868 |
| 136 | 304 | 662 | [107 . . . 136] | 1129 | [137 . . . 173] | 1277 | 1425 | 1573 | 1721 | 1869 |
| 137 | 14 | 677 | [241 . . . 270] | 1130 | [271 . . . 305] | 1278 | 1426 | 1574 | 1722 | 1870 |
| 138 | 15 | 678 | [240 . . . 269] | 1131 | [270 . . . 303] | 1279 | 1427 | 1575 | 1723 | 1871 |
| 139 | 16 | 679 | [240 . . . 269] | 1132 | [270 . . . 303] | 1280 | 1428 | 1576 | 1724 | 1872 |
| 140 | 17 | 680 | [51 . . . 80] | 1133 | [81 . . . 115] | 1281 | 1429 | 1577 | 1725 | 1873 |
| 141 | 18 | 686 | [51 . . . 80] | 1134 | [81 . . . 115] | 1282 | 1430 | 1578 | 1726 | 1874 |
| 142 | 19 | 689 | [171 . . . 200] | 1135 | [201 . . . 234] | 1283 | 1431 | 1579 | 1727 | 1875 |
| 143 | 20 | 690 | [174 . . . 203] | 1136 | [204 . . . 238] | 1284 | 1432 | 1580 | 1728 | 1876 |
| 144 | 21 | 695 | [51 . . . 80] | 1137 | [81 . . . 115] | 1285 | 1433 | 1581 | 1729 | 1877 |
| 145 | 22 | 810 | [174 . . . 203] | 1138 | [204 . . . 240] | 1286 | 1434 | 1582 | 1730 | 1878 |
| 146 | 23 | 811 | [248 . . . 277] | 1139 | [278 . . . 313] | 1287 | 1435 | 1583 | 1731 | 1879 |
| 147 | 24 | 812 | [109 . . . 138] | 1140 | [139 . . . 173] | 1288 | 1436 | 1584 | 1732 | 1880 |
| 148 | 25 | 813 | [51 . . . 80] | 1141 | [81 . . . 115] | 1289 | 1437 | 1585 | 1733 | 1881 |
| 149 | 26 | 814 | [172 . . . 201] | 1142 | [202 . . . 236] | 1290 | 1438 | 1586 | 1734 | 1882 |
| 150 | 27 | 816 | [58 . . . 87] | 1143 | [88 . . . 123] | 1291 | 1439 | 1587 | 1735 | 1883 |
| 151 | 28 | 817 | [239 . . . 268] | 1144 | [269 . . . 302] | 1292 | 1440 | 1588 | 1736 | 1884 |
| 152 | 29 | 820 | [306 . . . 335] | 1145 | [336 . . . 370] | 1293 | 1441 | 1589 | 1737 | 1885 |
| 153 | 30 | 821 | [51 . . . 80] | 1146 | [81 . . . 116] | 1294 | 1442 | 1590 | 1738 | 1886 |
| 154 | 31 | 822 | [237 . . . 266] | 1147 | [267 . . . 302] | 1295 | 1443 | 1591 | 1739 | 1887 |
| 155 | 32 | 824 | [173 . . . 202] | 1148 | [203 . . . 237] | 1296 | 1444 | 1592 | 1740 | 1888 |
| 156 | 33 | 825 | [108 . . . 137] | 1149 | [138 . . . 172] | 1297 | 1445 | 1593 | 1741 | 1889 |
| 157 | 34 | 827 | [51 . . . 80] | 1150 | [81 . . . 115] | 1298 | 1446 | 1594 | 1742 | 1890 |
| 158 | 35 | 829 | [109 . . . 138] | 1151 | [139 . . . 173] | 1299 | 1447 | 1595 | 1743 | 1891 |
| 159 | 36 | 830 | [171 . . . 200] | 1152 | [201 . . . 234] | 1300 | 1448 | 1596 | 1744 | 1892 |
| 160 | 37 | 831 | [177 . . . 206] | 1153 | [207 . . . 243] | 1301 | 1449 | 1597 | 1745 | 1893 |
| 161 | 38 | 837 | [51 . . . 80] | 1154 | [81 . . . 114] | 1302 | 1450 | 1598 | 1746 | 1894 |
| 162 | 39 | 838 | [174 . . . 203] | 1155 | [204 . . . 238] | 1303 | 1451 | 1599 | 1747 | 1895 |
| 163 | 40 | 839 | [115 . . . 144] | 1156 | [145 . . . 178] | 1304 | 1452 | 1600 | 1748 | 1896 |
| 164 | 41 | 840 | [115 . . . 144] | 1157 | [145 . . . 178] | 1305 | 1453 | 1601 | 1749 | 1897 |
| 165 | 42 | 841 | [51 . . . 81] | 1158 | [82 . . . 114] | 1306 | 1454 | 1602 | 1750 | 1898 |
| 166 | 43 | 843 | [51 . . . 80] | 1159 | [81 . . . 115] | 1307 | 1455 | 1603 | 1751 | 1899 |
| 167 | 44 | 844 | [51 . . . 80] | 1160 | [81 . . . 114] | 1308 | 1456 | 1604 | 1752 | 1900 |
| 168 | 45 | 845 | [174 . . . 203] | 1161 | [204 . . . 237] | 1309 | 1457 | 1605 | 1753 | 1901 |
| 169 | 46 | 846 | [237 . . . 266] | 1162 | [267 . . . 302] | 1310 | 1458 | 1606 | 1754 | 1902 |
| 170 | 47 | 847 | [174 . . . 203] | 1163 | [204 . . . 240] | 1311 | 1459 | 1607 | 1755 | 1903 |
| 171 | 461 | 849 | [174 . . . 203] | 1164 | [204 . . . 238] | 1312 | 1460 | 1608 | 1756 | 1904 |
| 172 | 49 | 856 | [173 . . . 202] | 1165 | [203 . . . 237] | 1313 | 1461 | 1609 | 1757 | 1905 |
| 173 | 50 | 857 | [107 . . . 136] | 1166 | [137 . . . 173] | 1314 | 1462 | 1610 | 1758 | 1906 |
| 174 | 51 | 859 | [173 . . . 202] | 1167 | [203 . . . 237] | 1315 | 1463 | 1611 | 1759 | 1907 |
| 175 | 52 | 862 | [107 . . . 136] | 1168 | [137 . . . 173] | 1316 | 1464 | 1612 | 1760 | 1908 |
| 176 | 53 | 866 | [174 . . . 203] | 1169 | [204 . . . 240] | 1317 | 1465 | 1613 | 1761 | 1909 |
| 177 | 54 | 875 | [177 . . . 206] | 1170 | [207 . . . 243] | 1318 | 1466 | 1614 | 1762 | 1910 |
| 178 | 55 | 876 | [177 . . . 206] | 1171 | [207 . . . 243] | 1319 | 1467 | 1615 | 1763 | 1911 |
| 179 | 56 | 879 | [177 . . . 206] | 1172 | [207 . . . 243] | 1320 | 1468 | 1616 | 1764 | 1912 |
| 180 | 57 | 901 | [177 . . . 206] | 1173 | [207 . . . 243] | 1321 | 1469 | 1617 | 1765 | 1913 |
| 181 | 58 | 902 | [51 . . . 80] | 1174 | [81 . . . 116] | 1322 | 1470 | 1618 | 1766 | 1914 |
| 182 | 59 | 903 | [109 . . . 138] | 1175 | [139 . . . 173] | 1323 | 1471 | 1619 | 1767 | 1915 |
| 183 | 60 | 904 | [177 . . . 206] | 1176 | [207 . . . 243] | 1324 | 1472 | 1620 | 1768 | 1916 |
| 184 | 61 | 905 | [175 . . . 204] | 1177 | [205 . . . 241] | 1325 | 1473 | 1621 | 1769 | 1917 |
| 185 | 62 | 906 | [180 . . . 209] | 1178 | [210 . . . 246] | 1326 | 1474 | 1622 | 1770 | 1918 |

TABLE 10-continued

Predicted guide-RNA sequences for the transposases.

| PRT SEQ ID | DNA SEQ ID NO | CRISPR SEQ ID NO | Repeat Within CRISPR | Repeat SEQ ID NO | Spacer Within CRISPR | Spacer SEQ ID NO | R + S SEQ ID NO | R + S Antisense SEQ ID NO | S + R SEQ ID NO | S + R Antisense SEQ ID NO |
|---|---|---|---|---|---|---|---|---|---|---|
| 186 | 63 | 907 | [109 . . . 146] | 1179 | [147 . . . 174] | 1327 | 1475 | 1623 | 1771 | 1919 |
| 187 | 64 | 909 | [51 . . . 80] | 1180 | [81 . . . 116] | 1328 | 1476 | 1624 | 1772 | 1920 |
| 188 | 65 | 910 | [51 . . . 80] | 1181 | [81 . . . 116] | 1329 | 1477 | 1625 | 1773 | 1921 |
| 189 | 66 | 923 | [107 . . . 136] | 1182 | [137 . . . 172] | 1330 | 1478 | 1626 | 1774 | 1922 |
| 190 | 67 | 924 | [51 . . . 81] | 1183 | [82 . . . 115] | 1331 | 1479 | 1627 | 1775 | 1923 |
| 191 | 68 | 925 | [109 . . . 139] | 1184 | [140 . . . 172] | 1332 | 1480 | 1628 | 1776 | 1924 |
| 191 | 68 | 926 | [105 . . . 134] | 1185 | [135 . . . 169] | 1333 | 1481 | 1629 | 1777 | 1925 |
| 192 | 69 | 927 | [51 . . . 81] | 1186 | [82 . . . 115] | 1334 | 1482 | 1630 | 1778 | 1926 |
| 193 | 519 | 929 | [51 . . . 80] | 1187 | [81 . . . 115] | 1335 | 1483 | 1631 | 1779 | 1927 |
| 194 | 71 | 934 | [182 . . . 212] | 1188 | [213 . . . 246] | 1336 | 1484 | 1632 | 1780 | 1928 |
| 195 | 72 | 945 | [51 . . . 80] | 1189 | [81 . . . 117] | 1337 | 1485 | 1633 | 1781 | 1929 |
| 196 | 73 | 946 | [51 . . . 81] | 1190 | [82 . . . 116] | 1338 | 1486 | 1634 | 1782 | 1930 |
| 196 | 73 | 947 | [170 . . . 199] | 1191 | [200 . . . 236] | 1339 | 1487 | 1635 | 1783 | 1931 |
| 197 | 532 | 949 | [51 . . . 80] | 1192 | [81 . . . 117] | 1340 | 1488 | 1636 | 1784 | 1932 |
| 197 | 532 | 950 | [51 . . . 80] | 1193 | [81 . . . 114] | 1341 | 1489 | 1637 | 1785 | 1933 |
| 198 | 547 | 971 | [51 . . . 81] | 1194 | [82 . . . 116] | 1342 | 1490 | 1638 | 1786 | 1934 |
| 199 | 76 | 983 | [110 . . . 139] | 1195 | [140 . . . 173] | 1343 | 1491 | 1639 | 1787 | 1935 |
| 200 | 77 | 984 | [51 . . . 80] | 1196 | [81 . . . 117] | 1344 | 1492 | 1640 | 1788 | 1936 |
| 201 | 78 | 985 | [115 . . . 144] | 1197 | [145 . . . 180] | 1345 | 1493 | 1641 | 1789 | 1937 |
| 201 | 78 | 986 | [51 . . . 80] | 1198 | [81 . . . 116] | 1346 | 1494 | 1642 | 1790 | 1938 |
| 202 | 79 | 993 | [51 . . . 80] | 1199 | [81 . . . 117] | 1347 | 1495 | 1643 | 1791 | 1939 |
| 202 | 79 | 994 | [51 . . . 80] | 1200 | [81 . . . 116] | 1348 | 1496 | 1644 | 1792 | 1940 |
| 203 | 80 | 995 | [51 . . . 80] | 1201 | [81 . . . 116] | 1349 | 1497 | 1645 | 1793 | 1941 |
| 204 | 81 | 996 | [106 . . . 135] | 1202 | [136 . . . 172] | 1350 | 1498 | 1646 | 1794 | 1942 |
| 205 | 82 | 997 | [105 . . . 136] | 1203 | [137 . . . 169] | 1351 | 1499 | 1647 | 1795 | 1943 |
| 206 | 83 | 999 | [106 . . . 135] | 1204 | [136 . . . 172] | 1352 | 1500 | 1648 | 1796 | 1944 |
| 207 | 84 | 1000 | [181 . . . 209] | 1205 | [210 . . . 246] | 1353 | 1501 | 1649 | 1797 | 1945 |
| 208 | 85 | 1001 | [180 . . . 209] | 1206 | [210 . . . 246] | 1354 | 1502 | 1650 | 1798 | 1946 |
| 209 | 86 | 1002 | [180 . . . 209] | 1207 | [210 . . . 246] | 1355 | 1503 | 1651 | 1799 | 1947 |
| 210 | 87 | 1005 | [106 . . . 135] | 1208 | [136 . . . 172] | 1356 | 1504 | 1652 | 1800 | 1948 |
| 211 | 88 | 1025 | [172 . . . 201] | 1209 | [202 . . . 238] | 1357 | 1505 | 1653 | 1801 | 1949 |
| 212 | 89 | 1027 | [183 . . . 212] | 1210 | [213 . . . 247] | 1358 | 1506 | 1654 | 1802 | 1950 |
| 212 | 89 | 1028 | [110 . . . 139] | 1211 | [140 . . . 175] | 1359 | 1507 | 1655 | 1803 | 1951 |
| 213 | 90 | 1029 | [118 . . . 147] | 1212 | [148 . . . 182] | 1360 | 1508 | 1656 | 1804 | 1952 |
| 213 | 90 | 1030 | [51 . . . 80] | 1213 | [81 . . . 116] | 1361 | 1509 | 1657 | 1805 | 1953 |
| 214 | 91 | 1040 | [182 . . . 212] | 1214 | [213 . . . 246] | 1362 | 1510 | 1658 | 1806 | 1954 |
| 214 | 91 | 1041 | [51 . . . 80] | 1215 | [81 . . . 116] | 1363 | 1511 | 1659 | 1807 | 1955 |
| 215 | 92 | 1042 | [51 . . . 80] | 1216 | [81 . . . 117] | 1364 | 1512 | 1660 | 1808 | 1956 |
| 216 | 93 | 1043 | [118 . . . 147] | 1217 | [148 . . . 182] | 1365 | 1513 | 1661 | 1809 | 1957 |
| 217 | 94 | 1051 | [117 . . . 146] | 1218 | [147 . . . 182] | 1366 | 1514 | 1662 | 1810 | 1958 |
| 218 | 95 | 1052 | [51 . . . 80] | 1219 | [81 . . . 117] | 1367 | 1515 | 1663 | 1811 | 1959 |
| 218 | 95 | 1053 | [116 . . . 146] | 1220 | [147 . . . 179] | 1368 | 1516 | 1664 | 1812 | 1960 |
| 219 | 96 | 1054 | [106 . . . 135] | 1221 | [136 . . . 171] | 1369 | 1517 | 1665 | 1813 | 1961 |
| 220 | 97 | 1055 | [51 . . . 81] | 1222 | [82 . . . 117] | 1370 | 1518 | 1666 | 1814 | 1962 |
| 221 | 98 | 679 | [240 . . . 269] | 1132 | [270 . . . 303] | 1280 | 1428 | 1576 | 1724 | 1872 |
| 222 | 99 | 647 | [239 . . . 268] | 1125 | [269 . . . 302] | 1273 | 1421 | 1569 | 1717 | 1865 |
| 223 | 595 | 653 | [304 . . . 333] | 1127 | [334 . . . 368] | 1275 | 1423 | 1571 | 1719 | 1867 |
| 224 | 101 | 1057 | [118 . . . 150] | 1223 | [151 . . . 184] | 1371 | 1519 | 1667 | 1815 | 1963 |
| 225 | 598 | 1058 | [116 . . . 144] | 1224 | [145 . . . 180] | 1372 | 1520 | 1668 | 1816 | 1964 |
| 226 | 103 | 1060 | [247 . . . 275] | 1225 | [276 . . . 310] | 1373 | 1521 | 1669 | 1817 | 1965 |
| 227 | 104 | 1061 | [247 . . . 275] | 1226 | [276 . . . 310] | 1374 | 1522 | 1670 | 1818 | 1966 |
| 228 | 105 | 1062 | [195 . . . 226] | 1227 | [227 . . . 261] | 1375 | 1523 | 1671 | 1819 | 1967 |
| 229 | 106 | 1063 | [120 . . . 151] | 1228 | [152 . . . 186] | 1376 | 1524 | 1672 | 1820 | 1968 |
| 230 | 107 | 1064 | [60 . . . 91] | 1229 | [92 . . . 125] | 1377 | 1525 | 1673 | 1821 | 1969 |
| 230 | 107 | 1065 | [120 . . . 151] | 1230 | [152 . . . 189] | 1378 | 1526 | 1674 | 1822 | 1970 |
| 231 | 108 | 1066 | [118 . . . 149] | 1231 | [150 . . . 183] | 1379 | 1527 | 1675 | 1823 | 1971 |
| 231 | 108 | 1067 | [118 . . . 149] | 1232 | [150 . . . 182] | 1380 | 1528 | 1676 | 1824 | 1972 |
| 232 | 600 | 1070 | [117 . . . 148] | 1233 | [149 . . . 184] | 1381 | 1529 | 1677 | 1825 | 1973 |
| 233 | 110 | 1072 | [117 . . . 148] | 1234 | [149 . . . 181] | 1382 | 1530 | 1678 | 1826 | 1974 |
| 233 | 110 | 1073 | [115 . . . 146] | 1235 | [147 . . . 179] | 1383 | 1531 | 1679 | 1827 | 1975 |
| 234 | 111 | 1074 | [117 . . . 148] | 1236 | [149 . . . 181] | 1384 | 1532 | 1680 | 1828 | 1976 |
| 234 | 111 | 1075 | [51 . . . 82] | 1237 | [83 . . . 117] | 1385 | 1533 | 1681 | 1829 | 1977 |
| 235 | 112 | 1076 | [117 . . . 148] | 1238 | [149 . . . 181] | 1386 | 1534 | 1682 | 1830 | 1978 |
| 236 | 113 | 1077 | [187 . . . 218] | 1239 | [219 . . . 252] | 1387 | 1535 | 1683 | 1831 | 1979 |
| 237 | 114 | 1078 | [118 . . . 149] | 1240 | [150 . . . 183] | 1388 | 1536 | 1684 | 1832 | 1980 |
| 237 | 114 | 1079 | [51 . . . 83] | 1241 | [84 . . . 116] | 1389 | 1537 | 1685 | 1833 | 1981 |
| 238 | 115 | 1081 | [112 . . . 136] | 1242 | [137 . . . 176] | 1390 | 1538 | 1686 | 1834 | 1982 |
| 239 | 116 | 1082 | [51 . . . 79] | 1243 | [80 . . . 115] | 1391 | 1539 | 1687 | 1835 | 1983 |
| 240 | 117 | 1083 | [51 . . . 77] | 1244 | [78 . . . 111] | 1392 | 1540 | 1688 | 1836 | 1984 |
| 241 | 118 | 1084 | [116 . . . 150] | 1245 | [151 . . . 181] | 1393 | 1541 | 1689 | 1837 | 1985 |
| 241 | 118 | 1085 | [190 . . . 226] | 1246 | [227 . . . 255] | 1394 | 1542 | 1690 | 1838 | 1986 |
| 242 | 119 | 1088 | [172 . . . 191] | 1247 | [192 . . . 237] | 1395 | 1543 | 1691 | 1839 | 1987 |

TABLE 10-continued

Predicted guide-RNA sequences for the transposases.

| PRT SEQ ID NO | DNA SEQ ID NO | CRISPR SEQ ID NO | Repeat Within CRISPR | Repeat SEQ ID NO | Spacer Within CRISPR | Spacer SEQ ID NO | R + S SEQ ID NO | R + S Antisense SEQ ID NO | S + R SEQ ID NO | S + R Antisense SEQ ID NO |
|---|---|---|---|---|---|---|---|---|---|---|
| 243 | 120 | 1089 | [51 ... 78] | 1248 | [79 ... 115] | 1396 | 1544 | 1692 | 1840 | 1988 |
| 244 | 121 | 1090 | [51 ... 78] | 1249 | [79 ... 115] | 1397 | 1545 | 1693 | 1841 | 1989 |
| 245 | 122 | 1091 | [51 ... 78] | 1250 | [79 ... 115] | 1398 | 1546 | 1694 | 1842 | 1990 |
| 246 | 123 | 1092 | [51 ... 69] | 1251 | [70 ... 107] | 1399 | 1547 | 1695 | 1843 | 1991 |
| 276 | 605 | 1093 | [111 ... 134] | 1252 | [135 ... 171] | 1400 | 1548 | 1696 | 1844 | 1992 |
| 277 | 606 | 1094 | [106 ... 135] | 1253 | [136 ... 172] | 1401 | 1549 | 1697 | 1845 | 1993 |
| 278 | 612 | 1100 | [106 ... 135] | 1254 | [136 ... 172] | 1402 | 1550 | 1698 | 1846 | 1994 |
| 279 | 613 | 1101 | [107 ... 136] | 1255 | [137 ... 172] | 1403 | 1551 | 1699 | 1847 | 1995 |
| 280 | 614 | 1102 | [51 ... 82] | 1256 | [83 ... 116] | 1404 | 1552 | 1700 | 1848 | 1996 |
| 281 | 615 | 1103 | [51 ... 80] | 1257 | [81 ... 116] | 1405 | 1553 | 1701 | 1849 | 1997 |
| 282 | 622 | 1110 | [51 ... 80] | 1258 | [81 ... 115] | 1406 | 1554 | 1702 | 1850 | 1998 |
| 283 | 623 | 1111 | [106 ... 135] | 1259 | [136 ... 172] | 1407 | 1555 | 1703 | 1851 | 1999 |
| 284 | 624 | 1112 | [118 ... 149] | 1260 | [150 ... 186] | 1408 | 1556 | 1704 | 1852 | 2000 |
| 285 | 625 | 1113 | [51 ... 82] | 1261 | [83 ... 116] | 1409 | 1557 | 1705 | 1853 | 2001 |
| 286 | 626 | 1114 | [115 ... 146] | 1262 | [147 ... 179] | 1410 | 1558 | 1706 | 1854 | 2002 |
| 287 | 627 | 1115 | [148 ... 171] | 1263 | [172 ... 195] | 1411 | 1559 | 1707 | 1855 | 2003 |

Protein Domain Analysis

Figure 4:
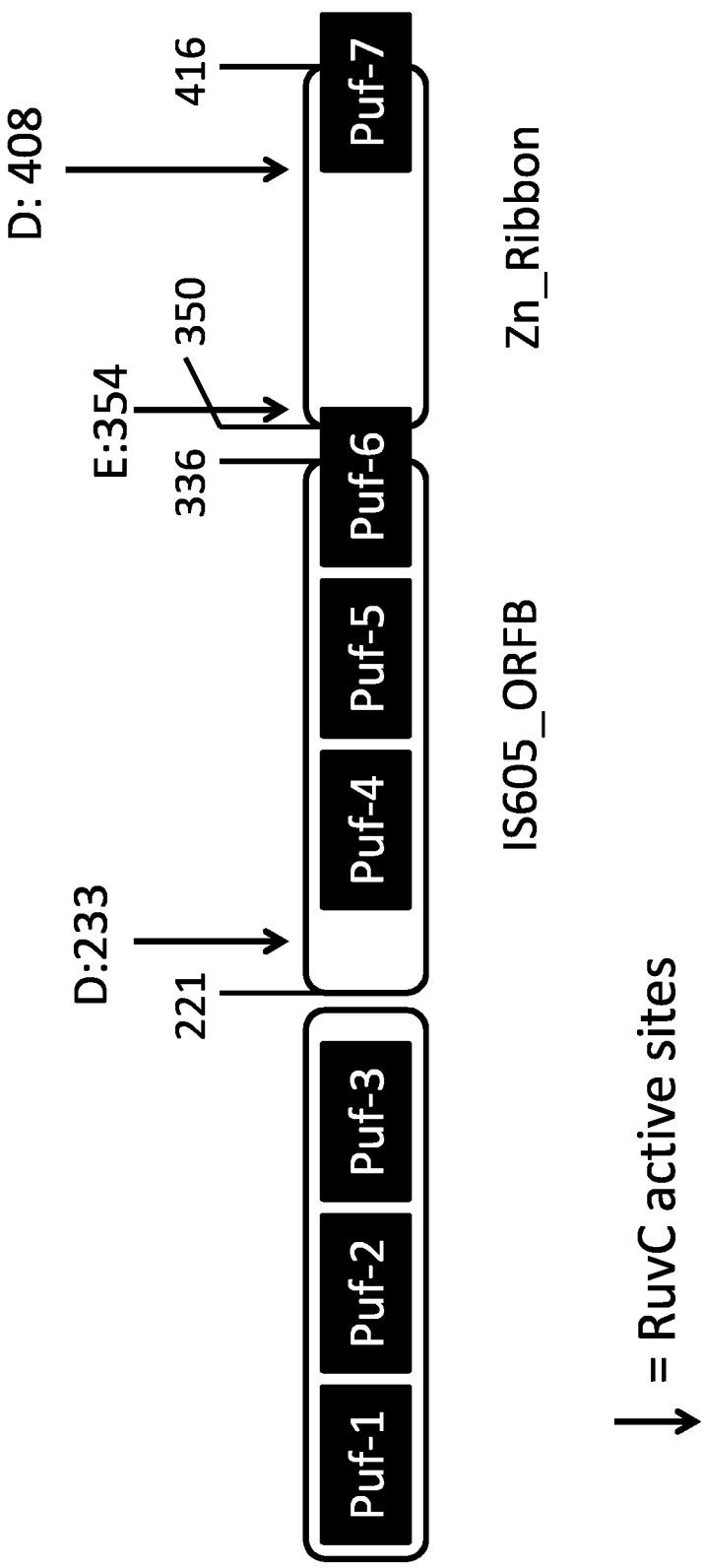
FIG. 4 shows a diagram of the predicted protein domain structure of the CRISPR-associated transposase of SEQ ID NO: 136 (DNA: SEQ ID NO: 304). Seven Puf (Pumilio-family RNA binding repeat) domains are predicted and labeled as Puf-1 to Puf-7. The protein is also predicted to contain an IS605_ORFB domain (amino acids 221-336), and a Zn_Ribbon domain (amino acids 350-416). The conserved RuvC catalytic sites in the split RuvC I, II, and III regions are indicated by D233, E354, and D408, respectively.

The cluster 1 members (104 unique proteins), including the CRISPR-associated transposase of SEQ ID NO: 136 (DNA: SEQ ID NO: 304), all have a central OrfB_IS605 (Insertion Element 605) and a C-terminal OrfB_Zn_ribbon domain. In addition, most members (102 unique proteins) also comprise Puf domains. The Insertion Element (IS) 605 or TnpB contains a split RuvC endonuclease domain and is considered a progenitor of Cpf1 and C2C1 proteins (Kapitonov, 2016). The RuvC domain provides the endonuclease activity of these enzymes. Proteins containing Zn-ribbon domains are thought to bind DNA. The CRISPR-associated transposases were analyzed for the presence of RuvC catalytic domains based on sequence alignment with split RuvC regions described in literature. Using the CRISPR-associated transposase of SEQ ID NO: 136 (DNA: SEQ ID NO: 304) as an example, a RuvC I and RuvC III regions with conserved catalytic "D" amino acids (position 233 and 408) and the RuvC II region with a conserved 'E' amino acid (position 354) were identified, and these three conserved residues are indicated in FIG. 4.

Puf domains (Pumilio-family RNA binding repeat) have been reported in eukaryotic RNA binding proteins. They usually, but not always, occur in tandem repeats of 8 and bind to a sequence specific 8 bp RNA binding motif. Each Puf domain forms a helical hairpin with a short helix preceding it (Yin, 2013). Each domain binds to one of the 8 nucleotides in the consensus binding site—5'-UGUA-NAUA-3' (Zhang and Muench, 2015). In addition to Pfam analysis, the protein structure prediction software, PSIPRED, was used to predict helical structures and identify additional Puf domains. For the CRISPR-associated transposase of SEQ ID NO: 136 (DNA: SEQ ID NO: 304), seven putative Puf domains were identified and their domain structures are outlined in FIG. 4, relative to the OrfB_IS605 and OrfB_Zn_ribbon domains, and the RuvC active sites. The domain annotations and sequences are further described for this CRISPR-associated transposase in FIG. 5 where each Puf domain sequence is underlined and the two Pfam domains—IS605 and Zn ribbon are enclosed by brackets [ ] and double brackets [[ ]], respectively.

Since Puf domains are known to bind the highly conserved consensus RNA sequence (5'-UGUANAUA-3'), the CRISPR repeats associated with the transposases (SEQ ID NOs: 124-246, 275-287) were searched for the presence of the consensus Puf binding motif. As depicted in FIG. 6 for the CRISPR-associated transposase of SEQ ID NO: 136 (DNA: SEQ ID NO: 304), the sequence alignment across the associated CRISPR repeats shows a highly conserved motif that is similar to Puf binding motifs. The observed consensus Puf motif in the CRISPR-associated transposase of SEQ ID NO: 136 (DNA: SEQ ID NO: 304) is also highly conserved across repeat sequences from other members in cluster 1. The identified protein domain structure and the putative Puf binding motif suggests that the CRISPR-associated transposase not SEQ ID NO: 136 (DNA: SEQ ID NO: 304) is a nuclease with RNA and DNA binding activity.

Example 3

A high through-put assay is conducted to determine if the identified CRISPR-associated transposases (a) have RNA-guided DNA nuclease activity, and (b) to identify the associated PAM motifs. This assay is generally applicable to RNA-Guided EndoNuclease (RGEN) proteins, which refer to DNA modifying enzyme that (1) includes endonucleolytic activity, and (2) are associated with a non-coding RNA species that is capable of guiding the RGENs to specific DNA target sites for enzymatic activity. Many of these enzymes may have, beyond endonuclease activity, other functions, which include, but are not limited to transposases, topoisomerases, recombinases, and resolvases.

A bacterial genomic region of interest (ROI) including a DNA sequence encoding a CRISPR-associated transposase represented by SEQ ID NOs: 124-246, 275-287 and the associated RNA species in its native genomic environment was cloned into a bacterial expression plasmid. Another LacZ reporter plasmid was also built for each RGEN system, which included one or more of the spacer sequences identified in the CRISPR array associated with the individual transposase. The spacer(s) sequence in each LacZ reporter plasmid was flanked at both ends by 12 nucleotides of randomized sequence. The LacZ reporter plasmids contain a low-copy replication origin and a selectable marker that is different from that of the plasmids encoding the CRISPR-associated transposases to allow selection for co-transformants.

Figure 7:
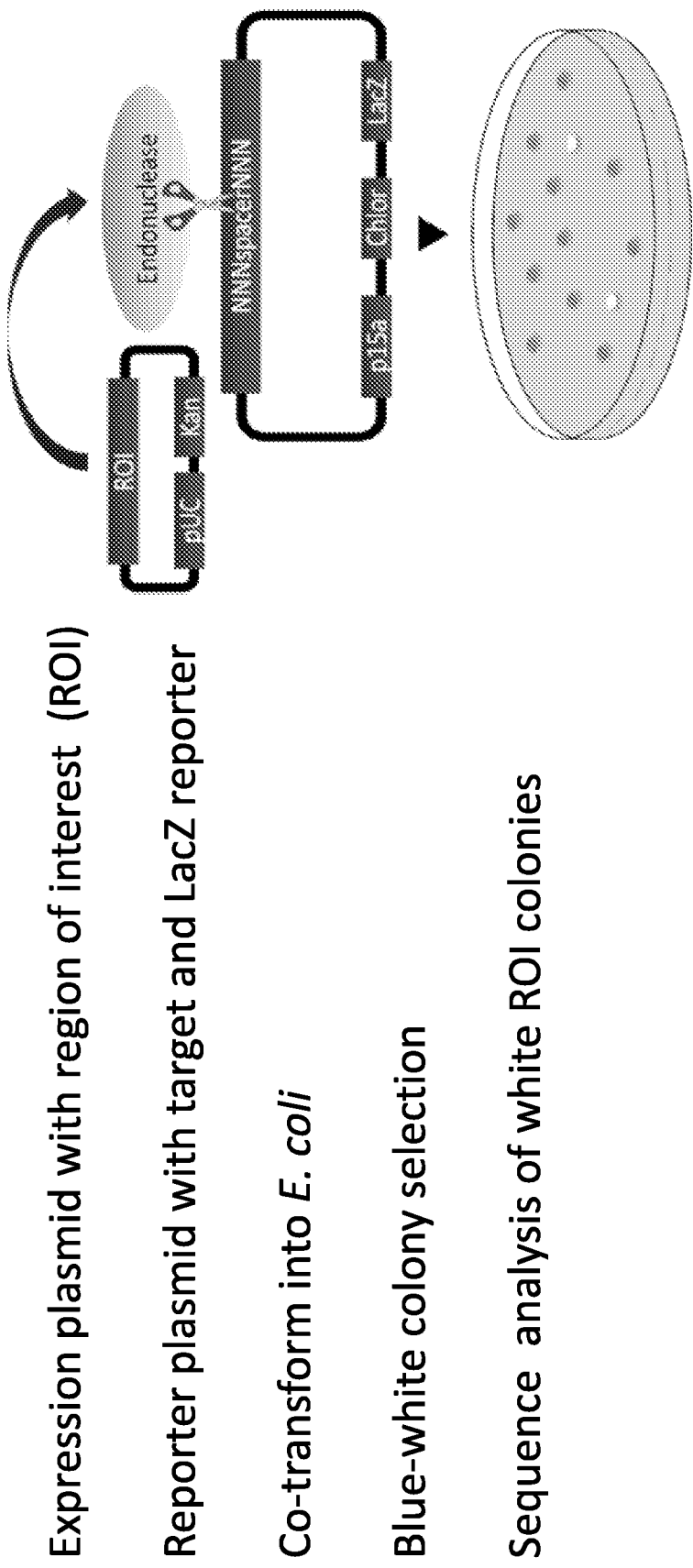
FIG. 7 shows a diagram of an *Escherichia coli* based blue-white selection assay to screen for nuclease activity. A bacterial expression plasmid generated using a pUC19 (pUC) vector with a kanamycin (kan) selection marker was used to clone a region of interest (ROI) encoding a putative transposase and associated guide-RNA. A reporter plasmid was also generated that contained a target sequence encoding a spacer from the CRISPR region, which is flanked by variable sequence (indicated by NNNspacerNNN), a lacZ reporter gene, a chloramphenicol selection cassette (chlor), and a low-copy number bacterial promoter (p15a). The two plasmids were co-transformed into *E. coli*, and the presence of white colonies indicates cutting by the transposase. Sequence analysis of plasmid recovered from white colonies is used to confirm the nuclease activity.

The ROI expression plasmid and the LacZ reporter plasmid were co-transformed into *E. coli*. Upon expression of the ROI elements (CRISPR-associated transposase and associated guide-RNA), and when the variable region of the LacZ reporter plasmid includes a functional PAM 5' or 3' to the spacer for the CRISPR-associated transposase, the DNA nuclease activity will introduce double-strand breaks (DSBs) in the reporter plasmids, resulting in a reduction of the LacZ reporter plasmid copy number within the cells. Reduction of reporter plasmids is detected by phenotypic changes of the resulting bacterial colony. Specifically, in normal colonies without nuclease activity, the colonies are dark blue and large. In contrast, in colonies with activity of the CRISPR-associated transposase on the reporter plasmid, the colonies are small and light blue or white in color. This assay design is illustrated in FIG. 7. This assay identifies CRISPR-associated transposase systems where the initial endonuclease cleavage is not followed by subsequent re-ligation of the broken ends and thus the linearized reporter plasmids are eliminated by bacterial endogenous nucleases. For RNA-guided nucleases (RGENs) that have additional functions, such as transposase activity, additional mutations may be introduced before the reporter plasmid is re-ligated, and thus the selectable marker and reporter genes may not be affected. In these latter cases, high-throughout sequencing of the reporter plasmids recovered from the surviving colonies would reveal additional mutations.

Figure 8:
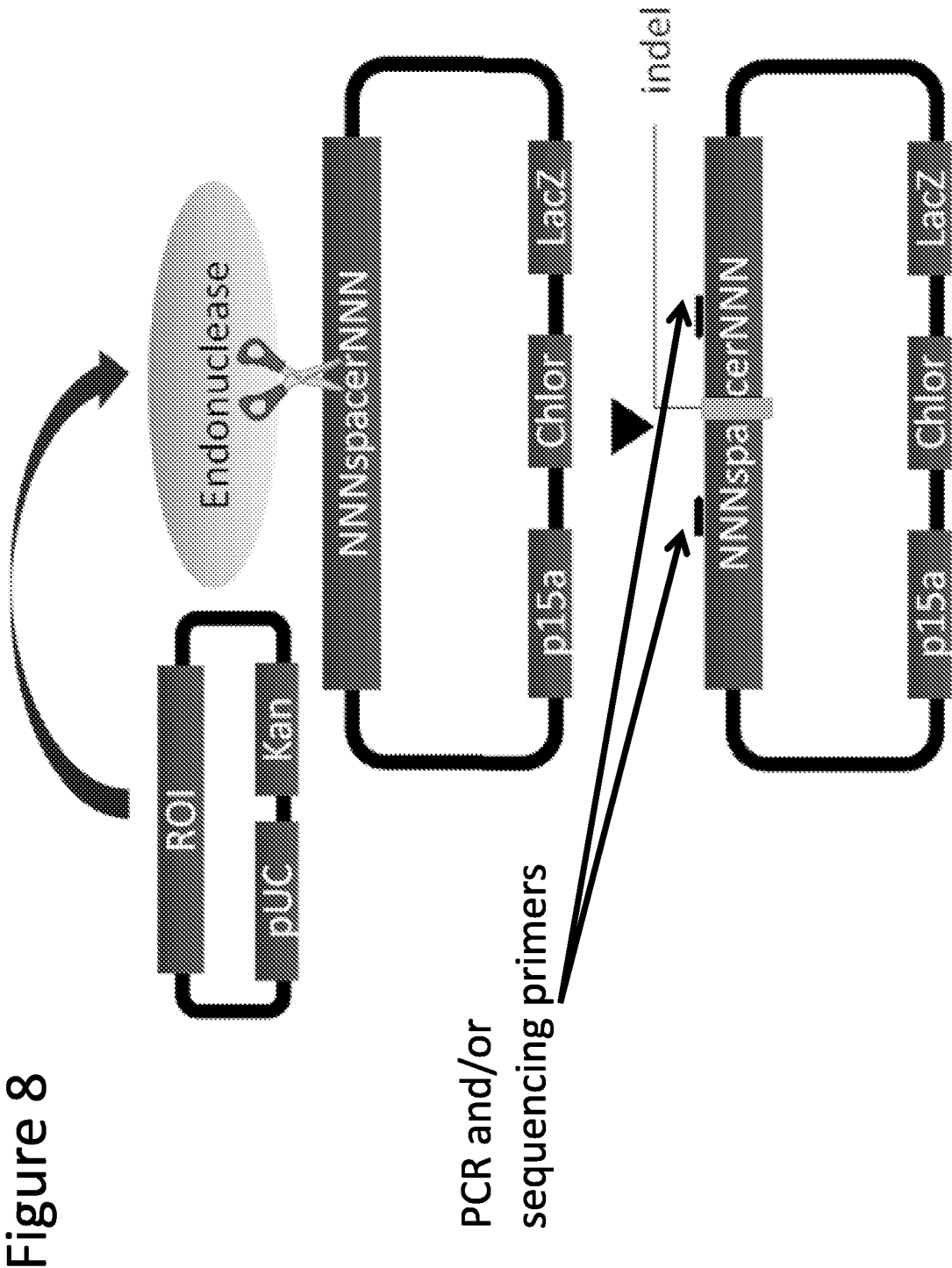
FIG. 8 shows a diagram of *Mycobacterium* cutting assay to validate nuclease activity of CRISPR-associated transposases. The same expression and reporter plasmids used for the *E. coli* blue-white selection of FIG. 7 are used to co-transform *Mycobacterium*. Due to endogenous plasmid repair in *Mycobacterium*, repair of double-strand breaks in the LacZ reporter plasmid results in insertions and deletions indels at the repair site. The presence of indels in the LacZ vector is indicative of nuclease activity. PCR and/or sequencing primers designed to the spacer cassette are used to detect indels in recovered reporter plasmids.

Broken plasmid DNAs are eliminated by host-derived endogenous nucleases in *E. coli*, which facilitates the blue-white selection described above, and illustrated in FIG. 7A. However, another group of prokaryotes, namely *Mycobacterium* spp. carries a different DNA repair mechanism, called non-homologous end-joining, which would heal the cut plasmid in an error-prone fashion (FIG. 8). This mechanism could be utilized to identify efficacious CRISPR-associated transposase systems by detecting either integration of a short oligonucleotide or point mutations at the target site by PCR amplification and/or sequencing of recovered reporter plasmids of surviving *Mycobacterium* colonies which are co-transformed with the expression and reporter plasmids. This assay is used as an alternative of the blue-white selection assay.

Example 4

A eukaryotic cell is transformed with an expression vector comprising a heterologous promoter operably linked to a sequence encoding one of the CRISPR-associated transposases selected from SEQ ID NOs: 124-246, 275-287, and a sequence encoding a RNA guide comprising a sequence targeting an endogenous genomic sequence of the eukaryotic cell. The CRISPR-associated transposase complexed with the guide RNA cleaves the genomic DNA at the target site and indel mutations are created by improper repair. Mutations are detected by sequencing.

Example 5

A eukaryotic cell is transformed with an expression vector comprising a heterologous promoter operably linked to a sequence encoding a CRISPR-associated transposase selected from SEQ ID NOs: 124-246, 275-287, and a sequence encoding an RNA guide comprising a sequence targeting an endogenous sequence of the cell. A donor polynucleotide comprising an exogenous transgene or a sequence for templated editing is further provided to the cell. The CRISPR-associated transposase complexed with the guide RNA cleaves the genomic DNA at the target site and the donor polynucleotide is incorporated by non-homologous end-joining or homologous recombination. Integrations are detected by sequencing amplicons spanning the chromosome-oligo junctions (e.g., FIG. 10).

Example 6: In Vitro Cutting Assay

Figure 9:
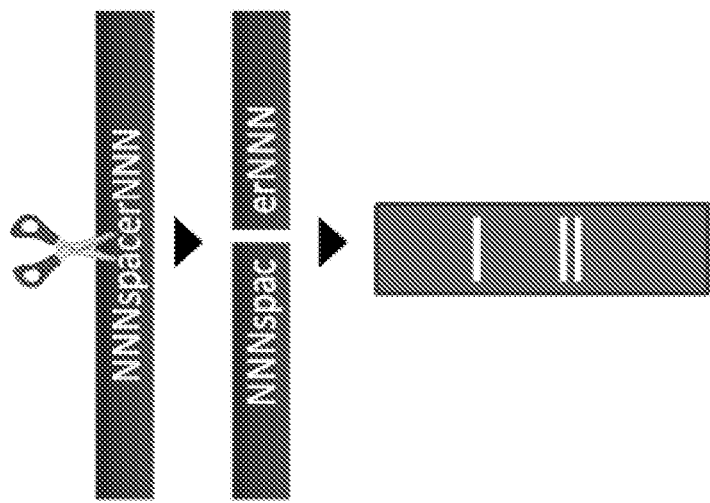
FIG. 9 shows a diagram of an in vitro cutting assay. The region comprising the CRISPR-associated transposase is cloned into an expression vector and the transposase is expressed in *E. coli* and the purified protein is incubated in vitro with the DNA target for cutting (NNNspacerNNN). The resulting DNA is (a) analyzed for fragment length by gel electrophoresis, and (b) by sequence analysis.

A sequence encoding one of the CRISPR-associated transposase proteins encoded by SEQ ID NOs: 124-246 and 275-287 is cloned into a bacterial expression plasmid, the expression plasmid is transformed into *E. coli*, the bacteria are harvested, a bacterial lysate is prepared, and the enzyme is purified from the bacterial lysate. The corresponding genomic region of interest (ROI) including CRISPR components associated with the transposase are cloned into a high-copy plasmid, which is transformed into *E. coli*, and RNA components associated with the transposase of interest encoded on the ROI construct are identified by RNA-seq of the bacterial lysate. These RNA components are synthesized, and the transposase protein and synthetic RNA components are combined in vitro, the resulting transposase/RNA complexes are added to synthetic DNA fragments carrying the spacer sequences as shown in FIG. 9. The DNA fragments are collected for sequencing to determine cutting.

Example 7: Determination and Validation of PAM Motif of a RNA-Guided DNA Nuclease A bacterial genomic region of interest (ROI) including one of the DNA sequences encoding a CRISPR-associated transposase represented by SEQ ID NOs: 124-246 and 275-287, and the associated CRISPR RNA components associated with the transposase of interest in its native genomic environment is cloned into a first bacterial expression plasmid which comprises a first antibiotic resistance gene, such as kanamycin resistance (Kan). A second bacterial plasmid comprising a second antibiotic resistance gene, for example tetracycline or chloramphenicol, is constructed such that the plasmid contains a spacer flanked both 5' and 3' by 12 bp of randomly selected nucleotides (Ns). The two plasmids are transformed into *E. coli* and plated on two plates: (1) containing media with a single antibiotic for selection of the first plasmid; and (2) containing antibiotics for selection against both the first and second plasmid. Plasmid DNA is prepared from bacteria grown on both sets of plates, PCR amplification of the spacer with flanking N sequence is conducted, and the PCR amplions are deep sequenced to identify sequences which are depleted from the library. These sequences corresponding to the depleted sequence correspond to the PAM motif recognized by the respective CRISPR-associated transposase which was co-transformed.

Alternatively, the PAM preferences for a CRISPR-associated transposase can be empirically examined and determined by using a method relying on the in vitro cleavage of plasmid libraries containing a randomized PAM (3' PAM or 5' PAM library) as a function of Nuclease-guide RNA complex (Karvelis, 2015; Shmakov, 2015). Randomized PAM plasmid libraries are constructed using synthesized oligonucleotides (ssDNA) consisting of seven randomized nucleotides either upstream or downstream of a spacer target. The randomized ssDNA oligos are made double stranded (dsDNA) by annealing to a short primer and synthesizing the second strand in vitro, for example, by providing a Klenow enzyme to the in vitro synthesis reaction. The dsDNA product is assembled into a linearized pUC19 plasmid using any standard molecular biology cloning method. *E. coli* are transformed with the cloned products, several bacterial colonies are collected and pooled. Plasmid DNA is harvested using a QIAGEN® plasmid Maxi kit. The pooled library is co-transformed into *E. coli* with a CRISPR-associated transposase locus. After transformation, cells are plated and selected with antibiotic. After 16 hr of growth, >4×10$^6$ cells are harvested and plasmid DNA is extracted using a QIAGEN® Maxi kit. The target PAM region is amplified and sequenced using an Illumina MiSeq® with single-end 150 cycles. Sequences corresponding to both PAMs and non-PAMs are cloned into pUC19 vectors. Competent *E. coli* with either the plasmid comprising the CRISPR-associated transposase locus or a pACYC184 control plasmid are transformed with PAM plasmid and plated on LB agar plates supplemented with ampicillin and chloramphenicol. After 18 hr, colonies were counted with OpenCFU (Geissmann, 2013).

Figure 11:
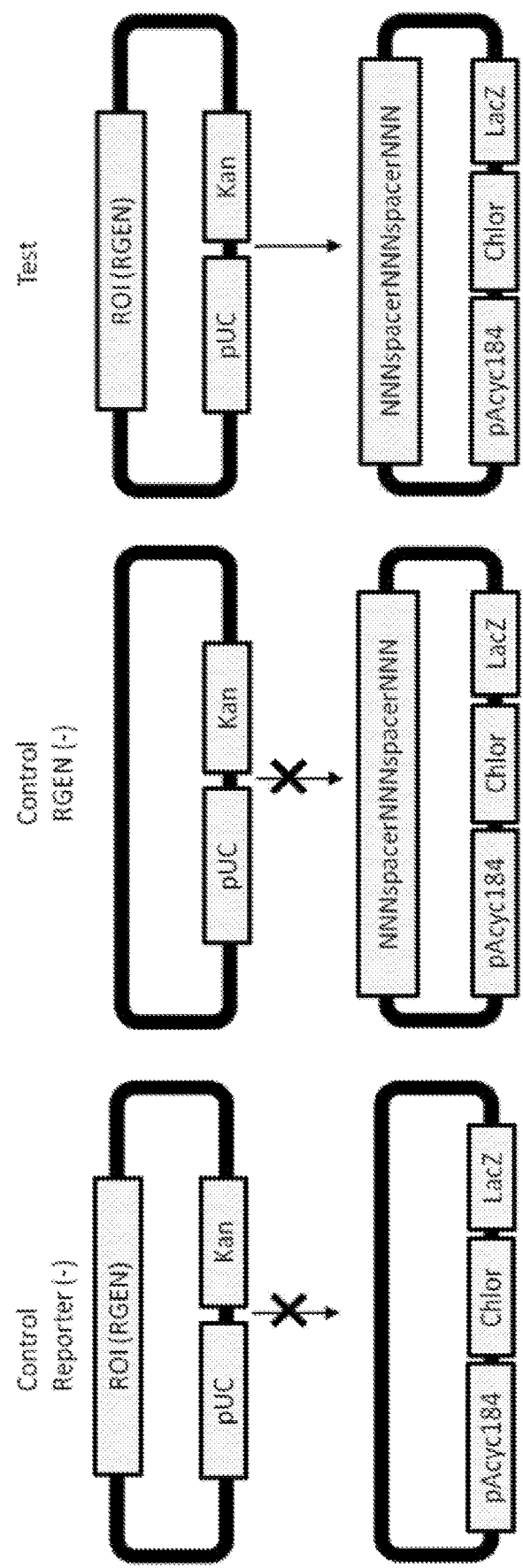
FIG. 11 shows a diagram of prokaryotic blue-white selection assay design for the validation of CRISPR-associated transposase activity. The top row shows diagrams of the vectors used for CRISPR-associated transposase (RGEN) expression. The bottom row shows diagrams of the vectors containing the putative target sequence (NNNspacerNNNspacerNNN) and the LacZ marker. The left top and bottom pair are the control lacking the target sequence. The middle top and bottom pair are the control lacking the CRISPR-associated transposase (RGEN). The right top and bottom pair are the test assay with the respective vectors containing the CRISPR-associated transposase (RGEN) and the target sequence.

Example 8: Validation of RNA-Guided DNA Nuclease Activity for CRISPR-Associated Transposases Using Blue-White Selection A phenotypic assay is conducted to determine if CRISPR-associated transposases identified herein have RNA-guided DNA nuclease activity. The design of this assay is essentially as detailed in Example 3. A bacterial genomic region of interest (ROI) (SEQ ID NO: 2019) comprising the DNA sequence (SEQ ID NO: 304) encoding the CRISPR-associated transposase of SEQ ID NO: 136 and the associated CRISPR RNA species in its native genomic environment was cloned into a plasmid. Another 'reporter' plasmid comprising two of the spacer sequences (SEQ ID NOs: 2017 and 2018) identified in the CRISPR array (SEQ ID NO: 662) were also built. The spacer(s) were flanked by 12 variable nucleotides at both ends (depicted as 'NNN' in FIG. 11). The reporter construct had a low-copy replication origin (pAcyc 184) and a selectable marker (chloramphenicol resistance) that is different from that of the plasmids comprising the CRISPR-associated transposase (kanamycin resistance) to allow selection for co-transformants. The reporter plasmid also carried a LacZ cassette that provided blue-white selection. The ROI and reporter plasmids were co-transformed into *E. coli*. DNA nuclease activity of the CRISPR-associated transposase results in a double-strand break (DSBs) leading to linearized reporter plasmid. The linearized reporter plasmid is completely degraded in the *E. coli*, which was thought to be the only possible outcome of DNA repair. However, molecular evidence for existence of alternative DNA repair mechanisms that lead to re-circularization of linearized plasmids is accumulating. Not to be bound by a particular theory, these rearrangements may occur by recombination between short tracks of homologies as demonstrated by Wang (2015). Alternatively, short homologies between a linear plasmid and a circular one can also lead to recombination resulting in chimeric plasmids. Some of these new variants deriving from targeted cleavage of the reporter construct would eliminate the reporter gene (LacZ), while retaining the chloramphenicol resistance gene, which would produce rare chloramphenicol resistant white colonies in a 'sea' of blue colonies. Two negative controls were built as depicted in FIG. 11, where either the ROI (Control RGEN (−)) or the reporter region (Control Reporter (−)) were absent from their vector backbones. Co-transformation of the two plasmids resulted in 21 white colonies among 750 blue colonies, while no white colonies were found in either of the negative controls lacking either the ROI comprising the CRISPR-associated transposase or the reporter region as shown in Table 11. These results suggest that the CRISPR-associated transposase of SEQ ID NO: 136 either eliminated or mutated the reporter plasmids. For molecular analysis, plasmids were isolated from ten white colonies. A region of the reporter plasmid including the two spacers and their flanking variable regions was amplified (569 bp) in (1) the pool of reporter plasmids that did not go through transformation, (2) in plasmids isolated from two blue colonies that were apparently unaffected by the transposase, and (3) in the plasmids isolated from the ten white colonies. While strong bands of expected size were obtained from the negative controls (plasmid sources 1 and 2 listed above), only faint bands were detected in nine of ten white colonies. This suggested targeted degradation of the reporter plasmids in white colonies. The amplicon from one of ten white colonies—colony #6 was comparable to the control in intensity, which suggested that the corresponding plasmid was repaired by an alternative mechanism that preserved the reporter region. Sequencing of the amplicons revealed no mutations in the negative controls. Sequencing was also attempted in all ten white colonies, but was successful only in colony #6, which retained a significant amount of the reporter plasmid. Point mutations were identified in both spacers of this plasmid in colony #6, which may have originated from imperfect DNA repair. No such mutations were found in either the reporter plasmid pools when sequenced prior to transformation, or in randomly selected blue colonies, which went through transformation, but were apparently unaffected by the transposase possibly due to incompatibility in the variable PAM region.

TABLE 11

CRISPR-associated transposase of SEQ ID NO: 136 tested for blue-white selection assay.

| PRT SEQ ID NO | ROI SEQ ID NO | Spacer-1 SEQ ID NO | Spacer-2 SEQ ID NO | Control Reporter (—) | Control Transposase (—) | Test |
|---|---|---|---|---|---|---|
| | | | | # of white colonies among 750 blue colonies | | |
| 136 | 2018 | 2016 | 2017 | 0 | 0 | 21 |

Example 9: Validation of RNA-Guided Endonuclease Activity Using a 2-Plasmid or 3-Plasmid Selection System A bacterial selection system was previously developed to study properties of homing endonucleases by linking DNA cleavage events with cell survival (Chen and Zhao, 2005). The 2-plasmid system of Chen and Zhao consists of a 'reporter plasmid' (p11-LacY-wtx1), and an inducible protein expression vector (pTrc-I-SceI). This system has been used to increase the in vivo cutting efficiency and specificity of a FokI nuclease domain (Guo, 2010). It has also been used to alter the PAM specificity of Cas9, an RNA-guided endonuclease (Kleinstiver, 2015). The assay may be modified into a highly sensitive selection system that couples RNA-guided endonuclease DNA cleavage with the survival of host cells. Three plasmids-pNuc-I-SceI, pCut-I-SceI, and pGuide are built to enable either a 2-plasmid (pNuc and pCut) selection system, or a more flexible 3-plasmid selection system. The protein expression vector, pNuc-I-SceI, uses a strong P-tac promoter. Another improvement is incorporation of the lacI gene (lac repressor) in the pNuc-I-SceI backbone, such that the plasmid can work well in non-lacI$^q$ hosts. pNuc-I-SceI is derived from the pACYC-Duet1 plasmid (Novagen), and has the P15a-ori and Chloramphenicol (Cm) resistance gene. pNuc appeared to express the I-SceI meganuclease at a low, non-toxic level in E. coli, in quantities sufficient to cut plasmids with an I-SceI restriction site. pNuc-I-SceI has unique NdeI and NotI sites that allow the easy replacement of the I-SceI coding region with other genes or operons. Cutting the plasmid with BamHI and NotI allows for cloning 1-9 kb genomic regions containing multiple ORFs, CRISPR loci or other sequences, where protein expression from ORFs will be originating from the native promoters, etc.

The reporter plasmid, pCut-I-SceI contains the highly toxic ccdB gene behind a well-regulated P-ara expression unit that expresses ccdB levels at such low levels in its uninduced state that cells containing pCut are healthy. The pCut-I-SceI contains a cassette conferring carbenicillin resistance. Addition of 0.2% arabinose to the growth medium, induces the expression of ccdB to levels that cause a 3-4 log-kill of cells bearing the plasmid. pCut-I-SceI also contains a 'cut site' immediately downstream of the ccdB gene. In pCut-I-SceI, the 'cut site' is a ~50 bp sequence containing the 18 bp recognition sequence of the I-SceI meganuclease. The region flanking the cut site contains unique restriction sites that allow the sequence to be replaced by other desired sequences, such as a cut site library of sequences, containing degenerate nucleotides (i.e. N=A or C or G or T). Expression of an endonuclease that cuts pCut in its 'cut site' relieves the sensitivity to growth on arabinose is due to the rapid in vivo degradation of pCut and the loss of the arabinose-inducible ccdB gene. The system can be fine tuned for selecting recognition sequence variants of endonucleases, 'kinetic variants' (Guo, 2010), or studying the in vivo temperature optimum for DNA cleavage.

When competent BW25141 E. coli containing pCut-I-SceI are made and transformed with pNuc-I-SceI, and side-by-side with (empty) pACYC-Duet1, and allowed to recover for approx. 2.5 hrs, without antibiotics, with or without the addition of IPTG (to further induce I-SceI expression from the P-tac promoter), aliquots of the cells can be plated on LB+ 25 ug/ml Chloramphenicol (Cm) agar plates (to determine transformation efficiency of the pNuc construct), alongside LB+25 ug/ml Cm+0.2% arabinose plates. Depending on dilutions and competency of the E. coli, E. coli transformed with (empty) pACYC-Duet1 yield 0-1 colony-forming units (cfus) on LB+25 ug/ml Cm+0.2% arabinose plates as compared to >1000 cfus on LB+25 ug/ml Cm plates. In contrast, E. coli transformed with pNuc-I-SceI yield 30 to >100 cfu's on LB+Cm+arabinose plates as compared to >500 cfu's on LB+Cm plates. Plasmids similar to pNuc have been used by others to co-express RNA-guided endonucleases along with their guide RNA(s) or a CRISPR locus (Zetsche, 2015). A modification of this system that uses a separate third plasmid, pGuide, to co-express guide RNA increases the flexibility of the selection system. The pCDF-Duet1 backbone (Novagen) containing the CDF-ori and Spectinomycin-r genes is chosen and a synthetic DNA J23119 (a synthetic constitutive E. coli promoter used by Zetsche 2015.) is inserted in the ~2.2 kB pCDF backbone to create the pGuide plasmid. The guide RNA associated with a CRISPR-associated transposase of interest, for example the CRISPR-associated transposase of SEQ ID NO: 136 (DNA: SEQ ID NO: 304), is inserted in the pCDF backbone to create the pGuide-transposase plasmid.

The 2-plasmid and 3-plasmid systems are used to determine RNA-guided nuclease activities for the CRISPR-associated transposase proteins selected from SEQ ID NOs: 124-246 and 275-287. Using the CRISPR-associated transposase of SEQ ID NO: 136 as an example, the transposase coding region (SEQ ID NO: 304) is cloned into the pNuc-I-SceI plasmid replacing the I-SceI component to create the pNuc-RGEN PRT: SEQ ID NO: 136 (DNA: SEQ ID NO: 304) plasmid. A, RGEN PRT: SEQ ID NO: 136 (DNA: SEQ ID NO: 304) 'cut site' (two spacers SEQ ID NOs: 2017 and 2018 flanked by 8 variable nucleotides at both ends) is cloned into the pCut-I-SceI plasmid replacing the I-SceI cut site to create the pCut-RGEN PRT: SEQ ID NO: 136 (DNA: SEQ ID NO: 304) plasmid. A pCut-control plasmid is generated by incorporating a non-RGEN PRT: SEQ ID NO: 136 (DNA: SEQ ID NO: 304) 'cut site' (e.g. Cas9 cut site) into the pCut-I-SceI plasmid.

The pNuc-RGEN PRT: SEQ ID NO: 136 (DNA: SEQ ID NO: 304) plasmids are tested with the pCut-RGEN PRT: SEQ ID NO: 136 (DNA: SEQ ID NO: 304) plasmid in the above described 2-plasmid assay to determine the minimal genomic fragment required for the RNA-guided nuclease activity. The pNUC-RGEN PRT: SEQ ID NO: 136 (DNA: SEQ ID NO: 304) plasmids can be further tested with the pCut-RGEN PRT: SEQ ID NO: 136 (DNA: SEQ ID NO: 304) plasmid and the pGuide plasmid to determine if the associated CRISPR locus is required for the nuclease activity of the CRISPR-associated transposase. The pCut-control plasmid is used to demonstrate specificity of the CRISPR-associated transposase mediated cleavage.

Example 10: Fragment Length Assay

This example describes an in vitro assay for high-throughput detection of targeted endonuclease activities for CRISPR-associated transposase proteins selected from SEQ ID NOs: 124-246 and 275-287. E. coli cells carrying expression vectors for CRISPR-associated transposases with or without guide RNAs (or an entire CRISPR locus) are lysed to prepare whole cell lysates, essentially as described in Example 6. Fluorescent end-labeled PCR amplicons carrying the predicted target site of the CRISPR-associated transposase are added to the lysates, and after incubation, the CRISPR-associated transposase present in the lysates cleaves the fluorescent end-labeled PCR amplicons. The fluorescent fragments can be detected and sized by high-throughput DNA length analysis (for example, on an ABI3700 instrument, Life technologies) to determine the extent of DNA cutting and the position of the cut site in the DNA fragments.

Example 11: RNA Binding Assay

Figure 12:
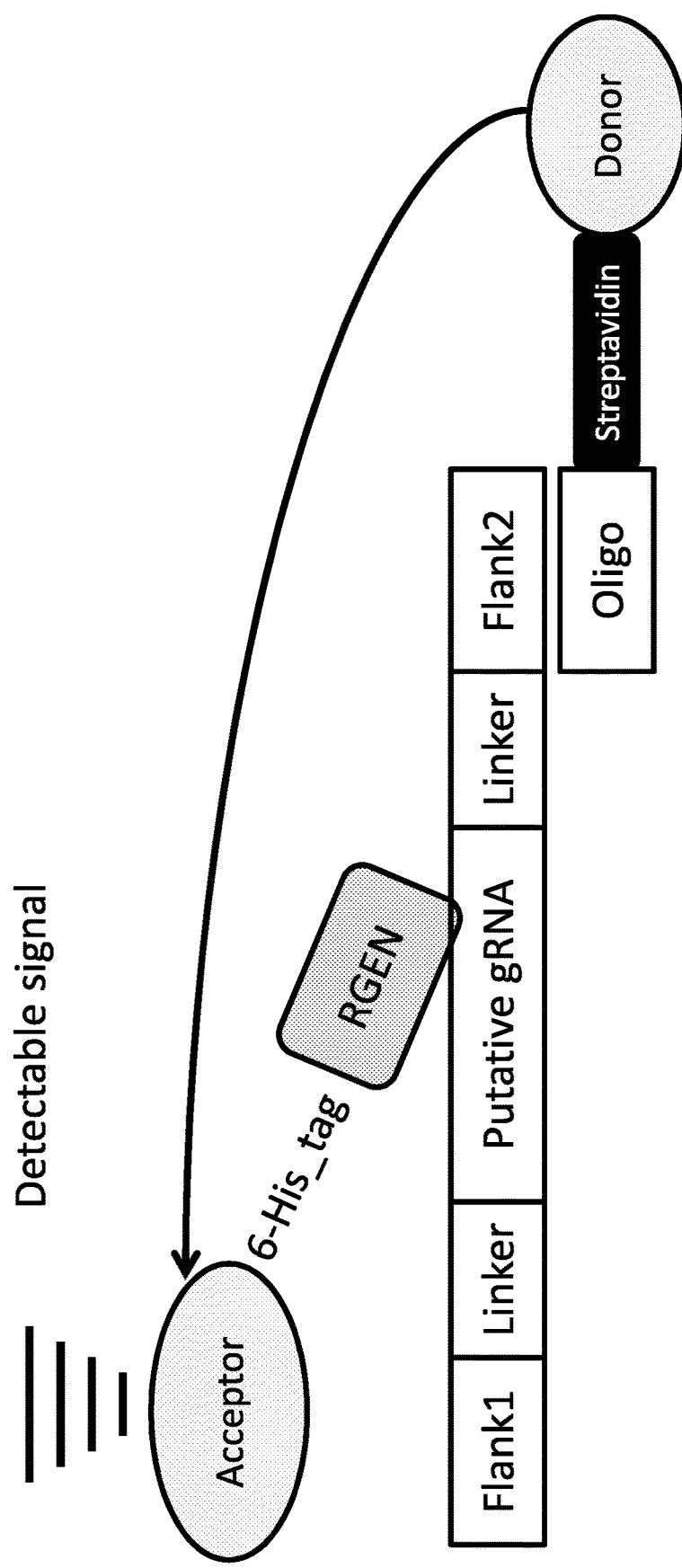
FIG. 12 shows a diagram of the Guide RNA binding assay using Alpha Screen (Perkin Elmer) technology. This assay system uses a donor and acceptor bead that when brought into close proximity emits a detectable fluorescent signal. The putative guide RNAs (gRNA) are made using in vitro transcription. These guide RNA sequences are linked to the flank sequences (Flank1: SEQ ID NO: 3380; Flank2: SEQ ID NO: 3381) via the linker sequence (SEQ ID NO: 3382). The nucleotide sequence (Flank2) binds to an oligo with an Alpha Streptavidin donor bead attached. A CRISPR-associated transposase is expressed in E. coli with a His-tag. This His-tag (represented in the figure as 6-His_tag) serves as the binding site for the Alpha acceptor bead. When CRISPR-associated transposase binds to the putative guide RNA a detectable fluorescent signal is produced.

This example describes the assay for assessing whether a transposase protein selected from SEQ ID NOs: 124-246 and 275-287 associates with a guide RNA sequence derived from its associated CRISPR array. The technology employed in this assay is the Alpha Screen (Perkin Elmer). This assay system uses a donor and acceptor bead that when brought into close proximity emits a detectable fluorescent signal. In this assay, several guide RNAs are made using in vitro transcription. These guide RNA sequences are linked to the flank sequences (Flank1: SEQ ID NO: 3380; Flank2: SEQ ID NO: 3381) via a linker sequence (SEQ ID NO: 3382) (FIG. 10). The nucleotide sequence (Flank2) binds to an oligo with an Alpha Streptavidin donor bead attached. An CRISPR-associated transposase is expressed in E. coli with a His-tag which serves as the binding site for the Alpha acceptor bead. As an example illustrated in FIG. 12, when a CRISPR-associated transposase of SEQ ID NO: 136 (with acceptor bead) binds to its predicted guide RNA (with donor bead) a detectable fluorescent signal is produced. For this experiment a CRISPR-associated transposase of SEQ ID NO: 136 (DNA: SEQ ID NO: 304) is expressed in an IPTG-inducible *E. coli* strain and the lysate is applied to the assay to look for signal. To first validate this assay a purified His-Cas9 is mixed with its gRNA (SEQ ID NO: 3383). If the assay functions under these conditions then it is further tested with a bacterial lysate containing expressed His-Cas9 to more closely mimic the conditions of the RGEN CRISPR-associated transposase experiment. If a detectable signal is measured from the Cas9 lysate then the assay is applied to a CRISPR-associated transposase lysate against its corresponding guide RNA. A number of putative guide RNA sequences (SEQ ID NOs: 3384-3402) are designed to be tested in the binding assay for the CRISPR-associated transposase of SEQ ID NO: 136, using the CRISPR repeats and spacers disclosed in Table 8 for SEQ ID NO: 136. Among these guide RNAs, two sequences (SEQ ID NOs: 3401 and 3402) are designed to be negative controls by introducing mutations into the native CRISPR repeat and spacer sequences comprised in these two guide RNAs.

Example 12: Use of CRISPR-Associated Transposases for Genome Editing in Plants

The CRISPR-associated transposases represented by SEQ ID NOs: 124-246 and 275-287 are tested for site-specific cleavage of genomic DNA in plants. To demonstrate this activity, vectors are created to express the transposase proteins and the associated guide RNAs. For example, vectors are created to express the CRISPR-associated transposase protein of SEQ ID NO: 136 and its associated guide-RNA. Codon-optimized open reading frames of the CRISPR-associated transposases represented by SEQ ID NOs: 124-246 and 275-287 for corn and soy are listed in Table 12. A promoter, such as maize Ubiquitin2 promoter, is used to drive the expression of CRISPR-associated transposases in plants. A nuclear localization signal (e.g. monopartite SV40) is added to the N terminus of a CRISPR-associated transposase and a bipartite nucleoplasmin nuclear localization signal (BiNLS) is included at the C terminus to facilitate nuclear localization. To validate the effectiveness of nuclear localization signal used, maize protoplasts are transformed with an transposase-GFP fusion protein construct and nuclear localized fluorescence is observed. A maize U6 snRNA promoter can be used for the generation of sgRNA in maize (WO2015131101 incorporated by reference herein; Zhu, 2016). The PAM sequences are identified for the CRISPR-associated transposases as described in Example 7, and the protospacer sequences recognized by CRISPR-associated transposases can be used to identify sgRNA-specific target sites within the maize genome with minimal off-target cuts, using the approach described by Zhu (2016). Target sites located in the first two exons are good candidates for the purpose of targeted gene disruption in maize, since mutations occurred at the beginning of the coding sequence are more likely to disrupt the function of the proteins.

To test the activity of CRISPR-associated transposases for maize endogenous gene editing, a protoplast transient assay is conducted to detect the function of the engineered CRISPR-transposase system. To increase the transformation efficiency, binary plasmids with both sgRNA and transposase expression cassettes are generated and then transformed into maize protoplasts. Genomic DNA is extracted from transformed protoplasts cultured for 24 h and amplicons encompassing target sites are prepared for sequencing (for example, Illumina deep sequencing) and targeted genome edits can be observed.

TABLE 12

The codon-optimized open reading frames for CRISPR-associated transposases for corn and soy.

| PRT SEQ ID NO | Organism | Corn codon-optimized SEQ ID NO | Soy codon-optimized SEQ ID NO |
|---|---|---|---|
| 124 | *Bacillus* sp. multi | 2020-2024 | 2700-2704 |
| 125 | *Bacillus* sp. multi | 2025-2029 | 2705-2709 |
| 126 | *Bacillus* sp. multi | 2030-2034 | 2710-2714 |
| 127 | *Bacillus* sp. multi | 2035-2039 | 2715-2719 |
| 128 | *Bacillus* sp. multi | 2040-2044 | 2720-2724 |
| 129 | *Bacillus* sp. multi | 2045-2049 | 2725-2729 |
| 130 | *Bacillus* sp. multi | 2050-2054 | 2730-2734 |
| 131 | *Bacillus* sp. multi | 2055-2059 | 2735-2739 |
| 132 | *Bacillus* sp. multi | 2060-2064 | 2740-2744 |
| 133 | *Bacillus* sp. multi | 2065-2069 | 2745-2749 |
| 134 | *Bacillus thuringiensis* | 2070-2074 | 2750-2754 |
| 135 | *Bacillus* sp. multi | 2075-2079 | 2755-2759 |
| 136 | *Bacillus* sp. Multi | 2080-2084 | 2760-2764 |
| 137 | *Bacillus* sp. multi | 2085-2089 | 2765-2769 |
| 138 | *Bacillus* sp. multi | 2090-2094 | 2770-2774 |
| 139 | *Bacillus* sp. multi | 2095-2099 | 2775-2779 |
| 140 | *Bacillus* sp. multi | 2100-2104 | 2780-2784 |
| 141 | *Bacillus* sp. multi | 2105-2109 | 2785-2789 |
| 142 | *Bacillus* sp. multi | 2110-2114 | 2790-2794 |
| 143 | *Bacillus* sp. multi | 2115-2119 | 2795-2799 |
| 144 | *Bacillus* sp. multi | 2120-2124 | 2800-2804 |
| 145 | *Bacillus* sp. multi | 2125-2129 | 2805-2809 |
| 146 | *Bacillus* sp. multi | 2130-2134 | 2810-2814 |
| 147 | *Bacillus* sp. multi | 2135-2139 | 2815-2819 |
| 148 | *Bacillus* sp. multi | 2140-2144 | 2820-2824 |
| 149 | *Bacillus* sp. multi | 2145-2149 | 2825-2829 |
| 150 | *Bacillus* sp. multi | 2150-2154 | 2830-2834 |
| 151 | *Bacillus* sp. multi | 2155-2159 | 2835-2839 |
| 152 | *Bacillus* sp. multi | 2160-2164 | 2840-2844 |
| 153 | *Bacillus* sp. multi | 2165-2169 | 2845-2849 |
| 154 | *Bacillus* sp. multi | 2170-2174 | 2850-2854 |
| 155 | *Bacillus* sp. multi | 2175-2179 | 2855-2859 |
| 156 | *Bacillus* sp. multi | 2180-2184 | 2860-2864 |
| 157 | *Bacillus* sp. multi | 2185-2189 | 2865-2869 |
| 158 | *Bacillus* sp. multi | 2190-2194 | 2870-2874 |
| 159 | *Bacillus* sp. multi | 2195-2199 | 2875-2879 |
| 160 | *Bacillus* sp. multi | 2200-2204 | 2880-2884 |
| 161 | *Bacillus* sp. multi | 2205-2209 | 2885-2889 |
| 162 | *Bacillus* sp. multi | 2210-2214 | 2890-2894 |
| 163 | *Bacillus* sp. multi | 2215-2219 | 2895-2899 |
| 164 | *Bacillus* sp. multi | 2220-2224 | 2900-2904 |
| 165 | *Bacillus* sp. multi | 2225-2229 | 2905-2909 |
| 166 | *Bacillus* sp. multi | 2230-2234 | 2910-2914 |
| 167 | *Bacillus* sp. multi | 2235-2239 | 2915-2919 |
| 168 | *Bacillus* sp. multi | 2240-2244 | 2920-2924 |
| 169 | *Bacillus* sp. multi | 2245-2249 | 2925-2929 |
| 170 | *Bacillus* sp. multi | 2250-2254 | 2930-2934 |
| 171 | *Bacillus* sp. multi | 2255-2259 | 2935-2939 |
| 172 | *Bacillus* sp. multi | 2260-2264 | 2940-2944 |
| 173 | *Bacillus* sp. multi | 2265-2269 | 2945-2949 |
| 174 | *Bacillus* sp. multi | 2270-2274 | 2950-2954 |
| 175 | *Bacillus* sp. multi | 2275-2279 | 2955-2959 |
| 176 | *Paenibacillus* sp. novel | 2280-2284 | 2960-2964 |
| 177 | *Bacillus thuringiensis* | 2285-2289 | 2965-2969 |
| 178 | *Bacillus* sp. multi | 2290-2294 | 2970-2974 |
| 179 | *Bacillus* sp. multi | 2295-2299 | 2975-2979 |
| 180 | *Bacillus* sp. multi | 2300-2304 | 2980-2984 |
| 181 | *Bacillus* sp. multi | 2305-2309 | 2985-2989 |
| 182 | *Bacillus* sp. multi | 2310-2314 | 2990-2994 |
| 183 | *Bacillus* sp. multi | 2315-2319 | 2995-2999 |
| 184 | *Bacillus* sp. multi | 2320-2324 | 3000-3004 |
| 185 | *Bacillus* sp. multi | 2325-2329 | 3005-3009 |
| 186 | *Bacillus* sp. multi | 2330-2334 | 3010-3014 |
| 187 | *Bacillus* sp. multi | 2335-2339 | 3015-3019 |

TABLE 12-continued

The codon-optimized open reading frames for CRISPR-associated transposases for corn and soy.

| PRT SEQ ID NO | Organism | Corn codon-optimized SEQ ID NO | Soy codon-optimized SEQ ID NO |
|---|---|---|---|
| 188 | Bacillus sp. multi | 2340-2344 | 3020-3024 |
| 189 | Bacillus sp. multi | 2345-2349 | 3025-3029 |
| 190 | Bacillus sp. multi | 2350-2354 | 3030-3034 |
| 191 | Bacillus sp. multi | 2355-2359 | 3035-3039 |
| 192 | Bacillus sp. multi | 2360-2364 | 3040-3044 |
| 193 | Bacillus sp. multi | 2365-2369 | 3045-3049 |
| 194 | Bacillus sp. multi | 2370-2374 | 3050-3054 |
| 195 | Bacillus thuringiensis | 2375-2379 | 3055-3059 |
| 196 | Bacillus sp. multi | 2380-2384 | 3060-3064 |
| 197 | Bacillus sp. multi | 2385-2389 | 3065-3069 |
| 198 | Bacillus sp. multi | 2390-2394 | 3070-3074 |
| 199 | Bacillus sp. multi | 2395-2399 | 3075-3079 |
| 200 | Bacillus sp. multi | 2400-2404 | 3080-3084 |
| 201 | Bacillus sp. multi | 2405-2409 | 3085-3089 |
| 202 | Bacillus sp. multi | 2410-2414 | 3090-3094 |
| 203 | Bacillus sp. multi | 2415-2419 | 3095-3099 |
| 204 | Bacillus sp. multi | 2420-2424 | 3100-3104 |
| 205 | Bacillus sp. multi | 2425-2429 | 3105-3109 |
| 206 | Bacillus sp. multi | 2430-2434 | 3110-3114 |
| 207 | Bacillus sp. multi | 2435-2439 | 3115-3119 |
| 208 | Bacillus sp. multi | 2440-2444 | 3120-3124 |
| 209 | Bacillus sp. multi | 2445-2449 | 3125-3129 |
| 210 | Bacillus sp. multi | 2450-2454 | 3130-3134 |
| 211 | Bacillus sp. multi | 2455-2459 | 3135-3139 |
| 212 | Bacillus sp. multi | 2460-2464 | 3140-3144 |
| 213 | Bacillus sp. multi | 2465-2469 | 3145-3149 |
| 214 | Bacillus sp. multi | 2470-2474 | 3150-3154 |
| 215 | Bacillus sp. multi | 2475-2479 | 3155-3159 |
| 216 | Bacillus sp. multi | 2480-2484 | 3160-3164 |
| 217 | Bacillus sp. multi | 2485-2489 | 3165-3169 |
| 218 | Bacillus sp. multi | 2490-2494 | 3170-3174 |
| 219 | Bacillus sp. multi | 2495-2499 | 3175-3179 |
| 220 | Bacillus sp. multi | 2500-2504 | 3180-3184 |
| 221 | Bacillus sp. multi | 2505-2509 | 3185-3189 |
| 222 | Bacillus sp. multi | 2510-2514 | 3190-3194 |
| 223 | Bacillus thuringiensis | 2515-2519 | 3195-3199 |
| 224 | Bacillus megaterium | 2520-2524 | 3200-3204 |
| 225 | Bacillus sp. multi | 2525-2529 | 3205-3209 |
| 226 | Bacillus sp. multi | 2530-2534 | 3210-3214 |
| 227 | Bacillus sp. multi | 2535-2539 | 3215-3219 |
| 228 | Paenibacillus thiaminolyticus (multi) | 2540-2544 | 3220-3224 |
| 229 | Paenibacillus thiaminolyticus (multi) | 2545-2549 | 3225-3229 |
| 230 | Paenibacillus sp. multi | 2550-2554 | 3230-3234 |
| 231 | Paenibacillus lentimorbus (multi) | 2555-2559 | 3235-3239 |
| 232 | Paenibacillus thiaminolyticus (multi) | 2560-2564 | 3240-3244 |
| 233 | Paenibacillus thiaminolyticus (multi) | 2565-2569 | 3245-3249 |
| 234 | Paenibacillus thiaminolyticus (multi) | 2570-2574 | 3250-3254 |
| 235 | Paenibacillus terrae | 2575-2579 | 3255-3259 |
| 236 | Paenibacillus thiaminolyticus (multi) | 2580-2584 | 3260-3264 |
| 237 | Paenibacillus thiaminolyticus (multi) | 2585-2589 | 3265-3269 |
| 238 | Bacillus sp. multi | 2590-2594 | 3270-3274 |
| 239 | Bacillus sp. multi | 2595-2599 | 3275-3279 |
| 240 | Streptomyces sp. multi | 2600-2604 | 3280-3284 |
| 241 | Bacillus sp. multi | 2605-2609 | 3285-3289 |
| 242 | Bacillus sp. multi | 2610-2614 | 3290-3294 |
| 243 | Bacillus sp. multi | 2615-2619 | 3295-3299 |
| 244 | Bacillus sp. multi | 2620-2624 | 3300-3304 |
| 245 | Bacillus sp. multi | 2625-2629 | 3305-3309 |
| 246 | Lysinibacillus sp. multi | 2630-2634 | 3310-3314 |
| 275 | Bacillus sp. multi | 2635-2639 | 3315-3319 |
| 276 | Streptomyces sp. multi | 2640-2644 | 3320-3324 |
| 277 | Bacillus sp. multi | 2645-2649 | 3325-3329 |
| 278 | Bacillus sp. multi | 2650-2654 | 3330-3334 |
| 279 | Bacillus sp. multi | 2655-2659 | 3335-3339 |
| 280 | Bacillus sp. multi | 2660-2664 | 3340-3344 |
| 281 | Bacillus sp. multi | 2665-2669 | 3345-3349 |
| 282 | Bacillus sp. multi | 2670-2674 | 3350-3354 |
| 283 | Bacillus sp. multi | 2675-2679 | 3355-3359 |
| 284 | Paenibacillus thiaminolyticus (multi) | 2680-2684 | 3360-3364 |
| 285 | Paenibacillus lentimorbus (multi) | 2685-2689 | 3365-3369 |
| 286 | Paenibacillus thiaminolyticus (multi) | 2690-2694 | 3370-3374 |
| 287 | Stenotrophomonas sp. multi | 2695-2699 | 3375-3379 |

To test the mutation efficiency of CRISPR-associated transposases in stable expression lines, a target site verified in the maize transient assay is chosen. Construct(s) with sgRNA and the selected target site, and the transposase is then transformed into maize immature embryos via *Agrobacterium tumefaciens*. $T_0$ transgenic lines are analyzed and the transposase positive lines are identified based on immunoblot analysis. SURVEYOR assays can be used to determine whether edits are introduced in the target site (Zhu, 2016). For detailed analysis of editing efficiency and mutation type introduced by CRISPR-associated transposases, the PCR amplicons encompassing the target site can be deep-sequenced for the transposase positive $T_0$ generation plants. The experimental designs and assays as described above in this example can also be adapted to program and test the CRISPR-associated transposases for genome editing in soy, wheat, canola, cotton, tomato, or other plants and vegetables.

SEQUENCE LISTING (3402 sequences)

SEQ ID NO: 1 - DNA, 1356 bp, Unknown
  Bacillus sp. multi
ttgggagtaacaattaagataatgaaatatcaaattttatgtccaatgaatgtcgattggataatatttgaaaaacatttacgaaacttaacatatcagatcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaaaaaatttgataaagaattaatcatgggaattgatatgggtggaataaatacagtttactttgcatttaatgaagggtttattcgcagcaatattaaaagtgatgaaattaaagaatttaatgaaagaattcgacagaggcgtatcaatttactgaaccaaagtaaatattgtagtaatagtagaacgggaaaaggtaggacgaaacggttacagcctatagacgtgttaagtaataaaatagctaagttccgaaatagtactaaccataaatatgcaaactatataataaaacagtgtctaaaatataattgtgggcgcattcaaatggaacttttaaaaggcatatcaaaaaatgataaggttcttaaagattggacttattttgatttgcaggagaaaatcaaaaatcaagctgagattcatggaattgaagttattaaagttgcccccgcatatacgagtcaacgatgtagtcaatgcggatatatttgtaaagaaaatcgttgtacacaagctatgtttgaatgtaaacaatgtggatataaaacacatgctgattataatgcggcaaaaaacattgctacttatgatatcgaaaatattataaataaacaattagcggcacaaagcaaattgcattcaaaaaaatgtatggaagagtatatagaagagttaggataccttgattaa

SEQ ID NO: 2 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaaaaaatttgataaagaattaatcatgggaattgatatgggtggaataaatacagtttactttgcatttaatgaagggtttattcgcagcaatattaaaagtgatgaaattaaagaatttaatgaaagaattcgacagaggcgtatcaatttactgaaccaaagtaaatattgtagtaatagtagaacgggaaaaggtaggacgaaacggttacagcctatagacgtgttaagtaataaaatagctaagttccgaaatagtactaaccataaatatgcaaactatataataaaacagtgtctaaaatataattgtgggcgcattcaaatggaacttttaaaaggcatatcaaaaaatgataaggttcttaaagattggacttattttgatttgcaggagaaaatcaaaaatcaagctgagattcatggaattgaagttattaaagttgcccccgcatatacgagtcaacgatgtagtcaatgcggatatatttgtaaagaaaatcgttgtacacaagctatgtttgaatgtaaacaatgtggatataaaacacatgctgattataatgcggcaaaaaacattgctacttatgatatcgaaaatattataaataaacaattagcggcacaaagcaaattgcattcaaaaaaatgtatggaagagtatatagaagagttaggataccttgattaa

SEQ ID NO: 3 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagatcgattaatgaatcaaacatacagcaaaggcgcatgtatgattcataaatacaaaaataagtggtatttatcaattacttataaattcaatgctataaaagaaaaaaaatttgataaagaattaatcatgggaattgatatgggtggaataaatacagtttactttgcatttaatgaagggtttattcgcagcaatattaaaagtgatgaaattaaagaatttaatgaaagaattcgacagaggcgtatcaatttactgaaccaaagtaaatattgtagtaatagtagaacgggaaaaggtaggacgaaacggttacagcctatagacgtgttaagtaataaaatagctaagttccgaaatagtactaaccataaatatgcaaactatataataaaacagtgtctaaaatataattgtgggcgcattcaaatggaacttttaaaaggcatatcaaaaaatgataaggttcttaaagattggacttattttgatttgcaggagaaaatcaaaaatcaagctgagattcatggaattgaagttattaaagttgcccccgcatatacgagtcaacgatgtagtcaatgcggatatatttgtaaagaaaatcgttgtacacaagctatgtttgaatgtaaacaatgtggatataaaacacatgctgattataatgcggcaaaaaacattgctacttatgatatcgaaaatattataaataaacaattagcggtacaaagcaaattgcattcaaaaaaatgtatggaagagtatatagaagagttaggataccttgattaa

SEQ ID NO: 4 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataagggaaacatgtctaccactcttcaaaaaattataaaaacctggaagagtagaagaaatgaaattagaaaaggtgagatgtcaattccttcttttcgaaatcgcataccaattgatctccataataattcagtagacataataaaagagaagaatggagattatattgctggtatatctcttttttcacgagattttcataaggaaaatggcgatgtcccaaaagggaagatttttgtaaagttaggtacccaaaaacaaaaaagcatgaaagttattttagaccgattaatcaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaaacaaagtaaatattgtagtaatagcagaacgggaaaaggtaggacgaaacgattacaaccaatagacgtgttaagtaataaaatagctaagtttcgaaatagcaccaaccataaatatgcaaattatataataaaacagtgtctaaaacataattgcgggcgtattcaaatggaacttttaaaaggcatatcaaaaaatgataaggttcttaaagattggacgtattttgatttgcaggagaagatcaaaaatcaagctgagattcatgggattgaagttattaaagtggcccccgcgtatacgagtcaacgatgtagtcaatgcggatatatttgtaaagaaaatcgttgtacacaagctatgtttgaatgtaagcagtgtggatataaaacacatgctgattataatgcggcgaaaaacattgctacttatgacatcgaaaatattataaataaacaattagcggtacaaagcaaattacattcaaaaaaatgtatggaagagtatatagaagagttaggatacctggattaa

SEQ ID NO: 5 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataagggaaacatgtctaccactcttcaaaaaattataaaaacctggaagagtagaagaaatgaaattagaaaaggtgagatgtcaattccttcttttcgaaatcgcataccaattgatctccataataattcagtagacataataaaagagaagaatggagattatattgctggtatatctctttttttacgagattttcataaggaaaatggcgatgtcccaaaagggaagatttttgtaaagttaggtacccaaaaacaaaaaagcatgaaagttattttagaccgattaatcaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaaacaaagtaaatattgtagtaatagcagaacgggaaaaggtaggacgaaacgattacaaccaatagacgtgttaagtaataaaatagctaagtttcgaaatagcaccaaccataaatatgcaaattatataataaaacagtgtctaaaacataattgcgggcgtattcaaatggaacttttaaaaggcatatcaaaaaatgataaggttcttaaagattggacgtattttgatttgcaggagaagatcaaaaatcaagctgagattcatgggattgaagttattaaagtggcccccgcgtatacgagtcaacgatgtagtcaatgcggatatatttgtaaagaaaatcgttgtacacaagctatgtttgaatgtaagcagtgtggatataaaacacatgctgattataatgcggcgaaaaacattgctacttatgacatcgaaaatattataaataaacaattagcggtacaaagcaaattacattcaaaaaaatgtatggaagagtatatagaagagttaggatacctggattaa

SEQ ID NO: 6 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataagggaaacatgtctaccactcttcaaaaaattataaaaacctggaagagtagaagaaatgaaattagaaaaggtgagatgtcaattccttcttttcgaaatcgcataccaattgatctccataataattcagtagacataataaaagagaagaatggagattatattgctggtatatctcttttttcacgagattttcataaggaaaatggcgatgtcccaaaagggaagatttttgtaaagttaggtacccaaaaacaaaaaagcatgaaagttattttagaccgattaatcaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaaacaaagtaaatattatagtaatagcagaacgggaaaaggtaggacgaaacgattacaaccaatagacgtgttaagtaataaaatagctaagtttcgaaatagcaccaaccataaatatgcaaattatataataaaacagtgtctaaaacataattgcgggcgtattcaaatggaacttttaaaaggcatatcaaaaaatgataaggttcttaaagattggacgtattttgatttgcaggagaagatcaaaaatcaagctgagattcatgggattgaagttattaaagtggcccccgcgtatacgagtcaacgatgtagtcaatgcggatatatttgtaaagaaaatcgttgtacacaagctatgtttgaatgtaagcagtgtggatataaaacacatgctgattataatgcggcgaaaaacattgctacttatgacatcgaaaatattataaataaacaattagcggtacaaagcaaattacattcaaaaaaatgtatggaagagtatatagaagagttaggatacctggattaa

SEQ ID NO: 7 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataagggaaacatgtctaccactcttcaaaaaattataaaaacctggaagagtagaagaaatgaaattagaaaaggtgagatgtcaattccttcttttcgaaatcgcataccaattgatctccataataattcagtagacataataaaagagaagaatggagattatattgctggtatatctcttttttcacgagattttcataaggaaaatggcgatgtcccaaaagggaagatttttgtaaagttaggtacccaaaaacaaaaaagcatgaaagttattttagaccgattaatcaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaaacaaagtaaatattgtagtaatagcagaacgggaaaaggtaggacgaaacgattacaaccaatagacgtgttaagtaataaaatagctaagtttcgaaatagcaccaaccataaatatgcaaattatataataaaacagtgtctaaaacataattgcgggcgtattcaaatggaacttttaaaaggcatatcaaaaaatgataaggttcttaaagattggacgtattttgatttgcaggagaagatcaaaaatcaagctgagattcataggattgaagttattaaagtggcccccgcgtatacgagtcaacgatgtagtcaatgcggatatatttgtaaagaaaatcgttgtacacaagctatgtttgaatgtaagcagtgtggatataaaacacatgctgattataatgcggcgaaaaacattgctacttatgacatcgaaaatattataaataaacaattagcggtacaaagcaaattacattcaaaaaaatgtatggaagagtatatagaagagttaggatacctggattaa

SEQ ID NO: 8 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaaccattcaacaattatgggagtttgatgctttatcctttgactactttaaagcaagagggacataccctactgtccaagatttgtatgggtgtacacagaagaaaattgacggttatatataccatacattacaaagtaaatatccagatatacataaaggaaacatgtctaccactcttcaaaaaattataaaaacgtggaagagtagaagaaatgaaattagaaaaggtgaaatgtcaattccttcttttcgaaatcgcataccaattgatctccataataattcagtagacataacaaaagagaagaatggagattatattgctggtatatctcttttttcacgagattttcataaggaaaatgacgatgtcccaaaagggaagatttttataaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttattttgcgtttaatgaagggtttattcgtagcaatattaaaagtgatgaaattaaaacgtttaatgaaagaattcgacagagacgtatcaatttactgaaacaaagtaaatattgtagtaatagtagaactggaaaaggtaggacgaaacgattacagccaatagacgtgttaagtaataaaatagctaaatttagaaatagcactaatcataaatatgcaaactatataataaaacagtgtctaaaatataattgtgggcgtattcaaatggaacttttaaaaggcatatcaaaaaacgataaggttcttaacgattggacttattttgacttgcaggagaagatcaaaaatcaagcagagattcatggaattgaagttattaaaattgccccagcatatacaagtcaacgctgtagtcaatgcggatatatttgtaaagaaaatcgttgtacacaagctatgtttgaatgtaagcagtgtggatataaaacacatgctgattataatgcagcgaaaaacatttctacttatgacatcgaaaatattataaacaaacaattagcggtacaaagcaaattgcattcaaaaaaatgtatggcagagtatatggaagagttaggatacctggattaa

SEQ ID NO: 9 - DNA, 1335 bp, Bacillus thuringiensis
atgaaatatcaaattttatgtccaatgaatgtcgattggacaatatttgaaaagcatttacgaaacttaacatatcaggtcagaacgataagtaatcgaaccattcaacaattatgggagtttgatgctttatcctttgactactttaaagcaagagggacataccctactgtccaagatttgtatgggtgtacacagaagaaaattgacggttatatataccatacattacaaagtaaatatccagatatacataaaggaaacatgtctaccactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttataaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttattttgcgtttaatgaagggtttattcgtagcaatattaaaagtgatgaaattaaaacgtttaatgaaagaattcgacagagacgtatcaatttactgaaacaaagtaaatattgtagtaatagtagaactggaaaaggtaggacgaaacgattacagccaatagacgtgttaagtaataaaatagctaaatttagaaatagcactaatcataaatatgcaaactatataataaaacagtgtctaaaacataattgtgggcgtattcaaatggaacttttaaaaggcatatcaaaaaacgataaggttcttaaagattggacttattttgacttgcaggagaagatcaaaaatcaagcagagattcatggaattgaagttattaaaattgccccagcatatacaagtcaacgctgtagtcaatgcggatatatttgtaaagaaaatcgttgtacacaagctatgtttgaatgtaagcagtgtggatataaaacacatgctgattataatgcagcgaaaaacatttctacttatgacatcgaaaatattataaacaaacaattagcggtacaaagcaaattgcattcaaaaaaatgtatggcagagtatatggaagagttaggatacctggattaa

SEQ ID NO: 10 - DNA, 1335 bp, Unknown
  Bacillus sp. multi
atgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaattatgggaattgatttgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 11 - DNA, 1356 bp, Bacillus thuringiensis
ttgggagtaacaattaagataatgaaatatcaaattttatgtccaatgaatgtcgattggacaatatttgaaaagcatttacgaaacttaacatatcaggtcagaacgataagtaatcgaaccattcaacaattatgggagtttgatgctttatcctttgactactttaaagcaagagggacataccctactgtccaagatttgtatgggtgtacacagaagaaaattgacggttatatataccatacattacaaagtaaatatccagatatacataaaggaaacatgtctaccactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttataaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttattttgcgtttaatgaagggtttattcgtagcaatattaaaagtgatgaaattaaaacgtttaatgaaagaattcgacagagacgtatcaatttactgaaacaaagtaaatattgtagtaatagtagaactggaaaaggtaggacgaaacgattacagccaatagacgtgttaagtaataaaatagctaaatttagaaatagcactaatcataaatatgcaaactatataataaaacagtgtctaaaacataattgtgggcgtattcaaatggaacttttaaaaggcatatcaaaaaacgataaggttcttaaagattggacttattttgacttgcaggagaagatcaaaaatcaagcagagattcatggaattgaagttattaaaattgccccagcatatacaagtcaacgctgtagtcaatgcggatatatttgtaaagaaaatcgttgtacacaagctatgtttgaatgtaagcagtgtggatataaaacacatgctgattataatgcagcgaaaaacatttctacttatgacatcgaaaatattataaacaaacaattagcggtacaaagcaaattgcattcaaaaaaatgtatggcagagtatatggaagagttaggatacctggattaa

SEQ ID NO: 12 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcagatcagaacgataagtaatcgaaccattcaacaattatgggagtttgatgccttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 13 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaattatgggaattgatttgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 14 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagtagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 15 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaaccattcaacaattatgggagtttgatgctttatcctttgactactttaaagcaagagggacataccctactgtccaagatttgtatgggtgtacacagaagaaaattgacggttatatataccatacattacaaagtaaatatccagatatacataaaggaaacatgtctaccactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttataaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttattttgcgtttaatgaagggtttattcgtagcaatattaaaagtgatgaaattaaaacgtttaatgaaagaattcgacagagacgtatcaatttactgaaacaaagtaaatattgtagtaatagtagaactggaaaaggtaggacgaaacgattacagccaatagacgtgttaagtaataaaatagctaaatttagaaatagcactaatcataaatatgcaaactatataataaaacagtgtctaaaacataattgtgggcgtattcaaatggaacttttaaaaggcatgtcaaaaaacgataaggttcttaaagattggacttattttgacttgcaggagaagatcaaaaatcaagcagagattcatggaattgaagttattaaaattgccccagcatatacaagtcaacgctgtagtcaatgcggatatatttgtaaagaaaatcgttgtacacaagctatgtttgaatgtaagcagtgtggatataaaacacatgctgattataatgcagcgaaaaacatttctacttatgacatcgaaaatattataaacaaacaattagcggttcaaagcaaattgcattcaaaaaaatgtatggcagagtatatggaagagttaggatacctggattaa

SEQ ID NO: 16 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaaccattcaacaattatgggagtttgatgctttatcctttgactactttaaagcaagagggacataccctactgtccaagatttgtatgggtgtacacagaagaaaattgacggttatatataccatacattacaaagtaaatatccagatatacataaaggaaacatgtctaccactcttcaaaaaattataaaaacgtggaagagtagaagaaatgaaattagaaaaggtgaaatgtcaattccttcttttcgaaatcgcataccaattgatctccataataattcagtagacataacaaaagagaagaatggagattatattgctggtatatctcttttttcacgagattttcataaggaaaatgacgatgtcccaaaagggaagatttttataaagttagctacccaaaaacaaaaaagcatgaaagttattttagaccgattaatgaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttattttgcgtttaatgaagggtttattcgtagcaatattaaaagtgatgaaattaaaacgtttaatgaaagaattcgacagagacgtatcaatttactgaaacaaagtaaatattgtagtaatagtagaactggaaaaggtaggacgaaacgattacagccaatagacgtgttaagtaataaaatagctaaatttagaaatagcactaatcataaatatgcaaactatataataaaacagtgtctaaaacataattgtgggcgtattcaaatggaacttttaaaaggcatatcaaaaaacgataaggttcttaaagattggacttattttgacttgcaggagaagatcaaaaatcaagcagagattcatggaattgaagttattaaaattgccccagcatatacaagtcaacgctgtagtcaatgcggatatatttgtaaagaaaatcgttgtacacaagctatgtttgaatgtaagcagtgtggatataaaacacatgctgattataatgcagcgaaaaacatttctacttatgacatcgaaaatattataaacaaacaattagcggtacaaagcaaattgcattcaaaaaaatgtatggcagagtatatggaagagttaggatacctggattaa

SEQ ID NO: 17 - DNA, 1356 bp, Unknown
  Bacillus sp. multi
ttgggagtaacaattaagataatgaaatatcaaattttatgtccaatgaatgtcgattggacaatatttgaaaaacaattacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataagggaaacatgtctaccactcttcaaaaaattataaaaacctggaagagtagaagaaatgaaattagaaaaggtgagatgtcaattccttcttttcgaaatcgcataccaattgatctccataataattcagtagacataataaaagagaagaatggagattatattgctggtatatctcttttttcacgagattttcataaggaaaatggcgatgtcccaaaagggaagatttttgtaaagttaggtacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaaacaaagtaaatattgtagtaatagcagaactggaaaaggtaggacgaaacgattacagcccatagacgtgttaagtaataaaatagctaagtttcgaaatagcactaatcataaatatgcaaactatatagtgaaacagtgtctaaaacataattgcgggcgtattcaaatggaacttttaaaaggtatatcaaaaaatgataaggttcttaaagattggacttattttgatttgcaggagaaaatcaaaaatcaggcagagatttatggaattgaagttattaaagttgtcccagcgtatacgagtcaacgatgtagtcaatgcggatatatttgtaaagaaaatcgttgtacacaagctatgtttgaatgtaagcagtgtggatataaaacacatgctgattataatgcggcgaaaaacatttccacttatgacatcgaaaatattataaataaacaattagcggtacaaagcaaattgcattcaaaaaaatgtatggaagagtatatagaagagttaggatacctggattaa

SEQ ID NO: 18 - DNA, 1335 bp, Unknown
  Bacillus sp. multi
atgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataagggaaacatgtctaccactcttcaaaaaattataaaaacctggaagagtagaagaaatgaaattagaaaaggtgagatgtcaattccttcttttcgaaatcgcataccaattgatctccataataattcagtagacataataaaagagaagaatggagattatattgctggtatatctcttttttcacgagattttcataaggaaaatggcgatgtcccaaaagggaagatttttgtaaagttaggtacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaaacaaagtaaatattgtagtaatagcagaactggaaaaggtaggacgaaacgattacagcccatagacgtgttaagtaataaaatagctaagtttcgaaatagcactaatcataaatatgcaaactatatagtgaaacagtgtctaaaacataattgcgggcgtattcaaatggaacttttaaaaggtatatcaaaaaatgataaggttcttaaagattggacttattttgatttgcaggagaaaatcaaaaatcaggcagagatttatggaattgaagttattaaagttgtcccagcgtatacgagtcaacgatgtagtcaatgcggatatatttgtaaagaaaatcgttgtacacaagctatgtttgaatgtaagcagtgtggatataaaacacatgctgattataatgcggcgaaaaacatttccacttatgacatcgaaaatattataaataaacaattagcggtacaaagcaaattgcattcaaaaaaatgtatggaagagtatatagaagagttaggatacctggattaa

SEQ ID NO: 19 - DNA, 1326 bp, Unknown
  Bacillus sp. multi
atgaaatatcaaattttatgtccaatgaatgtcgattggataatatttgaaaagcatttacgaaacttaacatatcaggtcagaacgataagtaatcgaactattcaacaattatgggagtttgatgctttatcctttgactactttaaagtaagagggacataccctactgtccaagatttgtatgggtgtacacagaagaaaattgacggttatatataccatacattacaaagtaaatatccagatattcataaaggaaacatgtctaccactcttcagaaaatcataaaaacgtggaaaagtagaagaaatgaaattagaaaaggtgaaatgtcaattccttcttttcgaaatcgcataccaattgatatccataataattctgtagacataacaaaagagaagaatggagattatattgctggtatatctcttttttcacgagattttcataaggaaaatggtgatgtcccaaaaggaaagatttttgtaaagttagctacccaaaaacaaaaaagtatgaaagttattttagaccgattaataaatcaaacatacagtaaaggcgcatgtatgatccataaatacaaaaataagtggtatttatcaattacttataaattcaatgctttaaaagaaaataaatttgataaagaattaatcatgggtattgatatgggtggaataaatacagtttactttgcatttaatgaagggtttattcgtaacaatattaaaagtgaagaaattaaaatgtttaatgaaagaattcgacagagacgtatcaacttattgaaacaaagtacatattgtagtaatagcagaacgggaaaaggtaggacgaaacgattacagccaatagacgtgttaagtaataaaatagctaagtttcgaaatagcaccaaccataaatatgcaaattatataataaaacagtgtctaaaacataattgtgggcgtattcaaatggaacttttaaaaggcatatcaaaaaatgataaggttcttaaagattggacgtattttgatttgcaggagaagatcaaaaatcaagctgagattcatgggattgaagttattaaagtggcccccgcatatacgagtcaacgatgtagtcaatgcggatatatttgtaaagaaaatcgttgtacacaagctatgtttgaatgtaagcagtgtggatataaaacacatgctgattataatgcggcgaaaaacattgctacttatgacatcgaaaatattataaataaacaattagcggtacaaagcaaattacattcaaaaaaatgtatggaagagtatatagaagagttaggataa

SEQ ID NO: 20 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtaaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 21 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataagggaaacatgtctaccactcttcaaaaaattataaaaacctggaagagtagaagaaatgaaattagaaaaggtgagatgtcaattccttcttttcgaaatcgcataccaattgatctccataataattcagtagacataataaaagagaagaatggagattatattgctggtatatctcttttttcacgagattttcataaggaaaatggcgatgtcccaaaagggaagatttttgtaaagttaggtacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaaacaaagtaaatattgtagtaatagcagaactggaaaaggtaggacgaaacgattacagcccatagacgtgttaagtaataaaatagctaagtttcgaaatagcactaatcataaatatgcaaactatatagtgaaacagtgtctaaaacataattgcgggcgtattcaaatggaacttttaaaaggtatatcaaaaaatgataaggttcttaaagattggacttattttgatttgcaggagaaaatcaaaaatcaggcagagatttatggaattgaagttattaaagttgtcccagcgtatacgagtcaacgatgtagtcaatgcggatatatttgtaaagaaaatcgttgtacacaagctatgtttgaatgtaagcagtgtggatataaaacacatgctgattataatgcggcgaaaaacatttccacttatgacatcgaaaatattataaataaacaattagcggtacaaagcaaattgcattcaaaaaaatgtatggaagagtatatagaagagttaggatacctggattaa

SEQ ID NO: 22 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgaccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatagcagaactggaaaaggtaggacgaaacgattacagccaatagacgtgttaagtaataaaatagctaagtttcaaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 23 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataagggaaacatgtctaccactcttcaaaaaattataaaaacctggaagagtagaagaaatgaaattagaaaaggtgagatgtcaattccttcttttcgaaatcgcataccaattgatctccataataattcagtagacataataaaagagaagaatggagattatattgctggtatatctcttttttcacgagattttcataaggaaaatggcgatgtcccaaaagggaagatttttgtaaagttaggtacccaaaaacaaaaaagcatgaaagttattttagaccgattaatcaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatagcagaactggaaaaggtaggatgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataagattcttaaagattggacttattttgatttgcaggagaagatcaaaaatcaagcagagattcatggaattgaagttattaaagttgccccagcgtatacgagtcaacgatgtagtcaatgtggatatatttgtaaagaaaatcgttgtacacaagctacgtttgaatgtaagcagtgtggatataaaacacatgctgattataatgcggcgaaaaacatttcaacttatgacatcgaaaatattataaataaacaattagcggtacaaagcaaattgcattcaaaaaaatgtatggaagagtatatagaagagttaggatacctggattaa

SEQ ID NO: 24 - DNA, 1335 bp, Unknown
  Bacillus sp. multi
atgaaatatcaaattttatgtccaatgaatgtcgattggacaatatttgaaaagcatttacggaacttaacatatcaggtcagaacgataagtaatcgaaccattcaacaactatgggagtttgatgctttatcctttgactactttaaagcaagagggacataccctactgtccaagatttgtatgggtgtacacagaagaaaattgacggttatatataccataaattacaaagtaaatatccagatatacataaaggaaacatgtctaccactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatggcgatgtcccaaaagggaagatttttgtaaagttaggtaccaaaaaacaaaaaagcatgaaagttattttagacagattaatgaatcaaacatacagcaaaggcgcatgtatgattcataaatacaagaataagtggtatttatcaattacttataaatgcaatgctttaaaagaaaataaatttgataaagaattaatcatgggaattgatatgggtggaatcaatacagtttactttgcttttaatgaagggtttattcgtaacaatattaaaagtgatgaaattaaagcgtttaatgaaagaattcgacagaggcgtatcaatttactgaaccaaagtaaatattgtagtaatagtagaacgggaaaaggtaggacgaaacggttacagcctatagacgtgttaagtaataaaatagctaagtttcgaaatagcactaaccataaatatgcaaactatataataaaacagtgtttaaaatataattgcgggcgcattcaaatggaacttttaaaaggcatatcaaaaaatgataaggttcttaaagattggacttattttgatttgcaggagaaaatcaaaaatcaagctgagattcgtggaattgaaattattaaagttgcccccgcatatacgagtcaacgatgtagtcaatgcggatatatttgtaaagaaaatcgttgtacacaagctatgtttgaatgtaaacaatgtggatataaaacacatgctgattataatgcggcaaaaaacattgctacttatgatatcgaaaatattataaataaacaattagcggcacaaagcaaattgcattcaaaaaaatgtatggaagagtatatagaagagttaggataccttgattaa

SEQ ID NO: 25 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataagggaaacatgtctaccactcttcaaaaaattataaaaacctggaagagtagaagaaatgaaattagaaaaggtgagatgtcaattccttcttttcgaaatcgcataccaattgatctccataataattcagtagacataataaaagagaagaatggagattatattgctggtatatctcttttttcacgagattttcataaggaaaatggcgatgtcccaaaagggaagatttttgtaaagttaggtacccaaaaacaaaaaagcatgaaagttattttagaccgattaatcaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaaacaaagtaaatattgtagtaatagcagaactggaaaaggtaggacgaaacgattacagcccatagacgtgttaagtaataaaatagctaagtttcgaaatagcactaatcataaatatgcaaactatatagtgaaacagtgtctaaaacataattgcgggcgtattcaaatggaacttttaaaaggtatatcaaaaaatgataaggttcttaaagattggacttattttgatttgcaggagaaaatcaaaaatcaggcagagatttatggaattgaagttattaaagttgtcccagcgtatacgagtcaacgatgtagtcaatgcggatatatttgtaaagaaaatcgttgtacacaagctatgtttgaatgtaagcagtgtggatataaaacacatgctgattataatacggcgaaaaacatttccacttatgacatcgaaaatattataaataaacaattagcggtacaaagcaaattgcattcaaaaaaatgtatggaagagtatatagaagagttaggatacctggattaa

SEQ ID NO: 26 - DNA, 1335 bp, Unknown
  Bacillus sp. multi
atgaaatatcaaattttatgtccaatgaatgttgattggacaatatttgaaaagcatttacgaaatttaacataccaggtcagaacgataagtaatcgaaccattcaacaattatgggagtttgatgctttatcctttgactactttaaagaaagagggacataccctactgtccaagatttgtatgggtgtacacagaagaaaattgatggttatatatatcatacattacaaagtaaatatccagatatacataaaggaaacatgtctaccactcttcaaaaaattataaaaacgtggaagagtagaagaaatgaaattagaaaaggtgaaatgtcaattccttcttttcgaaatcggataccaattgatctccataataattctgtagacataacaaaagagaagaatggagcttatattgctggtatatcttttttttcacgagattttcataaggaaaatggcgatgtcccaaaagggaagatttttgtaaagttatctactcaaaagcaaaaaagcatgaaagttattttagaccgattaatgaatcaaacatacagcaaaggcgcatgcatgattcataaatacaaaaataaatggtatttatcaattacttataaatttaatgctataaaagaaaataaatttgataaagaattaatcatgggaattgatatgggtggaataaatacagtttactttgcatttaatgaagggtttattcgtagcaatattaaaagtgatgaaattaaagcgtttaatgaaagaattcgacagagacgtatcaatttactgaaacaaagtaaatattgtagtaatagtagaacgggaaaaggtaggacgaaacgattacagccaatagacgtgttaagtaataaaatagctaagtttcgaaatagcactaatcataaatatgcaaactatatagtgaaacagtgtctaaagcataattgcgggcgtattcaaatggaacttttaaaaggtatatcaaaaaatgataagattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctatgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 27 - DNA, 1335 bp, Unknown
  Bacillus sp. multi
atgaaatatcaaattttatgtccaatgaatgtcgattggaccatatttgaaaagcatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataaaggaaacatgtctaccactcttcaaaaaatcataaaaacgtggaaaagtagaagaaatgaaattagaaaaggtgaaatgtcaattccttcttttcgaaatcgcataccaattgatctccataataattctgtagacataacaaaagagaagaatggagattatattgctggtatatcccttttttcacgagattttcataaggaaaatggtgatgtcccaaaaggaaagatttttgtaaagttagctacccaaaaacaaaaaagtatgaaagttattttagaccgattaatgaatcaaacatacagtaaaggcgcatgtatgatccataaatacaaaaataagtggtatttatcaattacttataaattcaatgctttaaaagaaaataaatttgataaagaattaatcatgggtattgatatgggcggaataaatacagtttactttgcatttaataaagggtttattcgtagcaatattaaaagtgatgaaattaaaacgtttaatgaaagaattcgacagagacgtatcaatttactgaaccaaagtaaatattgtagtaatagcagaactggaaaaggtaggacgaaacggttacagccaatagacgtgttaagtaataaaatagctaagtttcgaaatagcactaaccataaatacgcaaactatataataaaacagtgtctaaaacataattgcgggcgtattcaaatggaacttttaaaaggcatatcaaaaaatgataaggttcttaaagattggacttattttgacttgcaggagaagatcaaaaatcaagcagaaattcatggaattgaagttattaaaattgccccagcatatacgagtcaacgatgtagtcaatgcggatatatttgtaaagaaaatcgttgtacacaagatatgtttgaatgtaagcaatgtggatacaaaacacatgctgattataatgccgcgaaaaatatttctacttatggcatcgaaaatattataaacaaacaattagcggtacaaagcaaattgcattcaaaaaaatgtatggaagagtatatagaaaagttaggataccttgattaa

SEQ ID NO: 28 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtaaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatggcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 29 - DNA, 1335 bp, Unknown
  Bacillus sp. multi
atgaaatatcaaattttatgtccaatgaatgtcgattggacaatatttgaaaaacatttacgaaacttaacatatcaggttagaacgataagtaatcgaaccattcaacaattatgggagtttgatgctttatcctttgaatactttaaagaaagagggacataccctactgtccaagatttgtatgggtgtacacagaagaaaattgatggatatatataccatacattacaaagtaaatatccagatatacataaaggaaacatgtctactactcttcaaaaaattataaaaacgtggaagagtagaagaaatgaaattagaaaaggtgaaatgtcgattccttcttttcgaaatcgcataccaattgatctccataataattctgtagacataataaaagagaagaatggagattatattgctggtatctctcttttttcacgagattttcataaggaaaatggcgatgtcccaaaaggtaagatttttgtaaagctagctacccaaaaacaaaaaagcatgaaagttattttagaccgattaattaatcaaacatacagcaaaggtgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaagcaaagtaaatattgtagtaatagcagaactggaaaaggtaggacgaaacgattacagccaatagacgtgttaagtaataaaatagctaagtttcgaaatagcactaaccataaatatgcaaactatatagtgaaacagtgtctaaagcataattgcgggcgtattcaaatggaacttttaaaaggtatatcaaaaaatgataagattcttaaagattggacttattttgatttgcaggagaagatcaaaaatcaagcagagattcatggaattgaagttattaaagttgtcccagcgtatacgagtcaacgatgtagtcaatgcggatatatttgtaaagaaaatcgctgtacacaagctacgtttgaatgtaagcagtgtggatataaaacacatgctgattataatgcggcgaaaaacctttctacttatgacatcgaaaatattataaacaagcaattagcggtacaaagcaaattgcattcaaaaaaatgtatggaagagtatatagaagagttaggatacctggattaa

SEQ ID NO: 30 - DNA, 1356 bp, Unknown
  Bacillus sp. multi
ttgggagtaacaattaagataatgaaatatcaaattttatgtccaatgaatgtcgattgggcaatatttgaaaaacatttacgaagcttaacatatcaggtcagaacgataagtaatcgaaccattcaacaattatgggagtttgatgctttatcctttgactactttaaggaaacaggtacatcccctactgtccaagatttgtatgggtgtacacagaagaaaattgatggttatatataccatacattacaaagtaaatatccagatatacataaaggaaacatgtctaccactcttcaaaaaattataaaaacgtggaagagtagaagaaatgaaattagaaaaggtgaaatgtcaattccttcttttcgaaatcggataccaattgatctccataataattctgtagacataacaaaagagaagaatggagattatattgctggtatatctcttttttcacgagattttcataaggaaaatagcgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttattttgcgtttaatgaaggatttattcgtagcaatattaaaagcgatgaaattaaaacgtttaatgaaagaattcgacagagacgtatcaatttactgaaacaaagtaaatattgtagtaatagcagaattggaaaaggtaggacgaaacggttacagccaatagacgttttaagtaataaaatagctaaatttcgaaatagtactaaccataaatatgcaaactatataataaaacagtgtctaaaacataattgtgggcgtattcaaatggaacttttaaaaggcatattaaaaaatgataaagttcttaaaaattggacttattttgatttacaggagaagatcaaaaatcaagcaaagattcatggaattgaagttattaaaattgccccagcgtatacgagtcaacgatgtagtcaatgcggatatatttgtaaagaaaatcgttgtacacaagctatgtttgaatgtaagcagtgtggatataaaacacatgctgattataatgcggcgaaaaacatttctacttatgacatcgaaaatattataaacaaacaattagcggtacaaagcaaattacattcaaaaaaatgtatggaagagtatatagaagagttaggatacctggattaa

SEQ ID NO: 31 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataagggaaacatgtctaccactcttcaaaaaattataaaaacctggaagagtagaagaaatgaaattagaaaaggtgagatgtcaattccttcttttcgaaatcgcataccaattgatctccataataattcagtagacataataaaagagaagaatggagattatattgctggtatatctcttttttcactagattttcataaggaaaatggcgatgtcccaaaagggaagatttttgtaaagttaggtacccaaaaacaaaaaagcatgaaagttattttagaccgattaatcaatcaaacatacagcaaaggcgcatgtatgattcataaatacaaaaataagtggtatttatcaattacttataaattcaatgctataaaagaaaataaatttgataaaaaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaaacaaagtaaatattgtagtaatagcagaactggaaaaggtaggacgaaacgattacagcccatagacgtgttaagtaataaaatagctaagtttcgaaatagcactaatcataaatatgcaaactatatagtgaaacagtgtctaaaacataattgcgggcgtattcaaatggaacttttaaaaggtatatcaaaaaatgataaggttcttaaagattggacttattttgatttgcaggagaaaatcaaaaatcaggcagagatttatggaattgaagttattaaagttgtcccagcgtatacgagtcaacgatgtagtcaatgcggatatatttgtaaagaaaatcgttgtacacaagctatgtttgaatgtaagcagtgtggatataaaacacatgctgattataatgcggcgaaaaacatttccacttatgacatcgaaaatattataaataaacaattagcggtacaaagcaaattgcattcaaaaaaatgtatggaagagtatatagaagagttaggatacctggattaa

SEQ ID NO: 32 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaaccatccaacaattatgggagtttgatgctttatcttttgactactttaaagaaagagggacataccctactgtccaagatttgtatgggtgtacacagaagaaaattgatggttatatataccatacattacaaagtaaatatccagatatacataaggggaacatgtctaccactcttcaaaaaattataaaaacgtggaagagtagaagaaatgaaattagaaaaggtgagatgtcaattccttcttttcgaaatcgcataccaattgacctccataataattcagtagacataataaaagagaagaatggagattatattgctggtatatctcttttttcgcgagattttcataaggaaaatgacgatgtcccaaaagggaagatttttgtaaagttatctactcaaaaacaaaaaagcatgaaagttattttagatcgattaatgaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatatttaatgaaagaattcgacagagacgtatcaatttattgaaacaaagtaaatattgtagtaatagcagaactggaaaaggtaggacgaaacgattacagccaatagacgtgttaagtaataaaatagctaagtttcgaaatagtactaatcataaatatgcaaactatatagtgaaacagtgtctaaagcataattgcgggcgtattcaaatggaacttttaaaaggtatatcaaaaaatgataagattcttaaagattggacttattttgatttgcaggaaaagatcaaaaatcaagcagagattcatggaattgaagttattaaaattgcccccgcatatacgagtcaacgatgtagtcaatgcggatatatttgtaaagaaaatcgttgtacacaagctgtttttgaatgtaagcagtgtggatataaaacacatgctgattataatgcggcgaaaaacatttctatctatgacatcgaaaatattataaataaacaattagcggtacaaagcaaattgcattcaaaaaaatgtatggaagagtatatagaagagttaggatacctggattaa

SEQ ID NO: 33 - DNA, 1335 bp, Unknown
  Bacillus sp. multi
atgaaatatcaaattttatgtccaatgaatgttgattggacaatatttgaaaagcatttacgaaatttaacataccaggtcagaacgataagtaatcgaaccattcaacaattatgggagtttgatgctttatcctttgactactttaaagaaagagggacataccctactgtccaagatttgtatgggtgtacacagaagaaaattgatggttatatatatcatacattacaaagtaaatatccagatatacataaaggaaacatgtctaccactcttcaaaaaattataaaaacgtggaagagtagaagaaatgaaattagaaaaggtgaaatgtcaattccttcttttcgaaatcggataccaattgatctccataataattctgtagacataacaaaagagaagaatggagcttatattgctggtatatcttttttttcacgagattttcataaggaaaatggcgatgtcccaaaagggaagatttttgtaaagttatctactcaaaaacaaaaaagcatgaaagttattttagaccgattaatgaatcaaacatacagcaaaggcgcatgtatgattcataaatacaaaaataaatggtatttatcaattacttataaattcaatgctataaaagaaaataaatttgataaagaattaatcatgggaattgatatgggtggaataaatacagtttactttgcatttaatgaaggatttattcgtagcaatattaaaagcgatgaaattaaaatgtttaatgaaagaattcgacagagacgtatcaacttattgaaacaaagtaaatattgtagtaatagcagaactggaaaaggtaggacgaaacgattacagccaatagacgtgctaagtaataaaatagctaagtttcgaaatagcactaatcataaatatgcaaactatatagtgaaacagtgtctaaagcataattgcgggcggattcaaatggaacttttaaaaggtatatcaaaaaatgataagattcttaaagattggacttattttgatttgcaggagaaaatcaaaaatcaagcagagattcatggaattgaagttataaaagttgccccagcgtatacgagtcaaagatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 34 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataaaggaaacatgtctaccactcttcaaaaaattataaaaacatggaagagtagaagaaatgaaattagaaaaggtgaaatgtcaattccttcttttcgaaatcgcataccaattgatctccataataattctgtagacataaaaaaagagaagaatggagattatattgctgggatatctcttttttcacgagattttcataaggaaaatagcgatgtcccaaaagggaagatttttgtaaagttagctaccaaaaaacaaaaaagcatgaaaattattttagaccgattaatgaatcaaacatacagcaaaggcgcatgtatgattcataaatacaaaaataagtggtatttatcaattacttataaattcaatgctataaaagaaaataaatttgataaagatttaatcatgggaattgatatgggtggaataaatacagtttactttgcatttaatgaagggtttattcgtagcaatattaaaagtgatgaaattaaagcgtttaatgaaagaattcgacagagacgtatcaatttgctgaaacaaagtaaatattgtagtaatagtagaacgggaaaaggtagggaaaaacggttacagccaatagacgtgttaagtaataaaatagctaagtttcgaaatagcactaaccataaatatgcaaactatataataaaacagtgtctaaaacataattgcgggcgtattcaaatggaacttttaaaaggcatatcaaaaaatgataaggttcttaaagattggacttattttgatttgcaggagaagattcaaaatcaagccgagattcatggaattgaagttattaaagttgcccccgcatatacgagtcaacgatgtagtcaatgcggatatatttgtaaagaaaatcgttgtacacaagctgtgtttgaatgtaagcagtgtggatataaaacacatgctgattataatgcggccaaaaacattgctacttatgacatcgaaaatattataaataaacaattagcggtacaaagcaaattgcattcaaaaaaatgtatggaagagtatatagaagagttaggataccttgattaa

SEQ ID NO: 35 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggttagaacgataagtaatcgaaccattcaacaattatgggagtttgatgctttatcctttgaatactttaaagaaagagggacataccctactgtccaagatttgtatgggtgtacacagaagaaaattgatggatatatataccatacattacaaagtaaatatccagatatacataaaggaaacatgtctactactcttcaaaaaattataaaaacgtggaagagtagaagaaatgaaattagaaaaggtgaaatgtcgattccttcttttcgaaatcgcataccaattgatctccataataattctgtagacataataaaagagaagaatggagattatattgctggtatctctcttttttcacgagattttcataaggaaaatggcgatgtcccaaaaggtaagatttttgtaaagctagctacccaaaaacaaaaaagcatgaaagttattttagaccgattaattaatcaaacatacagcaaaggtgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaagcaaagtaaatattgtagtaatagcagaactggaaaaggtaggacgaaacgattacagccaatagacgtgttaagtaataaaatagctaagtttcgaaatagcactaaccataaatatgcaaactatatagtgaaacagtgtctaaagcataattgcgggcgtattcaaatggaacttttaaaaggtatatcaaaaaatgataagattcttaaagattggacttattttgatttgcaggagaagatcaaaaatcaagcagagattcatggaattgaagttattaaagttgtcccagcgtatacgagtcaacgatgtagtcaatgcggatatatttgtaaagaaaatcgctgtacacaagctacgtttgaatgtaagcagtgtggatataaaacacatgctgattataatgcggcgaaaaacctttctacttatgacatcgaaaatattataaacaagcaattagcggtacaaagcaaattgcattcaaaaaaatgtatggaagagtatatagaagagttaggatacctggattaa

SEQ ID NO: 36 - DNA, 1335 bp, Unknown
  Bacillus sp. multi
atgaaatatcaaattttatgtccaatgaatgtcgattggataatatttgaaaagcatttacgaaacttaacatatcaggtcagaacgataagtaatcgaactattcaacaattatgggagtttgatgctttatcctttgactactttaaagcaagagggacataccctactgtccaagatttgtatgggggtacacagaagaaaattgacggttatatataccatacattacaaagtaaatatccagatattcataaaggaaacatgtctaccactcttcagaaaatcataaaaacgtggaaaagtagaagaaatgaaattagaaaaggtgaaatgtcaattccttcttttcgaaatcgcataccaattgatatccataataattctgtagacataacaaaagagaagaatggagattatattgctggtatatctcttttttcacgagattttcataaggaaaatggtgatgtcccaaaaggaaagatttttgtaaagttagctacccaaaaacaaaaaagtatgaaagttattttagaccgattaataaatcaaacatacagtaaaggcgcatgtatgatccataaatacaaaaataagtggtatttatcaattacttataaattcaatgctttaaaagaaaataaatttgataaagaattaatcatgggtattgatatgggtggaataaatacagtttactttgcatttaatgaagggtttattcgtaacaatattaaaagtgaagaaattaaaatgtttaatgaaagaattcgacagagacgtatcaacttattgaaacaaagtacatattgtagtaatagcagaacgggaaaaggtaggacgaaacgattacagccaatagacgtgttaagtaataaaatagctaagtttcgaaatagcaccaaccataaatatgcaaattatataataaaacagtgtctaaaacataattgtgggcgtattcaaatggaacttttaaaaggcatatcaaaaaatgataagattcttaaagattggacgtattttgatttgcaggagaagatcaaaaatcaagctgagattcatgggattgaagttattaaagtggcccccgcatatacgagtcaacgatgtagtcaatgcggatatatttgtaaagaaaatcgttgtacacaagctatgtttgaatgtaagcagtgtggatataaaacacatgctgattataatgcggcgaaaaacattgctacttatgacatcgaaaatattataaataaacaattagcggtacaaagcaaattacattcaaaaaaatgtatggaagagtatatagaagagttaggatacctggattaa

SEQ ID NO: 37 - DNA, 1335 bp, Bacillus thuringiensis
atgaaatatcaaattttatgtccaatgaatgtcgattggaccatatttgaaaagcatttacgaaacttaacatatcaggtcagaacgataagtaatcgaaccattcaacaattatgggagtttgatgctttatcctttgactactttaaagcaagagggacataccctactgtccaagatttgtatgggtgtacacagaagaaaattgacggttatatataccatacattacaaagtaaatatccagatatacataaaggaaacatgtctaccactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggaatatctcttttttcacgggattttcataaggaaaatgacgatgtcccaaaagggaagatttttgtaaagttagctaccaaaaaacaaaaaagtatgaaaattattttagatcgattaatgaatcaaacatacagcaaaggcgcatgtatgattcataaatacaaaaataagtggtatttatcaattacttataaattcaatgctataaaagaaaataaatttgataaagagttaatcatgggaattgatatgggtggaataaatacaatttactttgcatttaatgaagggtttattcgtagcaatattaaaagtgatgaaattaaaacgtttaatgaaagaattcgacagagacgtatcaatttactgaaccaaagtaaatattgtagtaatagcagaactggaaaaggtaggacgaaacggttacagccaatagacgtgttaagtaataaaatagctaagtttcgaaatagcactaaccataaatacgcaaactatataataaaacagtgtctaaaacataattgcgggcgtattcaaatggaacttttaaaaggcatatcaaaaaatgataaggttcttaaagattggacttattttgacttgcaggagaagatcaaaaatcaagcagaaattcatggaattgaagttattaaaattgccccagcatatacgagtcaacgatgtagtcaatgcggatatatttgtaaagaaaatcgttgtacacaagatatgtttgaatgtaagcaatgtggatacaaaacacatgctgattataatgccgcgaaaaatatttctacttatggcatcgaaaatattataaacaaacaattagcggtacaaagcaaattgcattcaaaaaaatgtatggaagagtatatagaaaagttaggataccttgattaa

SEQ ID NO: 38 - DNA, 1356 bp, Unknown
  Bacillus sp. multi
ttgggagtaacaattaaaataatgaaatatcaaattttatgtccaatgaatgtcgattggacaatatttgaaaaacatttacgaaacttaacatatcaggtcagaacaataagtaatcgaaccattcaacaattatgggagtttgatgctttatcctttgactactttaaagcaagagggacataccctactgtccaagatttgtatgggtgtacacagaagaaaattgacggttatatataccatacattacaaagtaaatatccagatatacataaaggaaacatgtctaccactcttcaaaaaattataaaaacgtggaagagtagaagaaatgaaattagaaaaggtgaaatgtcaattccttcttttcgaaatcgcataccaattgatctccataataattctgtagaaataacaaaagagaagaatggagattatattgctggtatatctcttttttcacgagattttcataaggaaaatggtgatgtcccaaaaggaaagatttttttaaagttaggtacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaagcgtttaatgaaaaaattcgacagagacgtatcaatttactgaaacaaagtaattattgtagtaatagtagaacgggaaaaggtagggcaaaacggttacagccaatagacgtgttaagtaataaaatagctaagtttcgaaatagcactaaccataaatatgcaaactatataataaaacagtgcctaaaacataactgcgggcgtattcaaatagaacttttaaaaggcatatcaaaaaatgataaggttcttaaagattggacgtattttgatttacaggagaagatcaaaaatcaagctgagattcatgggattgaagttattaaagtggccccggcatatacgagtcaacgatgtagtcaatgcggatatatttgtaaagaaaatcgttgtacacaagctatgtttgaatgtaagcagtgtggatataaaacacatgctgattataacgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 39 - DNA, 1338 bp, Unknown
  Bacillus sp. multi
ttgggagtaacaattaagataatgaaatatcaaattttatgtccactgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagtaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaataattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctatgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 40 - DNA, 1356 bp, Unknown
  Bacillus sp. multi
ttgggagtaacaattaagataatgaaatatcaaattttatgtccaatgaatgtcgattggaccatatttgaaaagcatttacggaacttaacatatcaggtcagaacgataagcaatcgaaccattcaacaattatgggagtttgatgctttatcctttgactactttaaagcaatagggacataccctactgtccaagatttgtatgggtgtacacagaagaaaattgacggttatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgtataccaattgatctccataataattctgtagacataacaaaagagaagcatggagattatattgctggtatatctcttttttcacgagactttcataaggaaaataacgatgttccaaaagggaagatttttgtaaagttagctacccaaaaacaaaaaagtatgaaagttattttagaccgattaatgaatcaaacatacagtaaaggcgcatgtatgatctataaatacaaaaataagtggtatttatcaattacttataaattcaatgctttaaaagaaaataaatttgataaagaattaatcatgggtattgatatgggtggaataaatacagtttaccttgcatttaatgaagggtttattcgtagcaatattaaaagtgacgaaattaaaatgtttaatgaaagaattcgacagagacgtatcaacttattgaaacaaagtaaatattgtagtaatagcagaacgggaaaaggtaggacgaaacgattacagccaatagacgtgttaagtaataaaatagctaagtttcgaaatagcactaatcataaatatgcaaattatataataaaacagtgtctaaaacataattgcgggcgtattcaaatggaacttttaaaaggcatatcaaaaaatgataaggttcttaaagattggacgtattttgatttacaggagaagatcaaaaatcaagctgagattcatgggattgaagttattaaagtggccccagcatatacgagtcaacgatgtagtcaatgcggatatatttgtaaagaaaatcgttgtacacaagctatgtttgaatgtaagcagtgtggatataaaacacatgctgattataacgcggcgaaaaacatttctacttataacatcgaaaatattataaataaacaattagcggtacaaagcaaattgcattcaaaaaaatgtatggaagagtatatagaagagttaggatacctggattaa

SEQ ID NO: 41 - DNA, 1335 bp, Unknown
  Bacillus sp. multi
atgaagtatcaaattttatgtccaatgaatgacgattggacaatatttgaaaaacatttacgaaacttaacatatcaggtcagaacaataagtaatcgaaccattcaacaattatgggagtttgatgctttatcctttgactactttaaagcaagagggacataccctactgtccaagatttgtatgggtgtacacagaagaaaattgacggttatatataccatacattacaaagtaaatatccagatatacataaaggaaacatgtctaccactcttcaaaaaattataaaaacgtggaagagtagaagaaatgaaattagaaaaggtgaaatgtcaattccttcttttcgaaatcgcaaaccaattgatctccataataattctgtagacataacaaaagagaagaatggagattatattgctggtatatctcttttttcacgagattttcataaggaaaatggtgatgtcccaaaaggaaagatttttttaaagttaggtacccaaaaacaaaaaagcatgaaagttattttagatcgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaagcgtttaatgaaagaattcgacagagacgtatcaatttactgaaacaaagtaaatattgtagtaatagtagaacgggaaaaggtagggaaaaacggttacagccaatagacatgttaagtaataaaatagctaagtttcgaaatagcactaaccataaatatgcaaattatataataaaacagtgtctaaaacataattgcgggcgtattcaaatggaacttttaaaaggcatatcaaaaaatgataaggttcttaaagattggacgtattttgatttacaagagaaaatcaaaaatcaagctgagattcatgggattgaagttattaaagtggccccagcatatacgagtcaacgatgtagtcaatgcggatatatttgtaaagaaaatcgttgtacacaagatatgtttgaatgtaagcagtgtggatataaaacacatgctgattataacgcggcgaaaaacatttctacttataacatcgaaaatattataaataaacaattggcggtacaaagcaaattgcattcaaaaaaatgtatggaagagtatatagaagagttaggatacctggattaa

SEQ ID NO: 42 - DNA, 1356 bp, Unknown
  Bacillus sp. multi
ttgggagtaacaattaaaataatgaaatatcaaattttatgtccaatgaatgtcgattggacaatatttgaaaaacatttacgaaacttaacatatcaggtcagaacaataagtaatcgaaccattcaacaattatgggagtttgatgctttatcctttgactactttaaagcaagagggacataccctactgtccaagatttgtatgggtgtacacagaagaaaattgacggttatatataccatacattacaaagtaaatatccagatatacataaaggaaacatgtctaccactcttcaaaaaattataaaaacgtggaagagtagaagaaatgaaattggaaaaggtgaaatgtcaattccttcttttcgaaatcgcataccaattgatctccataataattctgtagaaataacaaaagagaagaatggagattatattgctggtatatctcttttttcacgagattttcataaggaaaatggtgatgtcccaaaaggaaagatttttttaaagttaggtacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaagggtttattcgtagcaatattaaaagtgatgaaattaaagcgtttaatgaaaaaattcgacagagacgtatcaatttactgaaacaaagtaattattgtagtaatagtagaacgggaaaaggtagggcaaaacggttacagccaatagacgtgttaagtaataaaatagctaagtttcgaaatagcactaaccataaatatgcaaactatataataaaacagtgcctaaaacataactgcgggcgtattcaaatagaacttttaaaaggcatatcaaaaaatgataaggttcttaaagattggacgtattttgatttacaggagaagatcaaaaatcaagctgagattcatgggattgaagttattaaagtggccccggcatatacgagtcaacgatgtagtcaatgcggatatatttgtaaagaaaatcgttgtacacaagctatgtttgaatgtaagcagtgtggatataaaacacatgctgattataacgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 43 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataaaggaaacatgtctaccactcttcaaaaaattataaaaacatggaagagtagaagaaatgaaattagaaaaggtgaaatgtcaattccttcttttcgaaatcgcataccaattgatctccataataattctgtagacataaaaaaagagaagaatggagattatattgctgggatatctcttttttcacgagattttcataaggaaaatagcgatgtcccaaaagggaagatttttgtaaagttagctaccaaaaaacaaaaaagcatgaaaattattttagaccgattaatgaatcaaacatacagcaaaggcgcatgtatgattcataaatacaaaaataagtggtatttatcaattacttataaattcaatgctataaaagaaaataaatttgataaagatttaatcatgggaattgatatgggtggaataaatacagtttactttgcatttaatgaagggtttattcgtagcaatattaaaagtgatgaaattaaagcgtttaatgaaagaattcgacagagacgtatcaatttactgaaacaaagtaaatattgtagtaatagtagaatgggaaaaggtagggaaaaacggttacagccaatagacgtgttaagtaataaaatagctaagtttcgaaatagcactaaccataaatatgcaaactatataataaaacagtgtctaaaacataattgcgggcgtattcaaatggaacttttaaaaggcatatcaaaaaatgataaggttcttaaagattggacttattttgatttgcaggagaagattcaaaatcaagccgagattcatggaattgaagttattaaagttgcccccgcatatacgagtcaacgatgtagtcaatgcggatatatttgtaaagaaaatcgttgtacacaagctgtgtttgaatgtaagcagtgtggatataaaacacatgctgattataatacggccaaaaacattgctacttatgacatcgaaaatattataaataaacaattagcggtacaaagcaaattgcattcaaaaaaatgtatggaagagtatatagaagagttaggataccttgattaa

SEQ ID NO: 44 - DNA, 1335 bp, Unknown
  Bacillus sp. multi
atgaaatatcaaattttatgtccaatgaatgtcgattggacaatatttgaaaaacatttacgaaacttaacatatcaggtcagaacaataagtaatcgaaccattcaacaattatgggagtttgatgctttatcctttgactactttaaagcaagagggacataccctactgtccaagatttgtatgggtgtacacagaagaaaattgacggttatatataccataaattacaaagtaaatatccagatatacataaaggaaacatgtctaccactcttcaaaaaattataaaaacgtggaagagtagaagaaatgaaattagaaaaggtgaaatgtcaattccttcttttcgaaatcgcataccaattgatctccataataattctgtagaaataacaaaagagaagaatggagattatattgctggtatatctcttttttcacgagattttcataaggaaaatggtgatgtcccaaaaggaaagatttttttaaagttaggtacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaagcgtttaatgaaaaaattcgacagagacgtatcaatttactgaaacaaagtaattattgtagtaatagtagaacgggaaaaggtagggcaaaacggttacagccaatagacgtgttaagtaataaaatagctaagtttcgaaatagcactaaccataaatatgcaaactatataataaaacagtgcctaaaacataactgcgggcgtattcaaatagaacttttaaaaggcatatcaaaaaatgataaggttcttaaagattggacgtattttgatttacaggagaagatcaaaaatcaagctgagattcatgggattgaagttattaaagtggccccggcatatacgagtcaacgatgtagtcaatgcggatatatttgtaaagaaaatcgttgtacacaagctatgtttgaatgtaagcagtgtggatataaaacacatgctgattataacgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 45 - DNA, 1368 bp, Unknown
  Bacillus sp. multi
ttgggagtaacaattaagataatgaaatatcaaattttatgtccaatgaatgtcgattggataatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacggaagaaaattgatgtctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatagcagaactggaaaaggtaggacgaaacgattacagccaatagacgtgttaagtaataaaatagctaagtttcgaaatagcactaaccataaatatgcaaactatatagtgaaacagtgtctaaagcataattgcgggcggattcaaatggaacttttaaaaggtatatcaaaaaatgataagattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagtatatagaagagttaggatacctggattaa

SEQ ID NO: 46 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataaaggaaacatgtctaccactcttcaaaaaattataaaaacgtggaagagtagaagaaatgaaattagaaaaggtgaaatgtcagttccttcttttcgaaatcacataccaattgatatccataataattctgtagacataacaaaagagaaaaatggagattatattgctggtatatctcttttttcacgagattttcataaggaaaatggcgatgtcccaaaagggaagatttttgtaaagttatctactcaaaaacaaaaaagcatgaaagttattttagaccgattaatgaatcaaacatacagcaaaggcgcatgtatgattcataaatacaaaaataagtggtatttatcaattacttataaattcaatgctataaaagaaaataaatttgataaagatttaatcatgggaattgatatgggtggaataaatacagtttactttgcatttaatgaagggtttattcgtagcaatattaaaagtgatgaaattaaagcgtttaatgaaagaattcgacagagacgtatcaatttactgaaacaaagtaaatattgtagtaatagtagaacgggaaaaggtagggaaaaacggttacagccaatagacgtgttaagtaataaaatagctaagtttcgaaatagcactaaccataaatatgcaaactatataataaaacagtgtctaaaacataattgcgggcgtattcatatggaacttttaaaaggcatatcaaaaaatgataaggttcttaaagattggacttattttgatttgcaggagaagatccaaaatcaagccgagattcatggaattgaagttattaaagttgcccccgcatatacgagtcaacgatgtagtcaatgcggatatatttgtaaagaaaatcgttgtacacaagctgtgtttgaatgtaagcagtgtggatataaaacacatgctgattataatgcggccaaaaacattgctacttatgacatcgaaaatattataaataaacaattagcggtacaaagcaaattgcattcaaaaaaatgtatggaagagtatatagaagagttaggatacctggattaa

SEQ ID NO: 47 - DNA, 1338 bp, Unknown
  Bacillus sp. multi
ttgggagtaacaattaagataatgaaatatcaaattttatttccactgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttattttgcatttaatgaaggatttattcgtagcaatattaaaagcgatgaaataattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 48 - DNA, 1338 bp, Unknown
  Bacillus sp. multi
ttgggagtaacaattaagataatgaaatatcaaattttatgtccactgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagtaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaataattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 49 - DNA, 1356 bp, Unknown
  Bacillus sp. multi
ttgggagtaacaattaagataatgaaatatcaaattttatgtccaatgaatgtcgattggacaatatttgaaaagcatttacgaaatttaacataccaggtcagaacgataagtaaccgaactattcaacaattatgggaatttgatgctttatcctttgactacttcaaagaaagagggacataccctactgtccaagatttgtatgggtgtacacagaagaaaattgatggttatatataccatacattacaaagtaagtatccagatatacataagggaaacatgtctaccactcttcaaaaaattataaaaacgtggaagagtagaagaaatgaaattagaaaaggtgaaatgtcaattccttcttttcgaaatcgcataccaattgatctccataacaattctgtagatataacaaaagagaagaatggagattatattgctggtatatctctttttttacgagattttcataaggaaaatggggatgtcccaaaagggaagatttttgtaaagttatctactcaaaaacaaaaaagcatgaaagttattttagaccgattaatgaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgacgaaattaaaatgtttaatgaaagaattcgacagagacgtatcaacttattgaaacaaagtaaatattgtagtaatagcagaattggaaaaggtaggacgaaacgattacagccaatagacgtgttaagtaataaaatagctaagtttcgaaatagcactaatcataaatatgcaaactatatagtgaaacagtgtctaaagcataattgcgggcgtattcaaatggaacttttaaaaggtatatcaaaaaatgataagattcttaaagattggacttattttgatttgcaggaaaagatcaaaaatcaagcagggattcatggaattgaagttattaaaattgcccccgcatatacgagtcaacgatgtagtcaatgcggatatatttgtaaagaaaatcgttgtacacaagctgtttttgaatgtaagcagtgtggatataaaacacatgctgattataatgcggcgaaaaacatttctatctatgacatcgaaaatattataaataaacaattagcggtacaaagcaaattgcattcaaaaaaatgtatggaagagtatatagaagagttaggataccttgattaa

SEQ ID NO: 50 - DNA, 1317 bp, Unknown
  Bacillus sp. multi
atgaaatatcaaattttatgtccactgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagtaaaggcgcatgtatgattcataaatacaaaaataagtggtatttatcaattacttataaattcaatgctataaaagaaaataaatttgataaagaattaatcatgggaattgatttgggtggaataaatacagtttactctgcatttaatgaaggatttattcgtagcaatattaaaagcgatgaaataattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 51 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaaccatccaacaattatgggagtttgatgctttatcttttgactactttaaagaaagagggacataccctactgtccaagatttgtatgggtgtacacagaagaaaattgatggatatatataccatacattacaaagtaaatatccagatatacataagggaaacatgtctaccactcttcaaaaaattataaaaacgtggaagagtagaagaaatgaaattagaaaaggtgagatgtcaattccttcttttcgaaatcgaataccaattgatctccataataattcagtagacataataaaagagaagaatggagattatattgctggtatatctcttttttcacgagattttcataaggaaaatggggatgtcccaaaagggaagatttttgtaaagttatctaatcaaaaacaaaaaagcatgaaagttattttagaccgattaatgaatcaaacatacagcaaaggcgcatgtatgattcataaatataaaaataagtggtatttatcaattacttataaattcaatgctataaaagaaaataagtttgataaagaattaattatgggaattgatatggggggaataaatacagtttattttgcatttaatgaagggtttattcgcagcaatattaaaagtgatgaaattaaaatgtttaatgaaagaattcgacagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcgtattcaaatggaacttttaaaaggtatagcaaaaaatgataagattcttaaagattggacttattttgatttgcaggagaagatcaaaaatcaagcagagattcatggaattgaagttattaaaattgcccccgcatatacgagtcaacgatgtagtcaatgcggatatatttgtaaagaaaatcgttgtacacaagctgtttttgaatgtaagcagtgtggatataaaacacatgctgattataatgcggcgaaaaacatttctatctatgacatcgaaaatattataaataaacaattagcggtacaaagcaaattgcattcaaaaaaatgtatggaagagtatatagaagagttaggatacctggattaa

SEQ ID NO: 52 - DNA, 1338 bp, Unknown
  Bacillus sp. multi
ttgggagtaacaattaagataatgaaatatcaaattttatgtccactgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaataattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggctataaaacacatgctgattataatgcggcgaaaaacatttctacttatgacatcgaaaatattataaataaacaattagcggtacaaagcaaattgcattcaaaaaaatgtatggaagagtatatagaaaagttaggatacctggattaa

SEQ ID NO: 53 - DNA, 1338 bp, Bacillus
ttgggagtaacaattaagataatgaaatatcaaattttatgtccactgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagtaaaggcgcatgtatgattcataaatacaaaaataagtggtatttatcaattacttataaattcaatgctataaaagaaaataaatttgataaagaattaatcatgggaattgatttgggtggaataaatacagtttactctgcatttaatgaaggatttattcgtagcaatattaaaagcgatgaaataattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 54 - DNA, 1335 bp, Bacillus thuringiensis
atgaaatatcaaattttatgtccaatgaatgtcgattggacaatatttgaaaagcatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataaaggaaacatgtctaccactcttcaaaaaattataaaaacatggaagagtagaagaaatgaaattagaaaaggtgaaatgtcaattccttcttttcgaaatcgcataccaattgatctccataataattctgtagacataaaaaaagagaagaatggagattatattgctgggatatctcttttttcacgagattttcataaggaaaatagcgatgtcccaaaagggaagatttttgtaaagttagctaccaaaaaacaaaaaagcatgaaaattattttagaccgattaatgaatcaaacatacagcaaaggcgcatgtatgattcataaatacaaaaataagtggtatttatcaattacttataaattcaatgctataaaagaaaataaatttgataaagatttaatcatgggaattgatatgggtggaataaatacagtttactttgcatttaatgaagggtttattcgtagcaatattaaaagtgatgaaattaaagcatttaatgaaaaaattcgacagagacgtatcaatttactgaaacaaagtaattattgtagtaatagtagaacgggaaaaggtagggcaaaacggttacagccaatagacgtgttaagtaataaaatagctaagtttcgaaatagcactaaccataaatatgcaaactatataataaaacagtgcctaaaacataactgcgggcgtattcaaatagaacttttaaaaggcatatcaaaaaatgataaggttcttaaagattggacgtattttgatttgcaggagaaaatcaagaatcaagctgaggttcatggaattgaagttattaaagttgcttccgcatatacgagtcaacgatgtagtcaatgcggatatatttgtaaagaaaatcgttgtacacaagcggtttttgaatgtaagcagtgtggatataaaacacatgctgattataatgcggccaaaaacattgctacttatgacatcgaaaatattataaataaacaattagcggtacaaagcaaattacattcaaaaaaatgtatggaagagtatatagaagagttaggatacctggattaa

SEQ ID NO: 55 - DNA, 1356 bp, Unknown
  Bacillus sp. multi
ttgggagtaacaattaagataatgaaatatcaaattttatgtccaatgaatgtcgattggacaatatttgaaaagcatttacgaaacttaacatatcaggtcagaacgataagtaatcgaactattcaacaattatgggagtttgatgctttatcttttgactactttaaagcaatagggacataccctactgtccaagatttgtatgggtgtacacagaagaaaattgacggttatatataccatacattacaaagtaaatatccagatatacataaaggaaacatgtctaccactcttcaaaaaattataaaaacatggaagagtagaagaaatgaaattagaaaaggtgaaatgtcaattccttcttttcgaaatcgcataccaattgatctccataataattctgtagacataaaaaaagagaagaatggagattatattgctgggatatctcttttttcacgagattttcataaggaaaatagcgatgtcccaaaagggaagatttttgtaaagttagctaccaaaaaacaaaaaagcatgaaaattattttagaccgattaatgaatcaaacatacagcaaaggcgcatgtatgattcataaatacaaaaataagtggtatttatcaattacttataaattcaatgctataaaagaaaataattttgataaagaattaatcatgggaattgatatgggtggaataaatacagtttactttgcgtttaatgaagggtttattcgtagcaatattaaaagtgatgaaattaaagcatttaatgaaaaaattcgacagagacgtatcaatttactgaaacaaagtaattattgtagtaatagtagaacgggaaaaggtagggcaaaacggttacagccaatagacgtgttaagtaataaaatagctaagtttcgaaatagcactaaccataaatatgcaaactatataataaaacagtgcctaaaacataactgcgggcgtattcaaatagaacttttaaaaggcatatcaaaaaatgataaggttcttaaagattggacgtattttgatttgcaggagaaaatcaagaatcaagctgaggttcatggaattgaagttattaaagttgcttccgcatatacgagtcaacgatgtagtcaatgcggatatatttgtaaagaaaatcgttgtacacaagcggtttttgaatgtaagcagtgtggatataaaacacatgctgattataatgcggccaaaaacattgctacttatgacatcgaaaatattataaataaacaattagcggtacaaagcaaattacattcaaaaaaatgtatggaagagtatatagaagagttaggatacctggattaa

SEQ ID NO: 56 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaactattcaacaattatgggagtttgatgctttatcttttgactactttaaagcaatagggacataccctactgtccaagatttgtatgggtgtacacagaagaaaattgacggttatatataccatacattacaaagtaaatatccagatatacataaaggaaacatgtctaccactcttcaaaaaattataaaaacatggaagagtagaagaaatgaaattagaaaaggtgaaatgtcaattccttcttttcgaaatcgcataccaattgatctccataataattctgtagacataaaaaaagagaagaatggagattatattgctgggatatctcttttttcacgagattttcataaggaaaatagcgatgtcccaaaagggaagatttttgtaaagttagctaccaaaaaacaaaaaagcatgaaaattattttagaccgattaatgaatcaaacatacagcaaaggcgcatgtatgattcataaatacaaaaataagtggtatttatcaattacttataaattcaatgctataaaagaaaataattttgataaagaattaatcatgggaattgatatgggtggaataaatacagtttactttgcgtttaatgaagggtttattcgtagcaatattaaaagtgatgaaattaaagcatttaatgaaaaaattcgacagagacgtatcaatttactgaaacaaagtaattattgtagtaatagtagaacgggaaaaggtagggcaaaacggttacagccaatagacgtgttaagtaataaaatagctaagtttcgaaatagcactaaccataaatatgcaaactatataataaaacagtgcctaaaacataactgcgggcgtattcaaatagaacttttaaaaggcatatcaaaaaatgataaggttcttaaagattggacgtattttgatttgcaggagaaaatcaagaatcaagctgaggttcatggaattgaagttattaaagttgcttccgcatatacgagtcaacgatgtagtcaatgcggatatatttgtaaagaaaatcgttgtacacaagcggtttttgaatgtaagcagtgtggatataaaacacatgctgattataatgcggccaaaaacattgctacttatgacatcgaaaatattataaataaacaattagcggtacaaagcaaattacattcaaaaaaatgtatggaagagtatatagaagagttaggatacctggattaa

SEQ ID NO: 57 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaactattcaacaattatgggagtttgatgctttatcttttgactactttaaagcaatagggacataccctactgtccaagatttgtatgggtgtacacagaagaaaattgacggttatatataccatacattacaaagtaaatatccagatatacataaaggaaacatgtctaccactcttcaaaaaattataaaaacatggaagagtagaagaaatgaaattagaaaaggtgaaatgtcaattccttcttttcgaaatcgcataccaattgatctccataataattctgtagacataaaaaaagagaagaatggagattatattgctgggatatctctttttttacgagattttcataaggaaaatagcgatgtcccaaaagggaagatttttgtaaagttagctaccaaaaaacaaaaaagcatgaaaattattttagaccgattaatgaatcaaacatacagcaaaggcgcatgtatgattcataaatacaaaaataagtggtatttatcaattacttataaattcaatgctataaaagaaaataattttgataaagaattaatcatgggaattgatatgggtggaataaatacagtttactttgcgtttaatgaagggtttattcgtagcaatattaaaagtgatgaaattaaagcatttaatgaaaaaattcgacagagacgtatcaatttactgaaacaaagtaattattgtagtaatagtagaacgggaaaaggtagggcaaaacggttacagccaatagacgtgttaagtaataaaatagctaagtttcgaaatagcactaaccataaatatgcaaactatataataaaacagtgcctaaaacataactgcgggcgtattcaaatagaacttttaaaaggcatatcaaaaaatgataaggttcttaaagattggacgtattttgatttgcaggagaaaatcaagaatcaagctgaggttcatggaattgaagttattaaagttgcttccgcatatacgagtcaacgatgtagtcaatgcggatatatttgtaaagaaaatcgttgtacacaagcggtttttgaatgtaagcagtgtggatataaaacacatgctgattataatgcggccaaaaacattgctacttatgacatcgaaaatattataaataaacaattagcggtacaaagcaaattacattcaaaaaaatgtatggaagagtatatagaagagttaggatacctggattaa

SEQ ID NO: 58 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaactattcaacaattatgggagtttgatgctttatcttttgactactttaaagcaatagggacataccctactgtccaagatttgtatgggtgtacacagaagaaaattgacggttatatataccatatattacaaagtaaatatccagatatacataaaggaaacatgtctaccactcttcaaaagattataaaaacatggaagagtagaagaaatgaaattagaaaaggtgaaatgtcaattccttcttttcgaaatcgcataccaattgatctccataataattctgtagacataaaaaaagagaagaatggagattatattgctgggatatctcttttttcacgagattttcataaggaaaatagcgatgtcccaaaagggaagatttttgtaaagttagctaccaaaaaacaaaaaagcatgaaaattattttagaccgattaatgaatcaaacatacagcaaaggcgcatgtatgattcataaatacaaaaataagtggtatttatcaattacttataaattcaatgctataaaagaaaataattttgataaagaattaatcatgggaattgatatgggtggaataaatacagtttactttgcgtttaatgaagggtttattcgtagcaatattaaaagtgatgaaattaaagcatttaatgaaaaaattcgacagagacgtatcaatttactgaaacaaagtaattattgtagtaatagtagaacgggaaaaggtagggcaaaacagttacagccaatagacgtgttaagtaataaaatagctaagtttcgaaatagcactaaccataaatatgcaaactatataataaaacagtgcctaaaacataactgcgggcgtattcaaatagaacttttaaaaggcatatcaaaaaatgataaggttcttaaagattggacgtattttgatttgcaggagaaaatcaagaatcaagctgaggttcatggaattgaagttattaaagttgcttccgcatatacgagtcaacgatgtagtcaatgcggatatatttgtaaagaaaatcgttgtacacaagcggtttttgaatgtaagcagtgtggatataaaacacatgctgattataatgcggccaaaaacattgctacttatgacatcgaaaatattataaataaacaattagcggtacaaagcaaattacattcaaaaaaatgtatggaagagtatatagaagagttaggatacctggattaa

SEQ ID NO: 59 - DNA, 1314 bp, Unknown
  Bacillus sp. multi
ttgggagtaacaattaagataatgaaatatcaaattttatgtccactgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagtaaaggcgcatgtatgattcataaatacaaaaataagtggtatttatcaattacttataaattcaatgctataaaagaaaataaatttgataaagaattaatcatgggaattgatttgggtggaataaatacagtttactctgcatttaatgaaggatttattcgtagcaatattaaaagcgatgaaataattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaatgtatggaagagtatatag

SEQ ID NO: 60 - DNA, 1347 bp, Unknown
  Bacillus sp. multi
atgaaatatcaaattttatgtccaatgaatgtcgattggacaatatttgaaaagcatttacgaaacttaacatatcaggtcagaacgataagtaatcgaactattcaacaattatgggagtttgatgctttatcttttgactactttaaagcaatagggacataccctactgtccaagatttgtatgggtgtacacagaagaaaattgacggttatatataccatacattacaaagtaaatatccagatatacataaaggaaacatgtctaccactcttcaaaaaattataaaaacatggaagagtagaagaaatgaaattagaaaaggtgaaatgtcaattccttcttttcgaaatcgcataccaattgatctccataataattctgtagacataaaaaaagagaagaatggagattatattgctgggatatctcttttttcacgagattttcataaggaaaatagcgatgtcccaaaagggaagatttttgtaaagttagctaccaaaaaacaaaaaagcatgaaaattattttagaccgattaatgaatcaaacatacagcaaaggtgcatgtatgattcataaatacaaaaataagtggtatttatcaattacttataaattcaatgctataaaagaaaataattttgataaagaattaatcatgggaattgatatgggtggaataaatacagtttactttgcgtttaatgaagggtttattcgtagcaatattaaaagtgatgaaattaaagcatttaatgaaaaaattcgacagagacgtatcaatttactgaaacaaagtaattattgtagtaatagtagaacgggaaaaggtagggcaaaacggttacagccaatagacgtgttaagtaataaaatagctaagtttcgaaatagcactaaccataaatatgcaaactatataataaaacagtgcctaaaacataactgcgggcgtattcaaatagaacttttaaaaggcatatcaaaaaatgataaggttcttaaagattggacgtattttgatttgcaggagaaaatcaagaatcaagctgaggttcatggaattgaagttattaaagttgcttccgcatatacgagtcaacgatgtagtcaatgcggatatatttgtaaagaaaatcgttgtacacaagcggtttttgaatgtaagcagtgtggatataaaacacatgctgattataatgcggccaaaaacattgctacttatgacatcgaaaatattataaataaacaattagcggtacaaagcaaattacattcaaaaaaatgtatggaagagtatatagaagagtatatagaagagttaggatacctggattaa

SEQ ID NO: 61 - DNA, 1191 bp, Unknown
  Bacillus sp. multi
atgctttatcctttgactactttaaagaaagagggacataccctactgtccaagatttgtatgggtgtacacagaagaaaattgatggctatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctctttttttacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaataattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaaaagttaggatacctggattaa

SEQ ID NO: 62 - DNA, 1353 bp, Unknown
  Bacillus sp. multi
ttgagtacagttgttaaagtaatgaaataccaaatagtctgtccggtaaatatagagtggaaggtttttgaaacgtatttacgtacacttacgtatcaagtaaggacaattggaaatcgaactatacaaaagctttgggagtttgataatcagtctctgaatcattttaaagagaatggtgtatatccaagtacccagcagctatatggatgcacacaaaaaactataagtggttatatctatgatcaattaaaattcgagtatctggatattaataaagctaatatgtctactacccttcagaaaacaattaagacatggaatagtagaaaaaaagaaatctggagtggtgagatgtccattccttcttttcgaaacaatttgccaatcgatattcatggaaactctatacagttaacaaaagaaaaaagtggtgattatattgcaaatttatctcttttttcatcaagttttataagagagaatgaattgtcaagtggtaaaatacttgtcaaattatcaacacgaaaacaaaatagtatgaaggtaattttagacaggttaattgatggaacatatgctaaaggtgcaagcatgcttcataaatataaaaataaatggtatctatctgttacttataaggcaaatgcaatagaagaaagtaaatttgatgaagattttattatgggcattgatatgggaaaggtaaatgtcctgtattttgcgtttaataaagggttcataagaggatcaatcagtggggaagaaattgaggcttttcgaaaaaaaattgaacacagacgtataagtttattacgtcaaggtaaatattgtagtgaaaataggataggtaaaggccgtaaaaagcgaattaaaccagttgatgtactaaatgataaagtagccaggttcagaaattctacgaatcataagtatgccaattatatagtacaacaatgtttgaaatataagtgtgggtgtatacagttagaaaatttgcaagggataagcaaagaacaaacattcttgaaaaattggacgtattttgatttacaagagaaaatcgagaatcaggcaaatcaatatgggattaaagtagtgaaaattgccccctcctatacaagtcaacgatgtagtgaatgtgggtatatccataaaaataatcggcaagatcaatctacctttgaatgtcagcaatgtaatttaaaagttcatgcagactataatgcggcaaaaaacatatctatatacaatattgaaaaactgatacaaaaacagttgaagttacaagaaaagttgaattcgaaaaagtatacggaacagtataaagagcagatagaaaatattacttag

SEQ ID NO: 63 - DNA, 1332 bp, Unknown
  Bacillus sp. multi
atgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaatgaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttaattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggataggaaaaggccgtgaaaaacgaattaaaccaattgatgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgccccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 64 - DNA, 1362 bp, Unknown
  Bacillus sp. multi
gtgacatatttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaatgaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttaattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggataggaaaaggccgtgaaaaacgaattaaaccaattgatgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgccccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 65 - DNA, 1353 bp, Bacillus
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaatgaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttaattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggataggaaaaggccgtgaaaaacgaattaaaccaattgatgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgccccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 66 - DNA, 1332 bp, Unknown
  Bacillus sp. multi
atgaaataccaaatagtctgtcctgtaaatatagaatggaaggcgtttgaaatatatttacgtacactttcatatcattttagaactatcgggaatagaactatacaaaaattgtgggaatatgataatcaatccttgaagcactttaaagatactggccaatatccaagtgcccaacaattatatgggtgtactcaaaaaaccataagtggatatatttatgatcagttaaaagaagaatatcaagatattaataaagccaatatgtccactactctacagaagacaattaagacctggaatagtagaaaaaaagaaatttggagtggtgagatgtccattccttcattccgaaacaatttaccaattgatattcatggaaactctattcagataataaaagaaaagagtggtgattatatcgcaagcgtatctcttttttcatcaaaattcataaaagaaaacgatttacccaatggtaaaatcttagtgaaattatctacaagaaaacaaaatagtatgaaggtaattttagatagaataattgatagtacatatgccaaaggcgcttgcatgctccataaacataaaaagaaatggtatttatctattacttataagtcaaatataaaagaagaacttaaatttgataaagatttaattatgggtatagatatggggaaaataaatgttctctattttgcgtttaataaaggtttggtaagaggggcaattagtggtgaagaaattgaggcttttcgaaaaaaaattgagcatagacgtataagtttattacgtcaaggtaagtattgtagtggaaataggatagggaaaggccgtgaaaaacgaattaaaccaattgatgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctgaaaaattggacgtattttgatttgcaggaaaaaatcaagaatcaggcaaatcaatatggagttaaagtggtgaaaattgacccatcctatacaagtcaacgatgtagcgaatgtgggtatatccacaaaaataatcggcaagatcaatctacctttgaatgtcagcaatgtagttttaaagttcatgcagactacaatgccgcaaaaaacatttctatgtacaatattgagaaggtaatacaaaaacaattggagttacaagaaaaattaaatctaacaaaatataaagaacagtatttagagcagatggaaaatattaattaa

SEQ ID NO: 67 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaatcagtggtgaagaaattgaggcttttcgaaaaaaaattgagcacagacgtataagtttattacgccaaggtaagtattgtagtggaaataggatagggaaaggccgtgaaaaacgaattaaaccaattgatgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 68 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcattcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgatgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaaaagtatatagaacaaatgaaaaatattaattaa

SEQ ID NO: 69 - DNA, 1332 bp, Unknown
  Bacillus sp. multi
atgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaatcagtggtgaagaaattgaggcttttcgaaaaaaaattgagcacagacgtataagtttattacgccaaggtaagtattgtagtggaaataggatagggaaaggccgtgaaaaacgaattaaaccaattgatgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccctcctatacaagtcaacgatgtagtgaatgtgggtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 70 - DNA, 1353 bp, Unknown
  Bacillus sp. multi
ttgagcttagctgtaaaagtaatgaaataccaaatagtttgtcctgtaaatgtagaatggaaagtgtttgaaacatatttacgtacactttcatatcaatctagaactattgggaatagaacaatacaaaaaatatgggaatttgacaatctatcgttgaaacactttaaagagactggtgaatatccaagtgctcaacaattatatggatgtactcagaaaaccataagtggatatatttatgatcagttaaaagaagaatataaagatattaataaagctaatatgtccactactatacagaaaacacttaagaactggaatagtagaaaaaaagaaatatggaggggcgagatgtccattccttcatttcgaagcgatctaccaatcgacatccatgggaactccatacagttaataaaagaaaaaggtggtgattatatcgcaagcgtatcccttttttcatcaaaatttattaaagagaatgatttacctaatggcaaaatcttagtgaaattatctacaagaaaacaaaatagtatgaaggtaattttagatagattaattaatagtacatactccaaaggtgcttgcatgctccataaacataaaaagaaatggtatttatctattacttataagtcaaatataaaagaagaacttaaatttgatgaagatttaattatgggcatagatatggggaaaataaatgttctctattttgcgtttaataaaagtttggtaagaggggcaattagtggtgaagaaattgaggcttttcgaaaaaaaattgagcacagacgtataagtttattgcgccaaggtaagtattgtagtggaaataggatagggaaaggccgtgaaaaacgaattaaaccaattgatgtactaaatgataaagtagctaaattcagaaatgcaacgaatcataaatacgcaaattatatagtacaacagtgtttaaaatataattgtggcactatacagttagaggatctaaaaggaataagcaaggagcaaacattcctgaagaattggacgtattttgatttgcaagaaaaaatcaaaaatcaggcaaatcaatatggagttaaagtggtgaaaattgacccatcctatacaagtcaacgatgtagtgaatgtgggtatatccacaaagataatcggcaagatcaatctacctttgaatgtctgcaatgtagttttaaagttcatgcagactacaatgccgcaaaaaacatttctgtgtacaatattgagaaggtaatacaaaaacaattggagttacaagaaaaattaaatctaacaaaatataaagaacattatatagaacaaatgaaaaatattaattaa

SEQ ID NO: 71 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcactttaaggatactggccaatatccaagtgcccaacaattatatgggtgtactcaaaaaaccataagtggatatatttatgatcagttaaaagaagaatatcaagatattaataaagccaatatgtccactactctacagaagacaattaagacctggaatagtagaaaaaaagaaatttggagtggtgagatgtccattccttcattccgaaacaatttaccaattgatattcatggaaactctattcagataataaaagaaaagagtggtgattatatcgcaagcgtatctcttttttcatcaaaatttataaaagaaaacgatttacccaatggtaaaattttagtgaaattatcgacaagaaaacaaaatagtatgaaggtaattttagatagaataattgatagtacatatgccaaaggcgcttgcatgctccataaacataaaaagaaatggtatttatctattacttataagtcaaatataaaagaagaacttaaatttgatgaagatttaattatgggcatagatatggggaaaataaatgttctctattttgcgtttaataaaggtttggtaagaggggcaattagtggtgaagaaattgaggcttttcgaaaaaaaattgagcatagacgtataagtttattacgccaaggtaagtattgtagtggaaataggatagggaaaggccgtaaaaaacgaattaaaccaattgaagtactaaatgataaaatagccaagtttagaaatgctacgaatcataagtatgccaattatatagtgcaacagtgcttaaaatataattgtggcactatacaattagaggatttacaaggaataagtaaagaacaaacattcctaaaaaattggacgtattttgatttgcaggaaaaaatcaagaatctggcaaatcaatatgggattaaagtggtgaaaattgacccatcctatacaagtcaacgatgtagtgaatgtgggtatatccataaaaataatcggcaaaatcaatctacctttgaatgtcagcaatgtagttttaaagttcatgcagactacaatgctgccaaaaacatttctgtgtacaatattgagaaggtaatacaaaaacaattgaagttacaagaaaaattaaatttaacaaaatataaagaacagtatatagagcagatggaaaatattaattaa

SEQ ID NO: 72 - DNA, 1353 bp, Bacillus thuringiensis
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatgggatgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 73 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgatgtactaaatgataaagtagctaaattcagaaatgcaacgaatcataaatacgcaaattatatagtacaacagtgtttaaaatataattgtgggactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaaaagtatatagaacaaatgaaaaatattaattaa

SEQ ID NO: 74 - DNA, 1353 bp, Unknown
  Bacillus sp. multi
ttgagcatagctgtaaaagtaatgaaataccaaatcgtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctttgtacaatattgagaaggtaatacaaaaacaattggagttacaagaaaaattaaatcaaacaaaatataaagaacagtatatagaacaaatgaaaaatattaattaa

SEQ ID NO: 75 - DNA, 1197 bp, Bacillus thuringiensis
ttgaaggactttaaggatactggccaatatccaagtgcccaacaattatatgggtgtactcaaaaaaccataagtggatatatttatgatcagttaaaagaagaatatcaagatattaataaagccaatatgtccactactctacagaagacaattaagacctggaatagtagaaaaaaagaaatttggagtggtgagatgtccattccttcattccgaaacaatttaccaattgatattcatggaaactctattcagataataaaagaaaagagtggtgattatatcgcaagcgtatctcttttttcatcaaaatttataaaagaaaacgatttacccaatggtaaaattttagtgaaattatcgacaagaaaacaaaatagtatgaaggtaattttagatagaataattgataatacatatgccaaaggcgcttgcatgctccataaacataaaaagaaatggtatttatctattacttataagtcaaatataaaagaagaacttaaatttgatgaagatttaattatgggcatagatatggggaaaataaatgttctctattttgcgtttaataaaggtttggtaagagggggaattagtggtgaagaaattgaggcttttcgaaaaaaaattgagcatagacgtataagtttattacgccaaggtaagtattgtagtggaaataggatagggaaaggccgtaaaaaacgaattaaaccaattgaagtactaaatgataaaatagccaagtttagaaatgctacgaatcataagtatgccaattatatagtgcaacagtgcttaaaatataattgtggcactatacaattagaggatttacaaggaataagtaaagaacaaacattcctaaaaaattggacgtattttgatttgcaggaaaaaatcaagaatcaggcaaatcaatatgggattaaagtggtgaaaattgacccatcctatacaagtcaacgatgtagtgaatgtgggtatatccataaaaataatcggcaaaatcaatctacctttgaatgtcagcaatgtagttttaaagttcatgcagactacaatgctgccaaaaacatttctgtgtacaatattgagaaggtaatacaaaaacaattgaagttacaagaaaaattaaatttaacaaaatataaagaacagtatatagagcagatggaaaatattaattaa

SEQ ID NO: 76 - DNA, 1353 bp, Unknown
  Bacillus sp. multi
ttgagcatagctgtaaaagtaatgaaataccaaatagtctgtcctgtaaatatagaatggaagacatttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacaaaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttaattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgatgtactaaatgataaagtagctaaattcagaaatgctacgaatcataagtatgccaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatctatatggggtgaaagtgatgaaaatcgacccatcctatacaagtcaacgatgtagtgaatgtgggtatattcacaaaaataatcggcaaaatcaatctacctttgaatgtcagcaatgtagttttaaagttcatgcagactacaatgccgcaaaaaacatttctttgtacaacattgagaaggtaatacaaaaacaattggagttacaagaaaaattaaatctaacaaaatataaagaacagtatatggaacaaatgaaaaatattaattaa

SEQ ID NO: 77 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagaagtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctttgtacaatattgagaaggtaatacaaaaacaattggagttacaagaaaaattaaatcaaacaaaatataaagaacagtatatagaacaaatgaaaaatattaattaa

SEQ ID NO: 78 - DNA, 1353 bp, Unknown
  Bacillus sp. multi
ttgagtacagttgtaaaagtaatgaaataccaaatagtttgtcctgtaaatatagagtggaaggcgtttgaaacgtatttacgtacactatcgtatcaagttaggacaattggaaatcgcactatacaaaaactttgggattttgacaatcagtcgttgaatcattttagagaaaatggtgtatatccgagtgcccaacaattatatggatgtacccaaaaaacgataagcggatatatctatgatcagttaaaagaggaatatcaggatattaataaagccaatatgtccacaactctacaaaagacgattaagacttggaatagtagaaaaaaagaaattcgaagtggtgaaatgtccattccttcttttcgaaacaatttaccaatcgatatccatgggaactctatacagataacaaaagaaaaaagtggggattatatcgcaagcttatctctattttcatcaaacttcataaaagaaaataatttgcctaacggtaaaatacaggtgaaattatcaacaagaaaacaaaatagtatgaaggtcattttagatagaataattgaaaatacatatgctaaaggtgcttgcatgcttcataagcacaaaaataaatggtatttgtctattatttataagccgactgtaaaggaagaacataactttgaagaagatttagtcatgggtattgatatggggaaaataaacgtactttatttttcttttaataaaggatggataagaggggcaattagtggagaggaaattgaggcttttcggaaaaaaattgaacatagacgtataagtttattgcgtcaaggtaaatattgtagtggaaacagggtggggaaagggcgagaaaagcgaattaaacccattgatgtattgaataataaagtagctaagtttagaaatgcaacgaatcataaatacgcaaattatatagtacaacagtgtctgaaatataattgtggcactatacagttagagaatttacaaggaataagcaaggaacaaacattcttgaaaaattggacgtattttgatttgcaggagaaaatcaagcagcaagctcatcaatacggtattaaagtagttacaattgatccctcatatacaagtcaacgttgtagtgaatgtgggtatatccataaaaataatcggcaaagtcaatcaacttttgagtgtcagcaatgtaatctaaaagtacatgcagactataatgcggcaaaaaatatatctatatacaatattgaaaaagtgatacaaaaacagttgaagttacaggagaagttgaattctaagaagtttacagaacagtatatagaacagatagaaaatattaattag

SEQ ID NO: 79 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaacagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgagggacaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgagtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 80 - DNA, 1353 bp, Unknown
  Bacillus sp. multi
ttgagcttagctgtaaaagtaatgaaataccaaatagtttgtcctgtaaatgtagaatggaaagtgtttgaaacatatttacgtacactttcatatcaatctagaactattgggaatagaacaatacaaaaaatatgggaatttgacaatctatcgttgaaacactttaaagagactggtgaatattcaagtgctcaacaattatatggatgtactcagaaaactataagtggatatatttatgatcagctaaaagaagaatataaagatattaataaagctaatatgtccactactatacagaaaacacttaagaactggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgatgtactaaatgataaagtagctaaattcagaaatgcaacgaatcataaatacgcaaattatatagtacaacagtgtttaaaatataattgtggcactatacagttagaggatctaaaaggaataagtaaggaacaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctgtgtacaatattgagaaggtaatacaaaagcaattggagttacaagaaaaattaaatcaaacaaaatataaagaacagtatatagaacaaatgaaaaatattaattaa

SEQ ID NO: 81 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaatagtagaaaaaaagaaatttggagcggtgagatgtccattccttcattccgaaacaatttaccaattgatattcatggaaactctattcagataataaaagaaaagagtggtgattatattgcaagcgtatctcttttttcatcaaaatttataaaagaaaacgatttacccgatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgagtatatccacaaaaataatcggcaagatcaatctacctttgaatgtcagcaatgtagttttaaagttcatgcagactacaatgccgcaaaaaatatttctgtgtacaatattgagaaggtaatacaaaaacaattggagttacaagaaaaattaaatcaaacaaaatataaagaacagtatatagaacaaatgaaaaatattaattaa

SEQ ID NO: 82 - DNA, 1332 bp, Unknown
  Bacillus sp. multi
atgaaataccaaatagtttgtcctgtaaatgtagaatggaaagtgtttgaaacatatttacgtacactttcatatcaatctagaactattgggaatagaacaatacaaaaaatatgggaatttgacaatctatcgttgaaacactttaaagagactggtgaatatccaagtgctcaacaattatatggatgtactcagaaaaccataagtggatatatttatgatcagttaaaagaagaatataaagatattaataaagctaatatgtccactactatacagaaaacacttaagaactggaatagtagaaaaaaagaaatatggaggggtgagatgtccattccttcatttcgaagcgatctaccaattgacatccatgggaactccatacagttaataaaagaaaaaggtggtgattatatcgcaagcgtatcccttttttcatcaaaatttattaaagagaatgatttacctaatggcaaaatcttagtgaaattatctacaagaaaacaaaatagtatgaaggtaattttagatagattaattaatagtacatactccaaaggcgcttgcatgttccataaacataaaaagaaatggtatttatctattacttataagtcaaatataaaagaagaacttaaatttgatgaagatttaattatgggcatagatatggggaaaataaatgttctctattttacgtttaataaaggtttggtaagagggacaattagtggtgaagaaattgaggcttttcgaaaaaaaattgagcacagacgtataagtttattgcgccaaggtaagtattgtagtggaaataggatagggaaaggccgtgaaaaacgaattaaaccaattgatgtactaaatgataaagtagctaaattcagaaatgcaacgaatcataaatatgcaaattatatagtacaacagtgtttaaaatataattgtggcactatacagttagaggatctaaaaggaataagcaaggagcaaacattcctgaagaattggacgtattttgatttgcaagaaaaaatcaaaaatcaggcaaatcaatatggagttaaagtggtgaaaattgacccatcctatacaagtcaacgatgtagtgaatgtgggtatatccacaaagataatcggcaagatcaatctacctttgaatgtctgcaatgtagttttaaagttcatgcagactacaatgccgcaaaaaacatttctgtgcacaatattgagaaggtaatacaaaaacaattggagttacaagaaaaattaaatctaacaaaatataaagaacattatatagaacaaatgaaaaatattaattaa

SEQ ID NO: 83 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaacatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaaggaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgatgtactaaatgataaagtagctaaattcagaaatgcaacgaatcataaatacgcaaattatatagtacaacagtgtttaaaatataattgtggcactatacatttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 84 - DNA, 1332 bp, Unknown
  Bacillus sp. multi
atgaaataccaaatagtctgtcctgtaaatatagaatggaagacgtttgaaatatatttacgtacactttcatatcattttagaactattgggaatagaactatacaaaaattgtgggaatatgataatcaatcattgaagcactttaaagatactggccaatatccaagtgcccaacaattatatgggtgtactcaaaaaaccataagtggatatatttatgatcagttaaaagaagaatatcaagatattaataaagccaatatgtccactactctacagaagacaattaagacctggaatagtagaaaaaaagaaatttggagtggtgagatgtccattccttcattccgaaacaatttaccaattgatattcatggaaactctattcagataataaaagaaaagagtggtgattatatcgcaagcgtatctcttttttcatcaaaatttataaaagaaaacgatttacccaatggtaaaatcttagtgaaattatcgacaagaaaacaaaatagtatgaaggtaattttagatagaataattgatagtacatatgccaaaggcgcttgcatgctccataaacataaaaagaaatggtatttatctattacttataagtcaaatataaaagaagaacttaaatttgatgaagatttaattatgggcatagatatggggaaaataaatgttctctattttgcgtttaataaaggtttggtaagaggggcaattagtggtgaagaaattgaggcttttcgaaaaaaaattgagcatagacgtataagtttattacgccaaggtaagtattgtagtggaaataggataggaaaaggccgtaaaaaacgaattaaaccaattgaagtactaaatgataaaatagccaagtttagaactgctacgaatcataagtatgccaattatatagtgcaacagtgcttaaaatataattgtggcactatacaattagaggatttacaaggaataagtaaagaacaaacattcctaaaaaattggacgtattttgatttgcaggaaaaaatcaagaatcaggcaaatcaatatgggattaaagtggtgaaaattgacccatcctatacaagtcaacgatgtagtgaatgtgggtatatccataaaaataatcggcaaaatcaatctacctttgaatgtcagcaatgtagttttaaagttcatgcagactacaatgctgccaaaaacatttctgtgtacaatattgagaaggtaatacaaagacaattgaagttacaagaaaaattaaatttaacaaaatataaagaacagtatatagagcagatggaaaatattaattaa

SEQ ID NO: 85 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcactttaaagatactggccaatatccaagtgcccaacaattatatgggtgtactcaaaaaaccataagtggatatatttatgatcagttaaaagaagaatatcaagatattaataaagccaatatgtccactactctacagaagacaattaagacctggaatagtagaaaaaaagaaatttggagtggtgagatgtccattccttcattccgaaacaatttaccaattgatattcatggaaactctattcagataataaaagaaaagagtggtgattatatcgcaagcgtatctcttttttcatcaaaatttataaaagaaaacgatttacccaatggtaaaatcttagtgaaattatcgacaagaaaacaaaatagtatgaaggtaattttagatagaataattgatagtacatatgccaaaggcgcttgcatgctccataaacataaaaagaaatggtatttatctattacttataagtcaaatataaaagaagaacttaaatttgatgaagatttaattatgggcatagatatggggaaaataaatgttctctattttgcgtttaataaaggtttggtaagaggggcaattagtggtgaagaaattgaggcttttcgaaaaaaaattgagcatagacgtataagtttattacgccaaggtaagtattgtagtggaaataggataggaaaaggccgtaaaaaacgaattaaaccaattgaagtactaaatgataaaatagccaagtttagaactgctacgaatcataagtatgccaattatatagtgcaacagtgcttaaaatataattgtggcactatacaattagaggatttacaaggaataagtaaagaacaaacattcctaaaaaattggacgtattttgatttgcaggaaaaaatcaagaatcaggcaaatcaatatgggattaaagtggtgaaaattgacccatcctatacaagtcaacgatgtagtgaatgtgggtatatccataaaaataatcggcaaaatcaatctacctttgaatgtcagcaatgtagttttaaagttcatgcagactacaatgctgccaaaaacatttctgtgtacaatattgagaaggtaatacaaaaacaattgaagttacaagaaaaattaaatttaacaaaatataaagcacagtatatagagcagatggaaaatattaattaa

SEQ ID NO: 86 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcactttaaagatactggccaatatccaagtgcccaacaattatatgggtgtactcaaaaaaccataagtggatatatttatgatcagttaaaagaagaatatcaagatattaataaagccaatatgtccactactctacagaagacaattaagacctggaatagtagaaaaaaagaaatttggagtggtgagatgtccattccttcattccgaaacaatttaccaattgatattcatggaaactctattcagataataaaagaaaagagtggtgattatatcgcaagcgtatctcttttttcatcaaaatttataaaagaaaacgatttacccaatggtaaaatcttagtgaaattatcgacaagaaaacaaaatagtatgaaggtaattttagatagaataattgatagtacatatgccaaaggcgcttgcatgctccataaacataaaaagaaatggtatttatctattacttataagtcaaatataaaagaagaacttaaatttgatgaagatttaattatgggcatagatatggggaaaataaatgttctctattttgcgtttaataaaggtttggtaagaggggcaattagtggtgaagaaattgaggcttttcgaaaaaaaattgagcatagacgtataagtttattacgccaaggtaagtattgtagtggaaataggataggaaaaggccgtaaaaaacgaattaaaccaattgaagtactaaatgataaaatagccaagtttagaactgctacgaatcataagtatgccaattatatagtgcaacagtgcttaaaatataattgtggcactatacaattagaggatttacaaggaataagtaaagaacaaacattcctaaaaaattggacgtattttgatttgcaggaaaaaatcaagaatcaggcaaatcaatatgggattaaagtggtgaaaattgacccatcctatacaagtcaacgatgtagtgaatgtgggtatatccataaaaataatcggcaaaatcaatctacctttgaatgtcagcaatgtagttttaaagttcatgcagactacaatgctgccaaaaacatttctgtgtacaatattgagaaggtaatacaaagacaattgaagttacaagaaaaattaaatttaacaaaatataaagaacagtatatagagcagatggaaaatattaattaa

SEQ ID NO: 87 - DNA, 1353 bp, Bacillus weihenstephanensis
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaatagtagaaaaaaagaaatttggagcggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgagtatatccacaaaaataatcggcaagatcaatctacctttgaatgtcagcaatgtagttttaaagttcatgcagactacaatgccgcaaaaaatatttctgtgtacaatattgagaaggtaatacaaaaacaattggagttacaagaaaaattaaatcaaacaaaatataaagaacagtatatagaacaaatgaaaaatattaattaa

SEQ ID NO: 88 - DNA, 1353 bp, Bacillus
ttgagcaaagttgtaaaagtaatgaaataccaaatagtctgtcctctaaatatagaatggaaggtgtttgaaatatatttacgtacactttcatatcattttagaactattgggaatagaacgatacaaaaattgtgggaatatgataatcaatcattgaagcacttcaaagatactggccaatatcctagtgtccaacaattatatgggtgtactcaaaagaccgtaagtggatatatttatgatcagttaaaagaagaatatcaagatattaataaagccaatatgtccactactctacagaagacaattaagacctggaatagtagaaaaaaagaaatttggagtggtgagatgtccattccttcattccgaaacaatttaccaattgatgttcatggaaactctgtacaggtaacaaaagaaaaaagtggtgattatatagcaagcgtatctcttttttcatcaaaatttataaaagaaaacgatttacccaatggtaaaatcttagtgaaattatcgacaagaaaacaaaatagtatgaaggtaattttagataaaataattgatagtacatatgccaaaggcgcttgtatgctccataaacataaaaataaatggtatttatctattacttataaggcaactaaaaaagaagggcataaatttgatgaagatttaattatgggcattgatatggggaaaataaatgcactctattttgcgtataataaaggtttggtaagaggggtaattagtggagaagaaattgaggcttttcgaaaaaaagttgaatacagacgtataagtttattacgtcaaggaaaatattgtagtgaaaataggataggtaaaggccgtaaaaaacgaattaaaccaattgaagtactaaatgataaaatagccaagtttagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggagtgaaagtggtgaaaattgatccatcctatacaagtcaacgatgtagtgaatgtggatatatccataaaaataatcggcaagatcaatctacctttgaatgtcagcaatgtagttttaaagctcatgcagactacaatgctgcaaaaaatatttctatatacaatattgagaaggtaatacaaaaacaattggagttacaagaaaaattaaatctaacaaaatataaagaacagtatatagagcagatggagaatattaattaa

SEQ ID NO: 89 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcactttaaagatactggccaatatccaagtgcccaacaattatatgggtgtactcaaaaaaccataagtggatatatttatgatcagttaaaagaagaatatcaagatattaataaagcaaatatgtccactactctacagaagacaattaagacctggaatagtagaaaaaaagaaatttggagtggtgagatgtccattccttcattccgaaacaatttaccaattgatattcatggaaactctattcagataataaaagaaaagagtggtgattatatcgcaagcgtatctcttttttcatcaaaatttataaaagaaaacgatttacccaatggtaaaatcttagtgaaattatcgacaagaaaacaaaatagtatgaaggtaattttagatagaataattgatagtacatatgccaaaggcgcttgcatgctccataaacataaaaagaaatggtatttatctattacttataagtcaaatataaaagaagaacttaaatttgatgaagatttaattatgggcatagatatggggaaaataaatgttctctattttgcgtttaataaaggtttggtaagaggggcaattagtggtgaagaaattgaggcttttcgaaaaaaaattgagcatagacgtataagtttattacgccaaggtaagtattgtagtggaaataggataggacaaggccgtaaaaaacgaattaaaccaattgaagtactaaatgataaaatagccaagtttagaactgctacgaatcataagtatgccaattatatagtgcaacagtgcttaaaatataattgtggcactatacaattagaggatttacaaggaataagtaaagaacaaacattcctaaaaaattggacgtattttgatttgcaggaaaaaatcaagaatcaggcaaatcaatatgggattaaagtggtgaaaattgacccatcctatacaagtcaacgatgtagtgaatgtgggtatatccataaaaataatcggcaaaatcaatctacctttgaatgtcagcaatgtagttttaaagttcatgcagactacaatgctgccaaaaacatttctgtgtacaatattgagaaggtaatacaaagacaattgaagttacaagaaaaattaaatttaacaaaatataaagaacagtatatagagcagatggaaaatattaattaa

SEQ ID NO: 90 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtaattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggtgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgagtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 91 - DNA, 1332 bp, Unknown
  Bacillus sp. multi
atgaaataccaaatagtctgtcctgtaaatatagaatggaagacgtttgaaatatatttacgtacactttcatatcattttagaactattgggaatagaactatacaaaaattgtgggaatatgataatcaatcattgaagcactttaaagatactggccaatatccaagtgcccaacaattatatgggtgtactcaaaaaaccataagtggatatatttatgatcagttaaaagaagaatatcaagatattaataaagccaatatgtccactactctacagaagacaattaagacctggaatagtagaaaaaaagaaatttggagtggtgagatgtccattccttcattccgaaacaatttaccaattgatattcatggaaactctattcagataataaaagaaaagagtggtgattatatcgcaagcgtatctcttttttcatcaaaatttataaaagaaaacgatttacccaatggtaaaatcttagtgaaattatcgacaagaaaacaaaatagtatgaaggtaattttagatagaataattgatagtacatatgccaaaggcgcttgcatgctccataaacataaaaagaaatggtatttatctattacttataagtcaaatataaaagaagaacttaaatttgatgaagatttaattatgggcatagatatggggaaaataaatgttctctattttgcgtttaataaaggtttggtaagaggggcaattagtggtgaagaaattgaggcttttcgaaaaaaaattgagcatagacgtataagtttattacgccaaggtaagtattgtagtggaaataggatagggaaaggccgtaaaaaacgaattaaaccaattgaagtactaaatgataaaatagccaagtttagaactgctacgaatcataagtatgccaattatatagtgcaacagtgcttaaaatttaattgtggcactatacaattagaggatttacaaggaataagtaaagaacaaacattcctaaaaaattggacgtattttgatttgcaggaaaaaatcaagaatcaggcaaatcaatatggaattaaagtggtgaaaattgacccatcctatacaagccaacgatgtagtgaatgtgggtgtatccataaaaataatcggcaaaatcaatctacctttgaatgtcagcaatgtagttttaaagttcatgcagactacaatgctgccaaaaacatttctgtgtacaatattgagaaggtaatacaaaaacaattgaagttacaagaaaaattaaatttaacaaaatataaagaacagtatatagagcagatggaaaatattaattaa

SEQ ID NO: 92 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaacagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgagggacaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtaaacgatgtagtgaatgtgagtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 93 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaacagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttagccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgagtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 94 - DNA, 1359 bp, Unknown
  Bacillus sp. multi
atgtatttgagcaaagttgtaaaagtaatgaaataccaaatagtctgtcctgtaaatatagaatggaaggcgtttgaaatatatttacgtacactttcatatcattttagaactattgggaatagaacgatacaaaaattgtgggaatatgataatcattccttgaagcactttaaagatactggccaatatccaagtgcccaacaattatatgggtgtactcaaaaaactataagcggatatatttacgatcagttaaaagaagaatatcaagatattaataaagccaatatgtccactactctacaaaagacaattaagacctggaatagtagaaaaaaagaaatttggagtggtgagatgtccattccttcattccgaaacaatttaccaattgatattcatggaaactctatacagataataaaagaaaaaagtggtgattatatagcaaacgtatctcttttttcatcaaaatttataaaagaaaacgatttacccaacggtaaaatcttagtgaaattatctacaagaaaacaaaatagtatgaaggtaattttagatagaataattgatagtacatatgccaaaggcgcttgcatgctccataaacataaaaataaatggtatttatctattacctataaggcaactataaaagaagagcataaatttgatgaagaattaattatgggcattgatatggggaaaataaatgttctctattttgcgtataataaaggttcggtaagaggagcaattagcggagaagaaattgaggcttttcgaaaaaaaactgaatacagacgtataagcttattacggcaaggtaagcattgtagtgaaaataggataggtaaaggccgtaaaaaacgaattaaaccaattgatgtactaaatgataaagtagccaagtttagaaatgctacgaatcataagtatgccaattatatagtgcaacagtgtttaaaatataattgtggcactatacaattagaggatttacaaggaataagtaaagaacaaacattcctaaaaaattggacgtattttgatttgcaggaaaaaatcaagaatcaggcaaatcaatatggggttaaagtggtgaaaattgacccatgctatacaagtcaacgatgtagtgaatgtgggtatatccataaaaataatcggcaagatcaatctacctttgaatgtcagcaatgtagttttaaagttcatgcagactacaatgctgcaaaaaatatttctgtttacaatattgagaaggtaataaaaaaacaattggagttacaagaaaaattaaatctaacaaaatataaagaacagtatatagagcagatggagaatattaattaa

SEQ ID NO: 95 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataatgtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcattgtagttttaaagttcatgcagactacaatgccgcaaaaaacatttctttgtacaatattgagaaggtaatacaaaaacaattggagttacaagaaaaattaaatcaaacaaaatataaagaacagtatatagaacaaatgaaaaatattaattaa

SEQ ID NO: 96 - DNA, 1359 bp, Unknown
  Bacillus sp. multi
atgtatttgagcaaagttgtaaaagtaatgaaataccaaatagtctgtcctgtaaatatagaatggaaggcgtttgaaatatatttacgtacactttcatatcattttagaactattgggaataaaactatacaaaaattgtgggaatatgataatcattccttgaagcactttaaagatactggccaatatccaagtgcccaacaattatatgggtgtactcaaaaaactataagcggatatatctatgatcagttaaaagaagaatatcaagatattaataaagccaatatgtccactactctacaaaagacaattaagacctggaatagtagaaaaaaagaaatttggagtggtgagatgtccattccttcattccgaaacaatttaccaattgatattcatggaaactctatacagataataaaagaaaaaagtggtgattatatagcaaacgtatctcttttttcatcaaaatttataaaagaaaacgatttacccaacggtaaaatcttagtgaaattatctacaagaaaacaaaatagtatgaaggtaattttagatagaataattgatagtacatatgccaaaggcgcttgcatgctccataaacataaaaataaatggtatttatctattacctataaggcaactataaaagaagagcataaatttgatgaagaattaattatgggcattgatatggggaaaataaatgttctctattttgcgtataataaaggtttggtaagaggagcaattagcggagaagaaattgaggcttttcgaaaaaaaactgaatacagacgtataagtttattacgtcaaggtaaatattgtagtgaaaataggataggtaaaggccgtaaaaaacgaattaaaccaattgatgtactaaatgataaagtagctaagtttagaaatgctacgaatcataagtatgccaattatatagtgcaacagtgtttaaaatataattgtggcactatacaattagaggatttacaaggaataagtaaagaacaaacattcctaaaaaattggacgcattttgatttgcaggaaaaaatcaagaatcaggcaaatcaatatggggttaaagtcgtgaaaattgacccatcctatacaagtcaacgatgtagtgaatgtgggtatatccataaaaataatcggcaagatcaatctacctttgaatgtcagcaatgtagttttaaagttcatgcagactacaatgctgcaaaaaatatttctgtgtacaatattgagaaggtaatacaaaaacaattggagttacaagaaaaattaaatctaacaaaatataaagaacagtatatagagcagatggagaatattaattaa

SEQ ID NO: 97 - DNA, 1353 bp, Unknown
  Bacillus sp. multi
ttgagtacagttgtaaaagtcatgaaataccaaatagtatgtccattaaatttagattggaaaatgtttgaaaagtatttacgtacactatcctatcaagttaggacaattggaaatcgaactatacaaaaactttgggattttgacaatcagtcgttgaatcattttagagaaaatggtgtatatccgagtgccaaacaattatatggatgtacccaaaaaacgataagcgggtatatctatgatcagttaaaagaggaatatcaggatattaataaagcaaatatgtccacaactctacaaaaaacgattaagacttggaatagtagaaaaaaagaaattcgaagtggtgatatgtccattccttcttttcgaaacaatttaccaatcgatatccatgggaactctatacagataacaaaagaaaaaagtggggattatatcgcaagcttatctctattttcatccaacttcataaaagaaaataatttgcctaatggtaaaatacaggtgaaattatcaacgagaaaacaaaatagtatgaaggtcattttagatagaataattgaaaatacatatgctaaaggtgcttgcatacttcataaacataaaaataaatggtatttgtctattatttataagccgattgtaaaggaagaacataaatttgaagaagatttagtaatgggtattgatatggggaaaataaacgtactttattttgcttttaataaaggatggataagaggggcaattagtggagaggaaattgaggcttttcggaaaaaaattgaacatagacgtataagtttattgcgtcaaggtaaatattgtagtggaaacagggtggggaaagggcgagaaaaacgaattaaacctattaatgtattgaataataaagtagctaagtttagaaatgcaacgaatcataaatacgcaaattatatagtacaacagtgtctgaaatataattgtggcactatacagttagagaatttacaaggaataagcaaggaacaaacattcctgaaaaattggacgtattttgatttgcaggagaaaatcaagcagcaagctcatcaatacggtattaaagtagttacaattgatccctcatatacaagtcaacgttgtagtgaatgtggatatatccataaaaataatcggcaaagtcaatctacttttgagtgtcagcgatgtaatctaaaagtacatgcagactataatgcggcaaaaaatatatctatatacaatatcgaaaaagtgatacaaaaacagttgaagttacaggagaagttgaattctaagaagtttacagaacagtatatagaacagatagaaaatattaattag

SEQ ID NO: 98 - DNA, 990 bp, Unknown
  Bacillus sp. multi
atgtctgtgttgataaagacttatttgcatggttaccactctattttgtacaataaaagaaaaacatcgtatgaggtggggagaggaaaacccatgtctaaccaacagttagtgaatttacgcattgattttgcttttaaacaattatttggtacaagtggaaatgaagatattttgattgcttttttaaacgcgatattgcaggattctttagaatcacccattgtttcgttacaactagaagatccacacttgcaccgggaacatgaagaagataaattatcgattttagatatttctgcaacattagatacgggaacaaaggtaaatgtagaaatccagttaaataataatcatgacatgattaagagaagtttatattactggggaaggctatacacatcccaacttcaaaaaggaatgccctatagttctcttcataaaacaattacgattaatttattaaactttgtcatgtttccagaatatgaagcgttccatacaacaggaatcctatggaatcaacagcaacaaaagaagttaagtgatgatattgaagttcatatggtggaaattccaaaactcatgcaacagtggcggaatgaacaagtaaatccctgggaagattcgtttgttcgttggttattattacttccagcgaatgaagatgaacaattaacccaaacattggaggatattgcgatgaaccaagaccctattttacaaaaagcgataaataaatgggaacgtatgagtcaagattcttctttccgacaagcatatgaagcaagggaaaaagctcttatggatgaggctgcaaagtttgcttatgcagaacaaaaaggtattgaaaagggcattgaaaaaggtattgaacaagggaagatacagcttattcgtggtatgcacaaaaacggaatgccaataaaagatattgcgaaatttacgaatttatctatagaagaaatacaagaaattcttgaattataa

SEQ ID NO: 99 - DNA, 996 bp, Unknown
  Bacillus sp. multi
atgtatggtagcaaacaagctcttatgtctacggatataagagcttgtttgcatatggatcactcttttatgtacaatgaaagaaaaacatcatatgagatggggagaggaaaacccatgtccaaccaacaattagtaaatttacgcattgattttgcttttaaacaattatttggcacaagtggaaatgaagatattctaattgcttttttaaatgctatgttacaagactcattagagtcaccgattgcttcattacagttagaagacccgcacttgcaccgagaacatgaagaggataaattatcgattttagatatttccgctacattagatacaggcacaaaggtaaatgtcgaaatacagctgaataataatcatgacatgattaagagaagtttatattactggggaaggctatatacatcccaacttcaaaaaggaatgccatatagttctcttcataaaacaattacgattaatttgttaaattttgttatatttcctgaatacgaggcattccatacaacaggaatcctatggaatcaacaacaacaaacgatattgagtagtgatatcgaagttcacattgtggagattccaaaactcatgcaacagtggcggaatgaacaagtaaatccctgggaagattcatttgttcgttggttgttattacttccagcgaatgaggatgaacaattaacccaaacattggaggatattgcgatgaaccaagacccaattttacaaaaagcgatgaataaatgggaacgtatgagtcaagattcttctttccgacaagcatatgaagcaagggaaaaagcgttgatggatgaagcggcaaagtttgcccatgctcgcaatgaaggaattcaagaaggaaaaatacaaatgattaaaggtatgcatgaacttggcgtaccaattgaaacgattgcaaaagcaagtaaattaagtatagaagaagttcaacatattttaagtagaaattcataa

SEQ ID NO: 100 - DNA, 996 bp, Bacillus thuringiensis
atgtatggtagcaaacaagctcttatgtctacggatataagagcttgtttgcatatggatcactcttttatgtacaatgaaagaaaaacatcatatgagatggggagaggaaaacccatgtccaaccaacaattagtaaatttacgcattgattttgcttttaaacaattatttggcacaagtggaaatgaagatattctaattgcttttttaaatgctatgttacaagactcattagagtcaccgattgcttcattacagttagaagacccgcacttgcaccgagaacatgaagaggataaattatcgattttagatatttccgctacattagatacaggcacaaaggtaaatgttgaaatacagctgaataataatcatgacatgattaagagaagtttatattactggggaaggctatatacatcccaacttcaaaaaggaatgccatatagttctcttcataaaacaattacgattaatttgttaaatttcgttatttttcctgaatacgaggcattccatacaacaggaatcctatggaatcaacaacaacaaacgatattgagtagtgatatcgaagttcacattgtggagattccaaaactcatgcaacagtggcgaaatgaacaagtaaatccctgggaagattcatttgttcgttggttgttattacttccagcgaatgaggatgaacaattaacccaaacattggaggatattgcgatgaaccaagacccaattttacaaaaagcgatgaataaatgggaacgtatgagtcaagattcttctttccgacaagcatatgaagcaagggaaaaagcgttgatggatgaagccgcaaagtttgcccatgctcgtaatgaaggaattcaagaagggaaaatacaaatgattaaaggtatgtatgaacttggcgtaccaattgaaacaattgcaaaagcaagtaaattaagtatagaagaagttgagcttattttgaaaggaaattcataa

SEQ ID NO: 101 - DNA, 1521 bp, Bacillus megaterium
atgtccactccattacaacagccacatcaaaaatcaaaaaaaacgtctcaaatgatcacgacacgcaaatttaaattagcaattgtatctgataatcgtaatgaggcttacagttttatacggaatgaaatacggaatcaaaataaagcacttaatgcagcttacaatcacttgtacttcgaacatatagcaacggagaaattaaaacatagtgacgaagaatatcagaaacatttgaccaagtaccgagaagtatctactaataaataccaagattacttaaaggtaaaagaaaaggttaatgctagcaaagatgatgaaaagttacaaaagagggtagataaggcaagggaggcttataacaaagcgcaagaaaaggtgtacaagatagagaaagaatttaataagaaatccatggaaacgtatcagaaagtagtcggcttatctaaacaaacaaggataggtaaactacttaagagccagtttactttacattatgatactgaggatagaataacatcaaccgtgctatctcacttcaataacgatatgaaaactggggttcttcgtggggatcgtagcttacgtacttacaaaaacagtcacccactattagtacgtgctagaagtatgaaagtttatgaggaaaatggtgactacttcattaaatgggttaaaggcattgtctttaaaatcgttatttcagctggaagtaagcaaaaggctaacataggtgaattgaaatcagtgcttatcaatatcctaaatggtcactataaggtatgtgatagtagcatcagtcttaataaagatttaatattaaatctttctctgaatattcctgtatctaaagaaaatgtgttcgttccaggccgcgttgtcggtgttgatctcgggttaaagatcccggcttatgtatcgcttaatgatactccttatatcaaaaaggggattggcaacatagacgactttttaaatgttcgtacacaattgcaaaaccaaagaaaaagattgcaaaagacactagaatgtacttctggtggtaaaggtaggagcaaaaaattaaagggcctagatagattgaaagcaaaggaaaagaactttgtgaacacatataatcattttttaagtaaaaaaatcatacagtttgctgtcaaaaataatgctggtgtcattcacttggaggaattacagtttgacaaactgaaaaataaatcattattgagaaactggtcctactatcaattacaaaccatgattgaatataaggccgaacgtgaaggtattgaagtgaaatacgtagatgctagttacacttcacagacttgcagcaaatgcggtcactatgaaaagggacaaagagtattgcaggatacgtttacttgcaaaaataaagagtgcaagggttatgctcataaagttaatgctgattttaacgcctcccaaaacattgcaaaaagcactgatattattagatgtactgaaatggcaaaaaacaatgatattgagaaaaatgcctag

SEQ ID NO: 102 - DNA, 1491 bp, Unknown
  Bacillus sp. multi
gtgattttaactaggaaagttaaactagttattgtatcggataatcgagacgaagggtataaactaattcgtaatgagataagagaacaacataaagcacttaacctagcctataaccatttatattttgaacataatgctattcaaatattgaagcagaatgatgaggactacaaacagaaaagaaataagttacaagaattaattaacaagaaatatgaggaacatcaaaaggcaaaaaacttagagaggaaagaagcattacgagaagcgtacaataacaagaaacaggaactatataaatttgaaagggaatgtaatgaagaagcacgtaaagcttatcaacaagtagttgggtttacacaacaaacgagagtacgaaatttaattaaccgtgagtataatttaatgagtgatactaaggatgggattacaagtaaagtaactcaagactataaaaatgattgtaaagcgggtttgttaattgggaagcgttcgctacggaattataagaaagataatcctttacttgttagaggtagaagcttgaagttttacaaggaggatggggattattttattaagtggaacaagggaacggtctttaaatgtattttgcatattaggaaaaagaatgtagcggaattacaaagcgttctggaaaatgttcttttaggtgcttataagatttgtgatagtagtattggtttcaacaacaaggatatgatattgaatctatcattaaatattccggataaagaaacatacgattatatcccaggtcgagttgttggagttgatttaggattgaaaattccagcttatgtatcattaagtgataaggtgtacgttagaaaagggataggaggtatagatgatttcttgcgtgtgagaacacaaatgcaaaaacgtagacgtcaattacaggaatctttagcagctgtaaaaggtggaaaaggaagagaaaagaaattaaaagcgttagaccatctaaaagggaaagaagctaactttgctaaaacctataaccatttcttaagtacacaaattgtaacatttgcagttaaaaatcaggctggtcaaattaatatggagttcttggaatttgataagatgaaaaataagtctttgttaaggaattggtcttattatcaattgcaaatgatggttgaatataaagctaaacgagagggaataataataaaatatgttgatgcgtatcttacaagtcaaacttgtagtaaatgcgattattatgaagaaggacaacgtgaaaaacaggaaaaatttatttgtaaaagttgtgcttttgaagtaaacgctgactataacgcttcgcagaacatcgcaaagagtgcaaggtatatatcagatagtacagagagggagtatcataagaaaaagcaagaagatttaaaagaaatattaggggagaacgacataataaatgaacagctatcattgtttgataatcacgatgatattgcttag

SEQ ID NO: 103 - DNA, 1491 bp, Unknown
  Bacillus sp. multi
gtgattttaactaggaaagttaaactagttattgtatcggataatcgagacgaagggtataaactaattcgtaatgagataagagaacagcataaagcacttaatttagcctatacccgtttatattttgaacataatgctattcaaatattgaagcagaatgatgaggactacaaacagaaaagaaataagctacaacaattaattaacaagaaatatgaggaacatcaaaaggcaaaaaacttagagaagaaagaagcactaagagaagcttacaataaaaagaaacaagaactatataattttgaaaaggaatataatgagaaagcacgtcaagcttatcaacaggtagttgggtttacgcaacaaacgagagtacgaaatttaattagccgtgagtgtaatttaatgagtgatactaaggatgggattacaagtaaggtaacacaagactataagaatgattgcaaagcgggtttattagctgggaaacgttcgttacggaattataagaaagacaatcctttacttgttaggggcagaagcttgaagttttataaggaggatggggattattttattaagtggaacaagggaacgatctttaaatgtattttgcatattaggaaaaagaatgtagctgaattacaaagcgtcctagaaaatgttcttttagatatttataaggtttgtgatagtagtatcgctttcaacaacagggatatgatattgaatttaacgttgaacatcccgaataaagaaacacaagattatatcccaggtcgagttgttggagttgatttaggattgaaaattccagcttatgtatcattaagtgataaggtgtacgtcagaaaagggataggaagtatagatgatttcttgcgtgtgagaacacaaatgcaaaagcgtagacgccgatttcaagaatctttagcagctgtaaaaggtggaaaaggaagagaaaagaaattaaaagcgttagaccatctaaaagggaaagaagctaactttgctaaaacctataaccatttcttgagtacacaaattgtaacatttgcagttaaaaatcaggctggtcaaattaatatggagttcttagaatttgataagatgaaaaataagtctttgttaagaaactggtcttattatcaactgcaaatgatggttgaatataaagctaagcgagagggaataataataaaatacgttgatgcttatcttacaagtcaaacttgtagtaaatgcgatcactacgaagagggacaacgggaaacacaagaacgatttatgtgtaaaagttgtggttttgaagtaaacgctgattacaacgcttcacaaaacattgcgaagagtacaaagcatatatcagatagtgtagagagtgagtattataagaaaaagcaagaagctttaaaagaaatattaagagagaacgacacgataaatgaacagctatcattgttggataattgcgatgatattgcttag

SEQ ID NO: 104 - DNA, 1491 bp, Unknown
  Bacillus sp. multi
gtgattttaactaggaaagttaaactagttattgtatcggataatcgagacgaagggtataaactaattcgtaatgagataagagaacagcataaagcacttaatttagcctatacccgtttatattttgaacataatgctattcaaatattgaagcagaatgatgaggactacaaacagaaaagaaataagctacaacaattaattaacaagaaatatgaggaacatcaaaaggcaaaaaacttagagaagaaagaagcactaagagaagcttacaataaaaagaaacaagaactatataattttgaaaaggaatatgatgagaaagcacgtcaagcttatcaacaggtagttgggtttacgcaacaaacgagagtacgaaatttaattagccgtgagtgtaatttaatgagtgatactaaggatgggattacaagtaaggtaacacaagactataagaatgattgcaaagcgggtttattagctgggaaacgttcgttacggaattataagaaagacaatcctttacttgttaggggcagaagtttgaagttttataaggaggatggggattattttattaagtggaacaagggaacgatctttaaatgtattttgcatattaggaaaaagaatgtagctgaattacaaagcgtcctagaaaatgttcttttagatatttataaggtttgtgatagtagtatcgctttcaacaacagggatatgatattgaatttaacgttgaacatcccgaataaagaaacacaagattatatcccaggtcgagttgttggagttgatttaggattgaaaattccagcttatgtatcattaagtgataaggtgtacgtcagaaaagggataggaagtatagatgatttcttgcgtgtgagaacacaaatgcaaaagcgtagacgccgatttcaagaatctttagcagctgtaaaaggtggaaaaggaagagaaaagaaattaaaagcgttagaccatctaaaagggaaagaagctaactttgctaaaacctataaccatttcttgagtacacaaattgtaacatttgcagttaaaaatcaggctggtcaaattaatatggagttcttagaatttgataagatgaaaaataagtctttgttaagaaactggtcttattatcaactgcaaatgatggttgaatataaagctaagcgagagggaataataataaaatacgttgatgcttatcttacaagtcaaacttgtagtaaatgcgatcactacgaagagggacaacgggaaacacaagaacgatttatgtgtaaaagttgtggttttgaagtaaacgctgattacaacgcttcacaaaacattgcgaagagtacaaagcatatatcagatagtgtagagagtgagtattataagaaaaagcaagaagctttaaaagaaatattaagagagaacgacacgataaatgaacagctatcattgttggataattgcgatgatattgcttag

SEQ ID NO: 105 - DNA, 1056 bp, Unknown
  Paenibacillus thiaminolyticus (multi)
atggggacggaaaccgatgaacaccatacggtacaccaccgccacgatacgtcataccgcttcctgttgtccagcaaaaaactctttgtagagttgcttcgctcctttgttcaaaaagagtgggtagagcgcatcgatgaaacgaatgtacaggaaatcccccactcgtttgttcttcaagacttcaagcgcaaggaagccgatttggtataccgggtgaagctgaatggacaagatgtcgtgttttatttgttgctggaaatgcagtccaaagtggacttcctcatgccataccgccttctgctttatcaggttgagatctggcggtatcttatgaaagatcaggaaaaagcgaagggcaagcctaaaacattccggctgcctcccattgtgccgattgtgctgtacaatgggaagagacgctggaccgccagtcgccaatttcgccagttattagccaatgaaacgatgttcggttcggaactcctgaattttgaatatgtccttattgatgttgctcgatatacagaagaagaattgttggctctttccaatacgatcggttctgtctttttgcttgatcagacggcggatcagacggaattactgaatcggctcggcaagctgatgcataccatacagcaattgccagaggacagccagcagcaattggtcgcctggatggcgaatatattaagtcagaaattaccggaaaatgaaccgcagttgcgcgagcttattcaaaacgtaaaaggaggcgtatcggttatggggcttgaaaaaaccttggatgccattaagcgcgagggaagacgcgaaggcagaagagaaggtttacgagaaggtttacgagaaggtttacgagaaggtatattagaaggcaaacaagaaggtaaacgcgaaggtatattagaaggcaaacaagaaggcaagcgagaagcaaaagaagaagttgttaagcaaatgattgccgaaaatctggatcctgacttgatcgccagagtcacgggttttccattagatattatcacgcagttaagggaaaaatcccattga

SEQ ID NO: 106 - DNA, 1044 bp, Unknown
  Paenibacillus thiaminolyticus (multi)
atggggacggaaaccgatgaacaccatacggtacaccaccgccacgatacgtcataccgcttcctgttgtccagcaaaaagctctttgtcgagttacttcgctcctttgttcaaaaagagtgggtagagcgcatcgatgaaacgaatgtacaggaaatcccccactcgtttgttcttcaagacttcaagcgcaaggaagccgatttggtgtaccgggtaaagctgaatggacaagatgtcgtgttttatttactgctggaaatgcagtccaaagtggacttcctcatgccataccgccttctgctttatcaggttgagatctggcggtatcttatgaaagatcaggaaaaagcgaagggcaagcctaaaacattccggctgcctcccattgtgccgattgtgctgtacaatgggaagagacgctggaccgccagtcgccaatttcgccagttgttagccaatgaaacgatgttcggctcggaactcctgaattttgaatatgtccttattgatgttgctcgatatacagaagaagagttgttggctctttccaatacgatcggttctgtctttttgcttgatcagacggcggatcagacggaattactgaatcggctcggcaagctgatgcataccatacagcaattgccagaggacagccagcagcaattggtcgcttggatggcgaatatattaagtcagaaattaccggaaaatgaaccgcagttgcgcgtgcttattcaaaacgtaaaaggaggcgtatcggttatgggacttgaaaaaaccttggatgccattaagcgtgagggaagacgtgaaggcagaagagaaggtcttcgtcagggtctgcaagaaggtatacgagaaggtaaacgagaaggtatacgagaaggtgtattagaaggcaaacaagaaggcaagcgggaagcaaaagaagaagttgccaagcaaatgatttccgaaaatctggatcctgaattaatcgccagagtcacgggcttttcactcgatattatcgcacagttacgggaaaaatctaagtaa

SEQ ID NO: 107 - DNA, 1020 bp, Unknown
  Paenibacillus sp. multi
atggggacggaaaccgatgaacaccatacggtacaccaccgccacgatacgtcataccgcttcctgttgtccagcaaaaaactctttgtcgagttgcttcgctcctttgttcaaaaagagtgggtagagcgcatcgatgaaacgaacgtacaggaaatcccccactcgtttgttcttcaagacttcaagcggaaggaagccgatttggtgtaccgtgtgaaactgaatggacaagatatcgtgttttatttgttgctggaaatgcagtccaaagtggacttcctcatgccataccgccttctgctttatcaggttgagatctggcggtatcttatgaaagatcaggaaaaagcgaagggcaagcctaaaaccttccggctgcctcccattgtgccgattgtactgtacaatgggaagagacgctggaccgccagtcgccaatttcgccagttgttagccaatgaaacgatgttcggctcggaactcctgaattttgaatatgtccttattgatgttgctcgatatacagaagaagagttgttggctctttccaatacgatcggttctgtctttttgcttgatcagacggcggatcagacggaattactgaatcggctcggccagctgatgcatacgatacagcaattgccagaggacagccagcagcaattaatcgcctggatggcgaatatattaagtcagaaattaccggaaaatgaaccgcagttgcgtgagcttatccaaaacgtaaaaggaggcgtatcggttatgggacttgaaaaaaccttggatgccattaagcgcgagggaagacgcgaaggccgaagagaaggtttacgggaaggtatacgagaaggtaaacaagaaggtattcgagaaggtaaacaagaaggcaagcgggaagctaaagaagaagtcgtcaaacatatgatttccgaaaacctggatcctgaattgatcgccagagtcacgggcttttcgctcgatattatcgcacagttacgggaaaaaactaagtga

SEQ ID NO: 108 - DNA, 1056 bp, Unknown
  Paenibacillus lentimorbus (multi)
atggggacggaaaccgatgaacaccatacggtacaccaccgccacgatacgtcataccgcttcctgttgtccagcaaaaaactctttgtagagttacttcgctactttgttcaaaaagagtgggtagagcgcatcgatgaaacgaatgtacaggaaatcccccactcgtttgttcttcaagacttcaagcgcaaggaagccgatttggtgtaccgggtgaagctgaatggacaggatgtcgtgttttatttactgctggaaatgcagtccaaagtggacttcctcatgccataccgccttctgctttatcaggtggagatctggcggtatcttatgaaagatcaggaacaagcgaagggcaagcctaaaacattccggctgcctcccattgtgccgattgtgctgtacaatgggaagagacgctggaccgccaatcgccaatttcgccagttgttagccaatgaaacgatgttcggttcggaactcctgaattttgaatatgtccttattgatgttgctcgatatacagaagaagagttgttggctctttccaatacgatcggttctgtctttttgcttgatcagacggcggatcaggcggaattactgaatcggctcggcaagctgatgcataccatacagcaattgccagaggacagccagcagcaattggtcgcttggatggcgaatatattaagtcagaaattaccggaaaatgaaccgcagttgcgcgagcttattcaaaacgtaaaaggaggcgtatcggttatggggcttgaaaaaaccttggatgccattaagcgcgagggaagacgcgaaggcagaagagaaggtttacgagaaggtttacgagaaggtttacgagaaggtatcttagaaggcaaacaagaaggtaaacgagaaggtttattagaaggcaaacaagaaggcaagcgagaagcaaaagaagaagttgttaagcaaatgattgccgaaaatctggatcctgacttgatcgccagagtcacgggttttccattagatattatcacgcagttaagggaaaaatcccattga

SEQ ID NO: 109 - DNA, 978 bp, Unknown
  Paenibacillus thiaminolyticus (multi)
atggggacggaaaccgaggaacacaatacggtacatcaccgccacgatacgtcatatcgcttcctgttgtccagtaaaaagctctttgtcgagttgcttcgctcttttgttcaaaaagaatgggtgaagcgcatagatgaaacgaacgtgcaggaaatcccccattcctttgtccttcaagacttcaagcggaaggaagccgatttggtgtaccgggtaaagctgaatggacaagatgtcgtattttacttgttgttggaaatgcagtccacagtggacttcctcatgccgtaccgtctactactttatcaggtggagatctggcgctatcttatgaaagaccaggaaaagacaaagggcaagccgaaagcattccggttgcctcccattgtgccgattgtgctgtacaatggaaagagacgctggaccgccaatcgccaatttcgccagttgttagccaatgagacaatgttcggttcggaactcttgaattttgaatatgtgcttattgatgttgctcgatacacggaagaagagttgttggctctttccaatacgatcggttctgtctttttgcttgatcagacggaggatcagacggaattactgaatcggctcggcaagctgatgcataccatacagcaaatgccagaggacagccagcagcaattggtcgcctggatggcgaatatattgagtcagaaattgccggaaaatgaaccgcatttgcgcgagcttatccaaaacgaaaaaggaggcgtatcggttatggggcttgaaaaaaccttggatgccattaaacgcgagggaagacgcgaaggccgaagagaaggcaaacaagaaggcaagcgggaagcaaaagaggaagttgtccagcaaatgattgccgaaaatctggatcctgaattaatcgccagaattacgggcttttcactcgatattattgcacagttacgggaaaaatctaaatctaagtga

SEQ ID NO: 110 - DNA, 1020 bp, Unknown
  Paenibacillus thiaminolyticus (multi)
atggggacggaaaccgatgaacactgtacggtacatcaccgccacgatacgtcataccgcttcctgttgtccagcaaaaaactctttgtagagttgcttcgctcctttgttcaaaaagagtgggtagagcgcatcgatgaaacgaatgtacaggaaatcccccactcgtttgttcttcaagacttcaggcgcaaggaagccgatttggtgtaccgagtcaagctgaatggacaagatgtcgtgttttatttattgctggaaatgcagtccaaagtggacttcctcatgccataccgccttctgctttatcaggttgagatctggcggtatcttatgaaagatcaggaaaaagcgaatggcaagcctaaaacattccggctgcctcccattgtgccgattgtgctgtacaatgggaagagacgctggaccgccagtcgccaatttcgccagttgttagccaatgaaacgatgttcggctcggaactcctgaattttgaatatgtccttattgatgttgcccgatatacagaagaagagttgttggccctttccaatacgatcggttctgtctttttgcttgatcagacagcggatcaggcggagttgctggatcggctcggcaagctgatgcatacgatacagcaattgccagaggacagccagcagcaattggtcgcctggatggcgaatattttaagtcaaaaattgccggaaaatgaaccgcagttgcgcgagcttatccaaaacgtgaaaggaggcgtatcggttatgggacttgaaaaaaccttggatgccattaagcgcgagggaagacgtgagggcagaagagaaggtcttcgtcagggtctgcaagaaggtatacgagaaggtaaacgcgaaggtttattagaaggcaagcgtgaagcaatagaagaagttgccaagcaaatgatttccgaaaatctggatcctgaattaatcgccagagtcacgggcttttcactagaaattatcacgcagttaagggaaaaatcccattaa

SEQ ID NO: 111 - DNA, 1044 bp, Unknown
  Paenibacillus thiaminolyticus (multi)
atggggacggaaaccgatgaacaccatacggtacatcaccgccacgatacgtcataccgcttcctgttgtccagcaaaaaactctttgtagagttgcttcgctcctttgttcaaaaagagtgggtagagcgcatcgatgaaacgaatgtacaggaaatcccccactcgtttgttcttcaagacttcaagcgcaaggaagccgatttggtgtaccgggtgaaggtgaatggacaagatgtcgtgttttatttattgctggaaatgcagtccaaagtggacttcctcatgccataccgccttctgctttatcaggttgagatctggcggtatcttatgaaagatcaggaaaaagcgaagggcaagcctaaaacattccggctgcctcccattgtgccgattgtgctgtacaatgggaagagacgctggaccgccagtcgccaatttcgccagttgttagccaatgaaacgatgttcggctcggaactcctgaattttgaatatgtccttattgatgttgcccgatatacagaagaagagttgttggccctttccaatacgatcggttctgtctttttgcttgatcagacagcggatcaggcggagttgctggatcggctcggcaagctgatgcatacgatacagcaattgccagaggacagccagcagcaattgatcgcctggatggcgaatatattaagtcagaaattgccggaaaatgaaccgcagttgcgcgagcttatccaaaacgtaaaaggaggcgtatcggttatggggcttgaaaaaaccttggatgccattaagcgcgagggaagacgtgagggcagaagagaaggtcttcgtcagggtctgcaagaaggtatacgagaaggtatacgagaaggtatacgcgaaggtttattagaaggcaagcaagaaggcaagcgtgaagcaaaagaagaagttgccaagcaaatgatttcagaaaatctggatcctgaattaatcgccagagtcacgggcttttcactcgatattattgcacagttacgggaaaaatctaattga

SEQ ID NO: 112 - DNA, 1056 bp, Paenibacillus terrae
atggggacggaaaccgatgaacaccatacggtacatcaccgccacgatacgtcataccgcttcctgttgtccagcaaaaaactctttgtcgagttgcttcgctcctttgttcaaaaagagtgggtagagcgcatcgatgaaacgaatgtacaggaaatcccccactcgtttgttcttcaagatttcaagcgcaaggaagccgatttggtgtaccgggtgaagctgaatgggcaagatgtcgtgttttatttattgttggaaatgcagtccaaagtggacttcctcatgccataccgccttctgctttatcaggttgagatctggcggtatcttatgaaagatcaggaaaaagcgaagggcaagcctaaaacattccggctgcctcccattgtgccgattgtactgtacaatgggaagagacgctggaccgccagtcgccaatttcgccagttgttagccaatgaaacgatgttcggctcggaactcctgaattttgaatatgtccttattgatgttgcccgatatacagaagaagagttgttggccctttccaatacgatcggttctgtctttttgcttgatcagacagcggatcaggcggagttgctggatcggctcggcaagctgatgcatacgatacagcaattgccagaggacagccaacagcaattggtcgcctggatggctaatattttaagtcaaaaattgccggaaaatgaaccgcagttgcacgagcttatccaaaacgtaaaaggaggcgtatcggttatgggacttgaaaaaaccttggatgccattaagcgcgagggaagacgtgagggcagaagagaaggtcttcgtcagggtctgcaagaaggtatacgagaaggtatacgagaaggtatacgagaaggtaaacgcgaaggtttattagaaggcaagcaagaaggcaagcgggaagcaaaagaagaagttgccaagcaaatgatttccgaaaatctggatcctgaattaatcgccagagtcacgggcttttcactcgatattattgcacagttacgggaaaaatctaagtaa

SEQ ID NO: 113 - DNA, 942 bp, Unknown
  Paenibacillus thiaminolyticus (multi)
atgggaaaggaatcagatgaacataatacgattcattaccgccacgatacatcataccgcttcctgttgtccagcaaaaaactctttgtcgagttgcttcgctcctttgttcaaaaagagtgggtagagcgcatcgatgaaacgaatgtgcaggaaatcccccactcgtttgttcttcaagacttcaagcgcaaggaagccgatctggtgtaccgggtgaagctgaatggacaagatgtcgtgttttatttgttgctggaaatgcagtccaaagtggacttcctcatgccataccgcctgctgctttatcaggttgagatctggcggtatcttatgaaagatcaggaaacagtgaagggcaagcctaaaacattccggctgcctcccattgtgccgattgtgctgtacaatgggaagagacgctggaccgccagtcgccaatttcgccagttgttagccaatgaaacgatgttcggctcggaactcctgaattttgaatatgtcctgattgatgttgcccgatatacggaagaagagttgttggctctttccaatacgatcggctcagtctttttgctagatcagacggcggatcagacggaattactgaatcggctcggcaagctgatgcatacgatacagcaattgccagaggacagccagcagcaattggtcgcctggatggctaatatattaagtcaaaaactgccggaaaatgaaccgcagttgcgcgagcttattcaaaacgtaaaaggaggcgtgtcggttatgggacttgaaaaaaccttggatgccattaagcgtgaaggcagaagagaaggcaagcgtgaagcaaaagaagaagttgtcaagcaaatgctcgccgaagacttggaacctgaattgatcgccagagtcacgggcttttcattggagatgatcacacaattaagagaacaatag

SEQ ID NO: 114 - DNA, 1299 bp, Unknown
  Paenibacillus thiaminolyticus (multi)
atgaagcataagctaaaacagaaacaaaatcaacgtatcacaagaattaccgattcgacgctagtcgttggtgcagacatcgccaagaaaattcacgtcgcacgagccgtggatttccggggcattgaactgggtaaagattgcgtgttccctaacgaccaacaaggattaacgaagctaacaacgtggatgaaggagcttgggcaagcacacagcaagacagacattgtgtttggcatcgagccaaccggacactactggtttccgctagcggcatatcttcatgcgcaaggcattcaaatcgtcgtcgtaaatccgcatcatgtcaacaagagcaaagagttggaggacaactctcagacgaagagtgactacaaggatgctaaagtcatcgcggatcttattcgaaacgggaaatactccgagccgaagctgccgacgaaggagtatgcagatttacgaatccttatgaacctgcgggagaaggtatctgcaagcctgacgcaagtaaaaggccgcattggccattggtttgaccggttcttcccggaatacagcaccgtatgtaaagactgggatggcaagacatcgctcatgacgatgcggtcgtttccgcttccatcggacatcgtatccaagagcgctagagaggtcttggctcactggaagacggaagtaaagcgcggcgtaggcatcaaacgggcagagaaactggttgccgccgctgcggcctccattgggctaacagaaggttcggcagccgcccgaatcgagctaagcaccttgttagggcaatttgaattgttccgtgagcagcttgaagggatcatgaaagaagtgacgcagatccttgagaatatccctggagcagagcacatgctaagcgtgccaggggttggaacggtcaccgtagccggttttctggccgaagttggagatctgagcaactatgatcatggccagcaaatcatacgactagcaggactaaacctgaaagaaaacagttcaggcaaacgaaagggaaaaacgggaataagcaagcgcgggcgttcacgcttgcgtgcgctgctgttccgtgctgtgatgcccatggtggccaagaatgaagcgtttaaaacactgcacaagcattacacgaaccgaagtcaaaatccgctcaagaagaagcagtccctcatcgctctgtgtggaaaactcatacgtgttctccataccctggggacaaagcaacgagcctacaatgccgatgaaatgcttggccctgttcgacaaagccagatgcagctagaggcagcttaa

SEQ ID NO: 115 - DNA, 1437 bp, Unknown
  Bacillus sp. multi
atgattattacaaggaagataaaacttataattgttggtgaagaacgagacaatcaatataaatttattcgtgaagaacgttataaacaaaacaaggcattaaatgttgcgattaatcatttatattttcttcacgtagcaaaagagaagattcgcttattggatcataaatttgtacaagatgaacagaaattacaagaaacgattgataagctatatgatgaaaaacgaaaacaaaaagatgaaaagaaaaaagatacgatagaacaaaaaatagaaaagaaaagaaacaaattaaaggaattacgaagtaaagggaataaggaagcagcaaaaactttgcaagatgccataaaaattaattttactactacaacgcgtgaaatcattaataaacaatttgacttgatgagtgatacaaaagaccgaattacacaaaaggtaacacaagattttagtatagacttaaaaaatggtttattaagtggtgaacgatcattacgcacatataaaaagaataatcctttattcattcgtggtcgtacattgtatttttaccaggaaggaaaaagcatactgattaaatggtgtaaaggaattgtgtttaaatgcatacttggaagacatcaaaataatagtcatgaattgtggaccatattaaaaaaagtgttagaacaatcttataaagtatgtgacagtagcatatcggtaggaaaagattttatcctaaatttatcattagatataggagaaagtgataatagaacagcttttgttgagggaagagtgttgggggtagacttaggaatgaaagtaccagcttatatgtctatcaatgataaaccatatattcgtaaagccttaggaagtttagaggattttttgaaaattcgtgtacaaatgcaaaaaagaagaaagaatttacacaaaactttagtcagtgtaaaaggcggaaaaggtagagagagaaaagtaaaagctttagatcgatttaaagaaaaagagcaaaactttgcaacgacctataatcattttttgagccataacattgttaaattcgccaaaaagcatagatctgggcaaattaacatggaattcttagctcttgcgggggaagataaggataaaattttacgcaattggtcatattatcaattgcaggagtttattgaatataaagctaatcaagaaggaataaaggtaaaatacgtagatccatatcgtacaagtcaaacttgttcgaagtgtggatcttatgaaccagggcaacgagaatcacaagaaaaatttatttgtaaggtatgtaaacttgaaataaatgcagattataatgcatcacaaaacattgctcatagtacaaagtacatgactaataaacaacaaagcgaatattttaaaagactgcagcaaaccacaaagttagaaaaatattcatga

SEQ ID NO: 116 - DNA, 1425 bp, Unknown
  Bacillus sp. multi
atgattatcgctaggaaaattaagcttattatcattggtgaaaatcgggatacccagtataaatttattcgtgaagaacgatataaacaaaataaagctttaaatgtagcaatgaatcatttgtactttcttcatgttgcaaaagagaaaattcgattgttagataagaaatttttacaggatgaaaagaaactacaagaaggcattaataagctttatgctgaaaagaagaaggttataaaagatgagaaaaaaagaaatgaactagaaaagaaaatacagaaacaaacaaatgaattaaagaagttgcgaagtaaaggtaataaagaagcggataagattttacaagaagcgattaaaattaatctttctagcacaacacgtgaagtaatcagtaaacagtttgatttgataagtgatacaaaggatcggattacacaaaaagtataccaagactttaaatctgatttaaaaaacggtttattgagcggtgaacgtgtattacgtacatataaaaagaataatccattgttaataagagggcgtgcattgaatttttatcgtgaaggaaaagatgtaatgattaagtggtttggaggtattattttcaaatgtatgcttgggcaacataaaaataatgctcaagagttaaaagcgactttaaataaagtgttagaaggatcttataaggtatgtgatagcagtatttcagtaggaaaggaactaattcttaacatatccttagatataggagaagttgattccaatgtctcctgtaaaaaaggacgtgttctaggtgttgacttgggtatgaaggtaccagcttatatgtctataaatgacaaaccgtatattcggaaatcattaggaagtttagatgattttttaaaaatccgtgtacaaatgcaaaaaagaagaaggaatttacacaagacattagtgagtgtaaaaggcggaaaaggtagagaaaaaaaattacaagcattagatcgcttaaaagaaaaagagaagaactttgcaacaacttacaatcattttttgagttataacatcgttaagtttgcaaaagacaatcttgctgaacaaattaatatggaatttcttgcactagctggtgaagataaaaatataattttaagaaactggtcttattatcagttgcaacaatttgtagagtataaagctaagcgagaaggaatcgatgtgaagtacgtagatccataccgtacaagtcaaatgtgctcaaaatgtgggaattatgaaccaggacaaagagaatcacaggaaaagtttatttgtaaatcatgtcatttggaaatcaatgcagattataatgcatcacaaaatattgctcatagtacaaaatatattacaaataaaaatcaaagtgagtattttaaaaaattgcagcataccatcgaatag

SEQ ID NO: 117 - DNA, 1191 bp, Unknown
  Streptomyces sp. multi
atggccgcgatctgggccggcatcgacgcaggcaagacccatcaccactgcgtagcgatcgatgagagcggccgtcggctgctgtcgcgacgcgtcgccaacgatgagcctgaacttctcgaactcctcaccgacgtcctggccttgggcgacgaggtgacctggggaatcgatctggccgacggcggagccgccctggccattgcgatcctcctcaaccacgaccagccggtgaactacatctccggccgggccatccaccgcgcctccgagagctaccgcggcgagggcaagaccgatgccaaggacgccgcggtcatcgctgaccaggtccgcatccggcgggacctgaaccccttacgcacgggtgacgaaaccgtcaccgacctcaagatcctcaccggccgccggatggacctcgtcgccgaccgcacccgcaccatcaaccggctccgggcacagttgtccgggatcttccccggcctggaacgggccctggacctcaccaacaagggccctctgaccctgctgaccggctaccagacctccgcggctatccgccggctcggcaccaagcgcctggagacctggctgcgaaatcgcaaggtcctccgcgctgatcagctcgccgagaccgcggtcgcggctgccgaacgtcagcacaccagcctgcccggggagaagctgaccgcccagatggtgcacacgctcgcgaaggaggtgatggtcctcaccgagcaggtcgccgaggtcgacaagctcatcgaggcccggtttcgcgaccaccgccacttcgacgtgatcaccagcatgcccggcctcggcatcatcctgggcgccgagttcctggccgccaccggcggcgacatgactatcttcgacacccccgaccgcctcgccgccttcggcggcgtcgccccggtcccgcgcgactccggaaagatcagcggcaacctgcggcgcccgcagcgatacaaccgacgcctccagcgcgtcttctacacctccgcgctgttcagcatccgaaagtgcgaggaatcccgccgcttctacgaccgcaaacgagccgagggcaagcgtcacacccaagcggttctcgccctcgcccgtcgccgcgtcaatgtcctctgggctctcctccgtgatggacgggcctacgaactcacgccgcctacggccctcgcggcttga

SEQ ID NO: 118 - DNA, 1131 bp, Unknown
  Bacillus sp. multi
atgcgtgtacaagaggtgatcctagagaatggaaagagatacatattagtagattcagatggggttcctgtgattcctgtggtgaagtacctcaagtatttggatgttacagggaaaagcagcaacacacagaagacttattgttatgcactcaaacagtatttcctgtacttacaggaaacagagaaagattacaagcatataagattagaggacttggtggagtttgtgggatggcttcggaatccgtatgagagcaccaaggtaatgtcccttcgacctgtgcagacaaagaaaacagaaaggacagtgaaccttacggtcactgctgtcacaaacttctatgactatttataccgaaatgaggagttgccacttgatatggaagagaaattgatacgtcaggtctttacaggcgggagaacgcggtataagagtttccttcatcatgtcaacaaggacaagccatccatgcggaatgtgttgaagataaaagaacctcgcaagagggtgcagacacttacaatagaacaggtggagcaagtcttagcggcaacaacgaatatacgggatacctttctcatccgactcttgtttgagacggggttaagaattggagaggctctttctttatttttggaggatttcaagtttagtcatcaaaaaggacatcgtattcgtctgacggatcgcggggaattagagaacagtgcgaaactaaaaacaggggaacgcgaaatctttgtttcacaggagctcatggacttatatgatgactacatgtatgatgtcgttgacgaattggacttcgaaaccaattttgtgttcgtcaaactgcgcggtaagaacaggggtaaaccgatgacctatggtgacgtggaagctctattcaagcggttacgtcagaaaatagggctgaacatccaccctcacctgttccgtcatacgcacgcgacgatgtactatcaagaaacgaaggatattaaacaggtgcaagagcgactgggccattcacaaatccaaacgaccatgaacctttaccttcatccttcggacgaagatacccgtaaggtttgggaaaaggcacagggagcatttcaaatcaaacaacagaatggcgggaaagaatga

SEQ ID NO: 119 - DNA, 3018 bp, Unknown
  Bacillus sp. multi
atgcctagtattgaagatacagcttatcctcgattgaaaagtaatccatcccaaaaagaattacaagaactatattctcctacaattgaagaaattcattggatgaagccacatgtaaaaggagatgtagctaaattaggagtattcgttttactaaaaacatttcaacgattaggatattttcttcctgtaacagaaatacctgaagacattgtcatacatattgctcaaaaaatgaatcttactcttgtatcacgaaatgatttacagaaatatcataactcaggtactcaaaaacgtcaccatgccttgattagagaatatagaaacattcatttcttcaatgatcaagctagaaagattatgattgataccatgaatcaagtatcatcaacaaaagacgactcggccgatttcattaacgctgcaatagatgaattaattcgtcagcgttttgaattacctactttttctactttgaatgagacagctaagaggttgcgttctcaatcgtaccatgtggtgtatgaacaagtatatcaatcaataaatgaaaacgataaaaataagattgattctctctttcaaacgaatgatggtactgtgtatacgccttggcatcatctcaaacaagatgccaaaaatcctactataaagcatttcagagaattagtaacacaaatggaatggttaatggctcaaaaagtaaatactacaatacttaagagtattccttctgttaaaatacgacaaatgacttcagaagccaaaacgctcgatgcagcaagaatgaaaaaaatggaacctaaaaaacgatatgcacttgctctctcttttatccaatctcaactcgcccatgttttagataatattggagaaatgatggttaagagaatgatgtctgcccgtaataaaagtcgtgatcagttacaacactatcaaatgaagaaccaaaaacggaccgatttgttaattacaactctttatgatgtcattcttgcctatcgttcaggaaatgaatctcaagataaaatggaagcgattgaacaagtagtaggaaaccgacatgaggagatattacatgattgcgaatcacatcttgcttatagtggtgataactactttgtctttgtctgggattattataaaagtagtcgttctacgttgtttaaaattttaaacacggtttccctacgctctacaaaccaagatcaaggattagaagatgcgattgcgtttttaaaaactcatcaaaattcccgaaaagagtcactttctatcgtaagtattgaaaaaaagggatactggaaaaaggaaataaaacctctactcgatttatcgtggattcctgatgcatggtggaggtggatagctccaaatcgaaaatctgggtgttatccagaagaagtgaatcgccgtcactttgaagcttgtgtatttacccagattatgtggggtttaaaatctggagatctttacattgagggaagtgaaaaatacgctgattatcgacaacaacttatctcttggaatgaatatgaacaaaaattattggatttttgtcataaaagcaatctcccctctacaggtaaagaatatgtaaaacaattacggaaaaggtttatgaaaatagcaaagaaaacagatgcttcttttccatacaataaacaagtgcgtattgagaatggtgaaattgtcattggaaagtcaaagaaaagaaaaccttctcctaaattaaaaagtttagaaaaatatatgactcaaaatctagttcccatcaatgttttagatatgctaggtgatacagaacattggttaaattggactcgattttttaaacccatttcaaaacatgaggctcgattagaagatccgattgaacgctatttaactactgtgttttgctatggttgtaatctaggacctgttcaaaccgcaagatcattaggaaacatggaccgaagacaaatttcatgggtaaatcaaagacacattacgacagaaaatctagatcaagcaatccaattcattatcaattcctataacaaattcggcctacctaagtattggggagacgggaaaagcgcatctgctgatggaacaatatgggccttatatgaacaaaacttgttatctgagaggcacatccgttatggaggatatgggggaattggctattatcatgtttctgataattatattgcattatttagtcattttataccgtgtggtgtatgggaaggactttatatactagatgtcttaatgaataataattctgagattcaaccagaagtcattcattctgatacacaaggacaaagtgctaccatttttggattatctaccttaatgggtatcgagttaatgccacgaattcgaaattggaaagatttaaaaatgttccgtccagataaagaaagtcgatttaagcatattgacgatatttttaccgatgaaattgattgggatttaattgaaatccattataaagatatgctacgagtagccatgtcaattgaagtaggaaaaattactccttccactattttgaataagctaggaacctatagtaagaaaaataaattatatcaagcgtttcgagaattaggacgtgtaattcgcactatgtttttattaaagtacatagctgatgaacaattgagacgtaccattcaaacagctacaaataagagtgaatcatttaatgggtttaccaaatggctattttttggtggagagggaatcattactgaaaataatagagaaaaccaaagaaaagtgattaagtttaatcacttagtagcgaattgtttaattttttacaatgtatttgcattaacacaagtgttacatgcttatcggcaagatggaaatgaattggacgaagaagtattgagtgagttgagtccatatatcacagctcatgtgaatcggtttggcaaatatggaattgatccaaatagacagccaccggatttacagttcgatatgccaatttaccaagtagccaattaa

SEQ ID NO: 120 - DNA, 1464 bp, Unknown
  Bacillus sp. multi
ttgattacatctcgtaaaattagactttctatagtttcggataattcaacagaagcttataactttattcgtaaagaaatgagagagcaaaataaagctctaaacgtcgcaatgaatcatttgtactttaattatgttgcacggcagaaaatctcatttgctgataaagcctatcagcacaaattaaacaaggctatagaagcacagcaaaagtcttttattttactgaaagaacttgaacaaaaacaaattgtagaaactgattcaagtaagaaatcaatattgaaagaacgcctgattaaaagcaaaactacttatgagaaaacaaaagaaaaattaagcagtttacgtaaagcgaggaataaagaattgtttcaagaatataacaatatgattggacaactggaggaaacgcatttacgtgatattgtgtcatctcaatttaatttactttcagatactaaagacaggcttacaaaaattgcgtaccaagacttcaaaaatgatataaccgaagttttatctggcgatcgttctttaagaacatataaaaaaaataatcctttatatatacgaggcaggacacttaacttatttaaagaatctgaagaattctttataaaatggacaaaaaaaattgtctttaaatgtgtccttggagtcaaatatcaaaataaaactgagctttacaaaaccttagaatgtatactcactggtgaatatacattatgtgatagttcaatgaattttaatcaacaaaataaactaattctgaatttagcattaaacattccagaaaaaagcgaaaatagaaaagttccaggacgtattgctggaattgatttaggacttaaaatacctgcttattttgcagtaaatgatgttccctatatccgaaaagcccttggtaaaattgaagattttctaaaagttcgtactaatatacaatctcaaaaacgaagtttacaacgtgctctccaatcttctaaagggggaaaaggaagaaaaaagaaactaaaagcgttagatcaatttaaggaaaaagaaaaaaactatatcataacctataatcactttattagtaaaaaaatcattagtttagctgtccaatacggcgttgaacagattaacttagagttgttaactttaaaagaaacacaaaagaaatcacttttacgtaactggtcgtattatcaactacaacaattcattgagtataaggctaacagagaagaaatttcaattaaatatgttgatccatttcatacttcacaaacctgtagtaaatgcggtcactatgaggacggacaaagagaaaaacaagatactttttgttgtaaatcttgcggatttatagataatgcagattataatgcagctcgtaatattgcagcgagtacaagatatattacaaataaagaagaaagcgaatattaccggaaaaataataatgaaatagcgtga

SEQ ID NO: 121 - DNA, 1464 bp, Unknown
  Bacillus sp. multi
ttgattacatctcgtaaaattagactttctatagtttcggataattcaacagaagcttataactttattcgtaaagaaatgcgagagcaaaataaagctctaaacgtcgcaatgaatcatttgtactttaattatgttgcacggcaaaaaatctcatttgctgataaagcctatcagcaaaaattaaacaaggctatagaagcacagcaaaattcttttattttactgaaagaacttgaacaaaaacaaattgcagaaactgattcaagtaagaaatcaatattgaaagaacgcctgattaaaagcaaaactacttatgagaagacaaaagaaaaattaagcagtttacgtaaagcgaggaataaagaattgtttcaagaatataacaatatgatcggacaactggaggaaacgcatttacgtgatattgtgtcatctcaatttaatttactttcagatactaaagacaggcttacaaaaattgcgtaccaagacttcaaaaatgatataaccgaagttttatctggcgatcgttctttaagaacatataaaaaaaataatcctttatatatacgaggcaggacacttaacttatttaaagaatctgaagaattctttataaaatggacaaaaaaaattgtctttaaatgtgtccttggagtcaaatatcaaaataaaactgagctttacaaaaccttagaatgtatactcactggcgaatatacattatgtgatagttcaatgaattttaatcaacaaaataaactaattctgaatttagcattaaacattccagaaaaaagcgaaaatagaaaagttccaggacgtattgctggaattgatttaggacttaaaatacctgcttattttgcagtaaatgatgttccctatatccgaaaagcccttggtaaaattgaagattttctaaaagttcgtactaatatacaatctcaaaaacgaagtttacaacgtgctctccaatcttctaaagggggaaaaggaagaaaaaagaaactaaaagcgttagatcaatttaaggaaaaagaaaaaaactatatcacaacctataatcactttattagtaaaaaaatcattagtttagctgtccaatacggcgttgaacagattaacttagagttgttaactttaaaagaaacacaaaagaaatcacttttacgtaactggtcgtattatcaactacaacaattcattgagtataaggctaacagagaagaaatttcaattaaatatgttgatccatttcatacttcacaaacctgtagtaaatgcggtcactatgaggacggacaaagagaaaaacaagatactttttgttgtaaatcttgcggatttatagataatgcagattataatgcagctcgtaatattgcagcgagtacaagatatattacaaataaagaagaaggcgaatattgccggaaaaataataatgaaatagcgtga

SEQ ID NO: 122 - DNA, 1461 bp, Unknown
  Bacillus sp. multi
ttgattacatctcgtaaaattagactttctatagtttcggataatgcagcagaagcctataactttattcgtaaagaaatgagagagcaaaataaagccctaaacgttgcaatgagtcatttgtactttaattctatcgccagacaaaagatcttattagctgatgaagcgtatcaacaaaaattaaaagacgctataaactcacaagaaaaatcatttaatacactaaaagaacttgagagaaaacagtgcatagaaggagattctgaaaagaaacaaactttaaaagaacgtttaatcaaaacacaaaatgcttacgagaaatcaaaagaaaaggtaagtaatttacgtaaaagtagaagtaaagattcattccaagagtataacaatataattggacaggttgaacaaacacatctacgggatgtcatttcctctcaattcaacttacattcagatacgaaagaccgactcacaatgattgcgaatcaagatttcaaaaacgatataggtgaagttttatctggtaattgctcattaagaacatataaaaaaaataatcctctctatataagaggtagaaacaccgtcttatataaagaaggtaatgagttctttataaaatggataaaaggaattgtcttgaaatgtattctgggagttaaaaatcaaaataaaactgagctttacaaaacattagaatgcgtacttgctggagtttataaaatatgtgatagttcaatgaattttaatcaacaaaataaactgattctgaatttagcattaaacatgccagataaaagcgaaaataagaaagttccaggacgtattgcaggaattgatttaggacttaaaatacctgcttatttttcagtaaatgatgctccttatatccgaaaaggcatcggtaaaattgaagattttctaaaagtccgtaccagcatacaatctcaaaaacggagtttagaacgcgctctccaatcctctaaaggtggaaaagggaggaaaaagaaattaaaagcgttaaatcagtttaaagaaaaagaaaaaagctatgtcacaacctataatcactttattagtaaaaaaattattagtttagctattcaatacggtgttgaacggattaatttagaattgttaactttaaaagaaacacaaaagaaatcacttttacgtaattggtcatattatcaactacaacaattcattgagtataaggctaacagagaaggaattttaattaaatacgttgatccatttcacacttcacaaacctgtagtaaatgcggtcactatgaggacggacaaagagaaaaacaagataattttcattgtaaatcttgtggctttaaagaaaatgcagattataatgctgctcgtaatattgcaaagagtacaaactacattacaaagaaagaagaaagtgaatattataaaagaaataatgaaatagcgtga

SEQ ID NO: 123 - DNA, 1839 bp, Unknown
  Lysinibacillus sp. multi
atgttagcttattttcctcgaccatatgaaaatgaaaccatatatagtatagcagcaaggtatgctaggcatatggggattttatcaaaacgcaatgttttaaaagacttatttgagattgtaaatccaacttcaagtgaagattatacttttcacatatatactctggttaataaaatcaggcatttttcaaatgaatacactgatgaatattttttaaataaacacactgtttctcctctttattctccatttatcaaagattcaagtggcaatccctcacgttctttagataactttatcaaagggaagaaaagatatatgtgggacatccctgaaaaagagaatttattttattgtagtgagtgtgtcgaggaagatttagaaaaatacggtgaatgttattggaataggatttttcaaatacccggaattatgatttgtggaaaacatgaaaggccattaagtaagtcacagttaaatatacatagaaatcctttaaataaatttataatgcctaatcaggaagtggcagtagatattaaaatagataatgaaatttttgaacaactattagaaataacaagaaatgttgaatatttttttactaacaaagtggatacatttaattatcaagaactctatgaaaaatattttgagtttattaagatagctagcattgcaattccattatcacatttaaaaaagaaattgggagaattaataatatcaagatttaatgagaaaactttagattttcttaactccaatccgcgaaaaaatgattggttatcatatttaagtgtcgagaggataaaacatattcatccaattagacatgttttattaatgatgtccttggcactatcagttgagaggtttataaacatcgtcccaaaatatcaaccatttggaagtggggcatggatatgtatgaattcattatccgaacattatttggaaaaagtcgtaacaaatgttaatattactttcaataaagatataggtaactttcagggtgagtttaagtgtagttgtggattcacttatgtattatataatggtgagaacaatccatgtaatataagtaagttcagtcctagagtaaaggaaaagggacatatatggagaaaagaatttgatgaattagtcagtagaggagcatcaattaaagaaatagctttaaaaaccaactacagtacgggcactgttcgtaagataataaaacaagggcataattatcatgaaaatgaaaagaagaggagacaacaaaatttagaagagagaaggatcattagggaaaaaaatgataagatggattggaatggaataagaagaaaatatcctaactcctcacgtacagaattaatgtatgaaaataaagccctttacaatagattgcttcgatacgatagggagtggttaatagaaaattctccaacttcccaaagaggagcagtaaaaacaagtgatgatattaatcacaaacgggatgtattatatttaaaggtagcccaagatatgttggagaattggtcagaatacgaaaaacaagcggggaaaattattaaaaaaactcaatttaccctttatacaaggttaggaatgaaaacgcgtaataatgataagtatccactaacagttgcctttatttccacgtttatagaatcaaatgaagattatcaaataagattaattaatcaatgcatcgagaaccattttataaattcagaaataaaaagatatagaatactagaatatagtggattaaggtatcttcatcccaaggcagaaaaatacttggaggttattataaatgaaaataataaaaggaattaa

SEQ ID NO: 124 - protein, 451 aa, Unknown
  Bacillus sp. multi
MGVTIKIMKYQILCPMNVDWIIFEKHLRNLTYQIRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKEKKFDKELIMGIDMGGINTVYFAFNEGFIRSNIKSDEIKEFNERIRQRRINLLNQSKYCSNSRTGKGRTKRLQPIDVLSNKIAKFRNSTNHKYANYIIKQCLKYNCGRIQMELLKGISKNDKVLKDWTYFDLQEKIKNQAEIHGIEVIKVAPAYTSQRCSQCGYICKENRCTQAMFECKQCGYKTHADYNAAKNIATYDIENIINKQLAAQSKLHSKKCMEEYIEELGYLD

SEQ ID NO: 125 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKEKKFDKELIMGIDMGGINTVYFAFNEGFIRSNIKSDEIKEFNERIRQRRINLLNQSKYCSNSRTGKGRTKRLQPIDVLSNKIAKFRNSTNHKYANYIIKQCLKYNCGRIQMELLKGISKNDKVLKDWTYFDLQEKIKNQAEIHGIEVIKVAPAYTSQRCSQCGYICKENRCTQAMFECKQCGYKTHADYNAAKNIATYDIENIINKQLAAQSKLHSKKCMEEYIEELGYLD

SEQ ID NO: 126 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLMNQTYSKGACMIHKYKNKWYLSITYKFNAIKEKKFDKELIMGIDMGGINTVYFAFNEGFIRSNIKSDEIKEFNERIRQRRINLLNQSKYCSNSRTGKGRTKRLQPIDVLSNKIAKFRNSTNHKYANYIIKQCLKYNCGRIQMELLKGISKNDKVLKDWTYFDLQEKIKNQAEIHGIEVIKVAPAYTSQRCSQCGYICKENRCTQAMFECKQCGYKTHADYNAAKNIATYDIENIINKQLAVQSKLHSKKCMEEYIEELGYLD

SEQ ID NO: 127 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIIKQCLKHNCGRIQMELLKGISKNDKVLKDWTYFDLQEKIKNQAEIHGIEVIKVAPAYTSQRCSQCGYICKENRCTQAMFECKQCGYKTHADYNAAKNIATYDIENIINKQLAVQSKLHSKKCMEEYIEELGYLD

SEQ ID NO: 128 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFLRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIIKQCLKHNCGRIQMELLKGISKNDKVLKDWTYFDLQEKIKNQAEIHGIEVIKVAPAYTSQRCSQCGYICKENRCTQAMFECKQCGYKTHADYNAAKNIATYDIENIINKQLAVQSKLHSKKCMEEYIEELGYLD

SEQ ID NO: 129 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYYSNSRTGKGRTKRLQPIDVLSNKIAKFRNSTNHKYANYIIKQCLKHNCGRIQMELLKGISKNDKVLKDWTYFDLQEKIKNQAEIHGIEVIKVAPAYTSQRCSQCGYICKENRCTQAMFECKQCGYKTHADYNAAKNIATYDIENIINKQLAVQSKLHSKKCMEEYIEELGYLD

SEQ ID NO: 130 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIIKQCLKHNCGRIQMELLKGISKNDKVLKDWTYFDLQEKIKNQAEIHRIEVIKVAPAYTSQRCSQCGYICKENRCTQAMFECKQCGYKTHADYNAAKNIATYDIENIINKQLAVQSKLHSKKCMEEYIEELGYLD

SEQ ID NO: 131 - protein, 444 aa, Unknown
  Bacillus sp. multi
MKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFIKLATQKQKSMKVILDRLINQTYSKGACMIHKYKNKWYLSITYKFNAIKENKFDKELIMGIDMGGINTVYFAFNEGFIRSNIKSDEIKTFNERIRQRRINLLKQSKYCSNSRTGKGRTKRLQPIDVLSNKIAKFRNSTNHKYANYIIKQCLKYNCGRIQMELLKGISKNDKVLNDWTYFDLQEKIKNQAEIHGIEVIKIAPAYTSQRCSQCGYICKENRCTQAMFECKQCGYKTHADYNAAKNISTYDIENIINKQLAVQSKLHSKKCMAEYMEELGYLD

SEQ ID NO: 132 - protein, 444 aa, Bacillus thuringiensis
MKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFIKLATQKQKSMKVILDRLINQTYSKGACMIHKYKNKWYLSITYKFNAIKENKFDKELIMGIDMGGINTVYFAFNEGFIRSNIKSDEIKTFNERIRQRRINLLKQSKYCSNSRTGKGRTKRLQPIDVLSNKIAKFRNSTNHKYANYIIKQCLKHNCGRIQMELLKGISKNDKVLKDWTYFDLQEKIKNQAEIHGIEVIKIAPAYTSQRCSQCGYICKENRCTQAMFECKQCGYKTHADYNAAKNISTYDIENIINKQLAVQSKLHSKKCMAEYMEELGYLD

SEQ ID NO: 133 - protein, 444 aa, Unknown
  Bacillus sp. multi
MKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 134 - protein, 451 aa, Bacillus thuringiensis
MGVTIKIMKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFIKLATQKQKSMKVILDRLINQTYSKGACMIHKYKNKWYLSITYKFNAIKENKFDKELIMGIDMGGINTVYFAFNEGFIRSNIKSDEIKTFNERIRQRRINLLKQSKYCSNSRTGKGRTKRLQPIDVLSNKIAKFRNSTNHKYANYIIKQCLKHNCGRIQMELLKGISKNDKVLKDWTYFDLQEKIKNQAEIHGIEVIKIAPAYTSQRCSQCGYICKENRCTQAMFECKQCGYKTHADYNAAKNISTYDIENIINKQLAVQSKLHSKKCMAEYMEELGYLD

SEQ ID NO: 135 - protein, 451 aa, Unknown
  Bacillus sp. multi
MGVTIKIMKYQILCPMNVDWTIFEKHLRNLTYQIRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 136 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 137 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSSRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 138 - protein, 444 aa, Unknown
  Bacillus sp. multi
MKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFIKLATQKQKSMKVILDRLINQTYSKGACMIHKYKNKWYLSITYKFNAIKENKFDKELIMGIDMGGINTVYFAFNEGFIRSNIKSDEIKTFNERIRQRRINLLKQSKYCSNSRTGKGRTKRLQPIDVLSNKIAKFRNSTNHKYANYIIKQCLKHNCGRIQMELLKGMSKNDKVLKDWTYFDLQEKIKNQAEIHGIEVIKIAPAYTSQRCSQCGYICKENRCTQAMFECKQCGYKTHADYNAAKNISTYDIENIINKQLAVQSKLHSKKCMAEYMEELGYLD

SEQ ID NO: 139 - protein, 444 aa, Unknown
  Bacillus sp. multi
MKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFIKLATQKQKSMKVILDRLMNQTYSKGACMIHKYKNKWYLSITYKFNAIKENKFDKELIMGIDMGGINTVYFAFNEGFIRSNIKSDEIKTFNERIRQRRINLLKQSKYCSNSRTGKGRTKRLQPIDVLSNKIAKFRNSTNHKYANYIIKQCLKHNCGRIQMELLKGISKNDKVLKDWTYFDLQEKIKNQAEIHGIEVIKIAPAYTSQRCSQCGYICKENRCTQAMFECKQCGYKTHADYNAAKNISTYDIENIINKQLAVQSKLHSKKCMAEYMEELGYLD

SEQ ID NO: 140 - protein, 451 aa, Unknown
  Bacillus sp. multi
MGVTIKIMKYQILCPMNVDWTIFEKQLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKVLKDWTYFDLQEKIKNQAEIYGIEVIKVVPAYTSQRCSQCGYICKENRCTQAMFECKQCGYKTHADYNAAKNISTYDIENIINKQLAVQSKLHSKKCMEEYIEELGYLD

SEQ ID NO: 141 - protein, 444 aa, Unknown
  Bacillus sp. multi
MKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKVLKDWTYFDLQEKIKNQAEIYGIEVIKVVPAYTSQRCSQCGYICKENRCTQAMFECKQCGYKTHADYNAAKNISTYDIENIINKQLAVQSKLHSKKCMEEYIEELGYLD

SEQ ID NO: 142 - protein, 441 aa, Unknown
  Bacillus sp. multi
MKYQILCPMNVDWIIFEKHLRNLTYQVRTISNRTIQQLWEFDALSFDYFKVRGTYPTVQDLYGCTQKKIDGYIYHTLQSKYPDIHKGNMSTTLQKIIKTWKSRRNEIRKGEMSIPSFRNRIPIDIHNNSVDITKEKNGDYIAGISLFSRDFHKENGDVPKGKIFVKLATQKQKSMKVILDRLINQTYSKGACMIHKYKNKWYLSITYKFNALKENKFDKELIMGIDMGGINTVYFAFNEGFIRNNIKSEEIKMFNERIRQRRINLLKQSTYCSNSRTGKGRTKRLQPIDVLSNKIAKFRNSTNHKYANYIIKQCLKHNCGRIQMELLKGISKNDKVLKDWTYFDLQEKIKNQAEIHGIEVIKVAPAYTSQRCSQCGYICKENRCTQAMFECKQCGYKTHADYNAAKNIATYDIENIINKQLAVQSKLHSKKCMEEYIEELG

SEQ ID NO: 143 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGKMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 144 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKVLKDWTYFDLQEKIKNQAEIYGIEVIKVVPAYTSQRCSQCGYICKENRCTQAMFECKQCGYKTHADYNAAKNISTYDIENIINKQLAVQSKLHSKKCMEEYIEELGYLD

SEQ ID NO: 145 - protein, 451 aa, Unknown
  Bacillus sp. multi
MGVTIKIMKYQILCPMNVDWTIFEKHLRNLTYQVRTISNRTIQQLWEFDALSFDYFKERGTYPTDQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIKMFNERIRQRRINLLKQSKYCSNSRTGKGRTKRLQPIDVLSNKIAKFQNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 146 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRMKRLQPIDVLSNKIAKFRNSTNHKYANYIVKQCLKHNCGRIQMELLKGISKNDKILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 147 - protein, 444 aa, Unknown
  Bacillus sp. multi
MKYQILCPMNVDWTIFEKHLRNLTYQVRTISNRTIQQLWEFDALSFDYFKARGTYPTVQDLYGCTQKKIDGYIYHKLQSKYPDIHKGNMSTTLQKIIKTWKSRRNEIRKGEMSIPSFRNRIPIDLHNNSVDITKEKNGDYIAGISLFSRDFHKENGDVPKGKIFVKLGTKKQKSMKVILDRLMNQTYSKGACMIHKYKNKWYLSITYKCNALKENKFDKELIMGIDMGGINTVYFAFNEGFIRNNIKSDEIKAFNERIRQRRINLLNQSKYCSNSRTGKGRTKRLQPIDVLSNKIAKFRNSTNHKYANYIIKQCLKYNCGRIQMELLKGISKNDKVLKDWTYFDLQEKIKNQAEIRGIEIIKVAPAYTSQRCSQCGYICKENRCTQAMFECKQCGYKTHADYNAAKNIATYDIENIINKQLAAQSKLHSKKCMEEYIEELGYLD

SEQ ID NO: 148 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLGTQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKVLKDWTYFDLQEKIKNQAEIYGIEVIKVVPAYTSQRCSQCGYICKENRCTQAMFECKQCGYKTHADYNTAKNISTYDIENIINKQLAVQSKLHSKKCMEEYIEELGYLD

SEQ ID NO: 149 - protein, 444 aa, Unknown
  Bacillus sp. multi
MKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGAYIAGISFFSRDFHKENGDVPKGKIFVKLSTQKQKSMKVILDRLMNQTYSKGACMIHKYKNKWYLSITYKFNAIKENKFDKELIMGIDMGGINTVYFAFNEGFIRSNIKSDEIKAFNERIRQRRINLLKQSKYCSNSRTGKGRTKRLQPIDVLSNKIAKFRNSTNHKYANYIVKQCLKHNCGRIQMELLKGISKNDKILKDWTYFDLQEKIKNQAEIHGIEVIKVAPAYTSQRCSQCGYICKENRCTQAMFECKQCGYKTHADYNAAKNISTYDIENIINKQLAVQSKLHSKKCMEEYIEELGYLD

SEQ ID NO: 150 - protein, 444 aa, Unknown
  Bacillus sp. multi
MKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENGDVPKGKIFVKLATQKQKSMKVILDRLMNQTYSKGACMIHKYKNKWYLSITYKFNALKENKFDKELIMGIDMGGINTVYFAFNKGFIRSNIKSDEIKTFNERIRQRRINLLNQSKYCSNSRTGKGRTKRLQPIDVLSNKIAKFRNSTNHKYANYIIKQCLKHNCGRIQMELLKGISKNDKVLKDWTYFDLQEKIKNQAEIHGIEVIKIAPAYTSQRCSQCGYICKENRCTQDMFECKQCGYKTHADYNAAKNISTYGIENIINKQLAVQSKLHSKKCMEEYIEKLGYLD

SEQ ID NO: 151 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGKMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIKMFNERIRQRRINLLKQSKYCSNGRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 152 - protein, 444 aa, Unknown
  Bacillus sp. multi
MKYQILCPMNVDWTIFEKHLRNLTYQVRTISNRTIQQLWEFDALSFEYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLATQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKILKDWTYFDLQEKIKNQAEIHGIEVIKVVPAYTSQRCSQCGYICKENRCTQATFECKQCGYKTHADYNAAKNLSTYDIENIINKQLAVQSKLHSKKCMEEYIEELGYLD

SEQ ID NO: 153 - protein, 451 aa, Unknown
  Bacillus sp. multi
MGVTIKIMKYQILCPMNVDWAIFEKHLRSLTYQVRTISNRTIQQLWEFDALSFDYFKETGTSPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENSDVPKGKIFVKLATQKQKSMKVILDRLINQTYSKGACMIHKYKNKWYLSITYKFNAIKENKFDKELIMGIDMGGINTVYFAFNEGFIRSNIKSDEIKTFNERIRQRRINLLKQSKYCSNSRIGKGRTKRLQPIDVLSNKIAKFRNSTNHKYANYIIKQCLKHNCGRIQMELLKGILKNDKVLKNWTYFDLQEKIKNQAKIHGIEVIKIAPAYTSQRCSQCGYICKENRCTQAMFECKQCGYKTHADYNAAKNISTYDIENIINKQLAVQSKLHSKKCMEEYIEELGYLD

SEQ ID NO: 154 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSLDFHKENGDVPKGKIFVKLGTQKQKSMKVILDRLINQTYSKGACMIHKYKNKWYLSITYKFNAIKENKFDKKLIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKVLKDWTYFDLQEKIKNQAEIYGIEVIKVVPAYTSQRCSQCGYICKENRCTQAMFECKQCGYKTHADYNAAKNISTYDIENIINKQLAVQSKLHSKKCMEEYIEELGYLD

SEQ ID NO: 155 - protein, 444 aa, Unknown
  Bacillus sp. multi
MKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENDDVPKGKIFVKLSTQKQKSMKVILDRLMNQTYSKGACMIHKYKNKWYLSITYKFNAIKENKFDKELIMGIDMGGINTVYFAFNEGFIRSNIKSDEIKIFNERIRQRRINLLKQSKYCSNSRTGKGRTKRLQPIDVLSNKIAKFRNSTNHKYANYIVKQCLKHNCGRIQMELLKGISKNDKILKDWTYFDLQEKIKNQAEIHGIEVIKIAPAYTSQRCSQCGYICKENRCTQAVFECKQCGYKTHADYNAAKNISIYDIENIINKQLAVQSKLHSKKCMEEYIEELGYLD

SEQ ID NO: 156 - protein, 444 aa, Unknown
  Bacillus sp. multi
MKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGAYIAGISFFSRDFHKENGDVPKGKIFVKLSTQKQKSMKVILDRLMNQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 157 - protein, 444 aa, Unknown
  Bacillus sp. multi
MKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIKKEKNGDYIAGISLFSRDFHKENSDVPKGKIFVKLATKKQKSMKIILDRLMNQTYSKGACMIHKYKNKWYLSITYKFNAIKENKFDKDLIMGIDMGGINTVYFAFNEGFIRSNIKSDEIKAFNERIRQRRINLLKQSKYCSNSRTGKGREKRLQPIDVLSNKIAKFRNSTNHKYANYIIKQCLKHNCGRIQMELLKGISKNDKVLKDWTYFDLQEKIQNQAEIHGIEVIKVAPAYTSQRCSQCGYICKENRCTQAVFECKQCGYKTHADYNAAKNIATYDIENIINKQLAVQSKLHSKKCMEEYIEELGYLD

SEQ ID NO: 158 - protein, 451 aa, Unknown
  Bacillus sp. multi
MGVTIKIMKYQILCPMNVDWTIFEKHLRNLTYQVRTISNRTIQQLWEFDALSFEYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLATQKQKSMKVILDRLINQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKILKDWTYFDLQEKIKNQAEIHGIEVIKVVPAYTSQRCSQCGYICKENRCTQATFECKQCGYKTHADYNAAKNLSTYDIENIINKQLAVQSKLHSKKCMEEYIEELGYLD

SEQ ID NO: 159 - protein, 444 aa, Unknown
  Bacillus sp. multi
MKYQILCPMNVDWIIFEKHLRNLTYQVRTISNRTIQQLWEFDALSFDYFKARGTYPTVQDLYGGTQKKIDGYIYHTLQSKYPDIHKGNMSTTLQKIIKTWKSRRNEIRKGEMSIPSFRNRIPIDIHNNSVDITKEKNGDYIAGISLFSRDFHKENGDVPKGKIFVKLATQKQKSMKVILDRLINQTYSKGACMIHKYKNKWYLSITYKFNALKENKFDKELIMGIDMGGINTVYFAFNEGFIRNNIKSEEIKMFNERIRQRRINLLKQSTYCSNSRTGKGRTKRLQPIDVLSNKIAKFRNSTNHKYANYIIKQCLKHNCGRIQMELLKGISKNDKILKDWTYFDLQEKIKNQAEIHGIEVIKVAPAYTSQRCSQCGYICKENRCTQAMFECKQCGYKTHADYNAAKNIATYDIENIINKQLAVQSKLHSKKCMEEYIEELGYLD

SEQ ID NO: 160 - protein, 444 aa, Bacillus thuringiensis
MKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATKKQKSMKIILDRLMNQTYSKGACMIHKYKNKWYLSITYKFNAIKENKFDKELIMGIDMGGINTIYFAFNEGFIRSNIKSDEIKTFNERIRQRRINLLNQSKYCSNSRTGKGRTKRLQPIDVLSNKIAKFRNSTNHKYANYIIKQCLKHNCGRIQMELLKGISKNDKVLKDWTYFDLQEKIKNQAEIHGIEVIKIAPAYTSQRCSQCGYICKENRCTQDMFECKQCGYKTHADYNAAKNISTYGIENIINKQLAVQSKLHSKKCMEEYIEKLGYLD

SEQ ID NO: 161 - protein, 451 aa, Unknown
  Bacillus sp. multi
MGVTIKIMKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRIPIDLHNNSVEITKEKNGDYIAGISLFSRDFHKENGDVPKGKIFLKLGTQKQKSMKVILDRLINQTYSKGACMIHKYKNKWYLSITYKFNAIKENKFDKELIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEIHGIEVIKVAPAYTSQRCSQCGYICKENRCTQAMFECKQCGYKTHADYNAAKNISTYDIENIINKQLAVQSKLHSKKCMEEYIEELGYLD

SEQ ID NO: 162 - protein, 445 aa, Unknown
  Bacillus sp. multi
MGVTIKIMKYQILCPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQAMFECKQCGYKTHADYNAAKNISTYDIENIINKQLAVQSKLHSKKCMEEYIEELGYLD

SEQ ID NO: 163 - protein, 451 aa, Unknown
  Bacillus sp. multi
MGVTIKIMKYQILCPMNVDWTIFEKHLRNLTYQVRTISNRTIQQLWEFDALSFDYFKAIGTYPTVQDLYGCTQKKIDGYIYHTLQSKYPDIHKGNMSTTLQKIIKTWKSRRNEIRKGEMSIPSFRNRIPIDLHNNSVDITKEKHGDYIAGISLFSRDFHKENNDVPKGKIFVKLATQKQKSMKVILDRLMNQTYSKGACMIYKYKNKWYLSITYKFNALKENKFDKELIMGIDMGGINTVYLAFNEGFIRSNIKSDEIKMFNERIRQRRINLLKQSKYCSNSRTGKGRTKRLQPIDVLSNKIAKFRNSTNHKYANYIIKQCLKHNCGRIQMELLKGISKNDKVLKDWTYFDLQEKIKNQAEIHGIEVIKVAPAYTSQRCSQCGYICKENRCTQAMFECKQCGYKTHADYNAAKNISTYNIENIINKQLAVQSKLHSKKCMEEYIEELGYLD

SEQ ID NO: 164 - protein, 444 aa, Unknown
  Bacillus sp. multi
MKYQILCPMNDDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIRKGEMSIPSFRNRKPIDLHNNSVDITKEKNGDYIAGISLFSRDFHKENGDVPKGKIFLKLGTQKQKSMKVILDRLINQTYSKGACMIHKYKNKWYLSITYKFNAIKENKFDKELIMGIDMGGINTVYFAFNEGFIRSNIKSDEIKAFNERIRQRRINLLKQSKYCSNSRTGKGREKRLQPIDMLSNKIAKFRNSTNHKYANYIIKQCLKHNCGRIQMELLKGISKNDKVLKDWTYFDLQEKIKNQAEIHGIEVIKVAPAYTSQRCSQCGYICKENRCTQDMFECKQCGYKTHADYNAAKNISTYNIENIINKQLAVQSKLHSKKCMEEYIEELGYLD

SEQ ID NO: 165 - protein, 451 aa, Unknown
  Bacillus sp. multi
MGVTIKIMKYQILCPMNVDWTIFEKHLRNLTYQVRTISNRTIQQLWEFDALSFDYFKARGTYPTVQDLYGCTQKKIDGYIYHTLQSKYPDIHKGNMSTTLQKIIKTWKSRRNEIGKGEMSIPSFRNRIPIDLHNNSVEITKEKNGDYIAGISLFSRDFHKENGDVPKGKIFLKLGTQKQKSMKVILDRLINQTYSKGACMIHKYKNKWYLSITYKFNAIKENKFDKELIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEIHGIEVIKVAPAYTSQRCSQCGYICKENRCTQAMFECKQCGYKTHADYNAAKNISTYDIENIINKQLAVQSKLHSKKCMEEYIEELGYLD

SEQ ID NO: 166 - protein, 444 aa, Unknown
  Bacillus sp. multi
MKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIKKEKNGDYIAGISLFSRDFHKENSDVPKGKIFVKLATKKQKSMKIILDRLMNQTYSKGACMIHKYKNKWYLSITYKFNAIKENKFDKDLIMGIDMGGINTVYFAFNEGFIRSNIKSDEIKAFNERIRQRRINLLKQSKYCSNSRMGKGREKRLQPIDVLSNKIAKFRNSTNHKYANYIIKQCLKHNCGRIQMELLKGISKNDKVLKDWTYFDLQEKIQNQAEIHGIEVIKVAPAYTSQRCSQCGYICKENRCTQAVFECKQCGYKTHADYNTAKNIATYDIENIINKQLAVQSKLHSKKCMEEYIEELGYLD

SEQ ID NO: 167 - protein, 444 aa, Unknown
  Bacillus sp. multi
MKYQILCPMNVDWTIFEKHLRNLTYQVRTISNRTIQQLWEFDALSFDYFKARGTYPTVQDLYGCTQKKIDGYIYHKLQSKYPDIHKGNMSTTLQKIIKTWKSRRNEIRKGEMSIPSFRNRIPIDLHNNSVEITKEKNGDYIAGISLFSRDFHKENGDVPKGKIFLKLGTQKQKSMKVILDRLINQTYSKGACMIHKYKNKWYLSITYKFNAIKENKFDKELIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEIHGIEVIKVAPAYTSQRCSQCGYICKENRCTQAMFECKQCGYKTHADYNAAKNISTYDIENIINKQLAVQSKLHSKKCMEEYIEELGYLD

SEQ ID NO: 168 - protein, 455 aa, Unknown
  Bacillus sp. multi
MGVTIKIMKYQILCPMNVDWIIFEKHLRNLTYQVRTISNRTIQQLWEFDALSFDYFKERGTYPTVQDLYGCTRKKIDVYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGISKNDKILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEEYIEELGYLD

SEQ ID NO: 169 - protein, 444 aa, Unknown
  Bacillus sp. multi
MKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSVPSFRNHIPIDIHNNSVDITKEKNGDYIAGISLFSRDFHKENGDVPKGKIFVKLSTQKQKSMKVILDRLMNQTYSKGACMIHKYKNKWYLSITYKFNAIKENKFDKDLIMGIDMGGINTVYFAFNEGFIRSNIKSDEIKAFNERIRQRRINLLKQSKYCSNSRTGKGREKRLQPIDVLSNKIAKFRNSTNHKYANYIIKQCLKHNCGRIHMELLKGISKNDKVLKDWTYFDLQEKIQNQAEIHGIEVIKVAPAYTSQRCSQCGYICKENRCTQAVFECKQCGYKTHADYNAAKNIATYDIENIINKQLAVQSKLHSKKCMEEYIEELGYLD

SEQ ID NO: 170 - protein, 445 aa, Unknown
  Bacillus sp. multi
MGVTIKIMKYQILFPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 171 - protein, 445 aa, Unknown
  Bacillus sp. multi
MGVTIKIMKYQILCPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 172 - protein, 451 aa, Unknown
  Bacillus sp. multi
MGVTIKIMKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFLRDFHKENGDVPKGKIFVKLSTQKQKSMKVILDRLMNQTYSKGACMIHKYKNKWYLSITYKFNAIKENKFDKELIMGIDMGGINTVYFAFNEGFIRSNIKSDEIKMFNERIRQRRINLLKQSKYCSNSRIGKGRTKRLQPIDVLSNKIAKFRNSTNHKYANYIVKQCLKHNCGRIQMELLKGISKNDKILKDWTYFDLQEKIKNQAGIHGIEVIKIAPAYTSQRCSQCGYICKENRCTQAVFECKQCGYKTHADYNAAKNISIYDIENIINKQLAVQSKLHSKKCMEEYIEELGYLD

SEQ ID NO: 173 - protein, 438 aa, Unknown
  Bacillus sp. multi
MKYQILCPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYSAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 174 - protein, 444 aa, Unknown
  Bacillus sp. multi
MKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIIKEKNGDYIAGISLFSRDFHKENGDVPKGKIFVKLSNQKQKSMKVILDRLMNQTYSKGACMIHKYKNKWYLSITYKFNAIKENKFDKELIMGIDMGGINTVYFAFNEGFIRSNIKSDEIKMFNERIRQRRINLLKQSKYCSNSRTGKGRTKRLQPIDVLSNKIAKFRNSTNHKYANYIVKQCLKHNCGRIQMELLKGIAKNDKILKDWTYFDLQEKIKNQAEIHGIEVIKIAPAYTSQRCSQCGYICKENRCTQAVFECKQCGYKTHADYNAAKNISIYDIENIINKQLAVQSKLHSKKCMEEYIEELGYLD

SEQ ID NO: 175 - protein, 445 aa, Unknown
  Bacillus sp. multi
MGVTIKIMKYQILCPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEKLGYLD

SEQ ID NO: 176 - protein, 445 aa, Bacillus
MGVTIKIMKYQILCPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYSAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEELGYLD

SEQ ID NO: 177 - protein, 444 aa, Bacillus thuringiensis
MKYQILCPMNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDIKKEKNGDYIAGISLFSRDFHKENSDVPKGKIFVKLATKKQKSMKIILDRLMNQTYSKGACMIHKYKNKWYLSITYKFNAIKENKFDKDLIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEVHGIEVIKVASAYTSQRCSQCGYICKENRCTQAVFECKQCGYKTHADYNAAKNIATYDIENIINKQLAVQSKLHSKKCMEEYIEELGYLD

SEQ ID NO: 178 - protein, 451 aa, Unknown
  Bacillus sp. multi
MGVTIKIMKYQILCPMNVDWTIFEKHLRNLTYQVRTISNRTIQQLWEFDALSFDYFKAIGTYPTVQDLYGCTQKKIDGYIYHTLQSKYPDIHKGNMSTTLQKIIKTWKSRRNEIRKGEMSIPSFRNRIPIDLHNNSVDIKKEKNGDYIAGISLFSRDFHKENSDVPKGKIFVKLATKKQKSMKIILDRLMNQTYSKGACMIHKYKNKWYLSITYKFNAIKENNFDKELIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEVHGIEVIKVASAYTSQRCSQCGYICKENRCTQAVFECKQCGYKTHADYNAAKNIATYDIENIINKQLAVQSKLHSKKCMEEYIEELGYLD

SEQ ID NO: 179 - protein, 444 aa, Unknown
  Bacillus sp. multi
MKYQILCPMNVDWTIFEKHLRNLTYQVRTISNRTIQQLWEFDALSFDYFKAIGTYPTVQDLYGCTQKKIDGYIYHTLQSKYPDIHKGNMSTTLQKIIKTWKSRRNEIRKGEMSIPSFRNRIPIDLHNNSVDIKKEKNGDYIAGISLFSRDFHKENSDVPKGKIFVKLATKKQKSMKIILDRLMNQTYSKGACMIHKYKNKWYLSITYKFNAIKENNFDKELIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEVHGIEVIKVASAYTSQRCSQCGYICKENRCTQAVFECKQCGYKTHADYNAAKNIATYDIENIINKQLAVQSKLHSKKCMEEYIEELGYLD

SEQ ID NO: 180 - protein, 444 aa, Unknown
  Bacillus sp. multi
MKYQILCPMNVDWTIFEKHLRNLTYQVRTISNRTIQQLWEFDALSFDYFKAIGTYPTVQDLYGCTQKKIDGYIYHTLQSKYPDIHKGNMSTTLQKIIKTWKSRRNEIRKGEMSIPSFRNRIPIDLHNNSVDIKKEKNGDYIAGISLFLRDFHKENSDVPKGKIFVKLATKKQKSMKIILDRLMNQTYSKGACMIHKYKNKWYLSITYKFNAIKENNFDKELIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEVHGIEVIKVASAYTSQRCSQCGYICKENRCTQAVFECKQCGYKTHADYNAAKNIATYDIENIINKQLAVQSKLHSKKCMEEYIEELGYLD

SEQ ID NO: 181 - protein, 444 aa, Unknown
  Bacillus sp. multi
MKYQILCPMNVDWTIFEKHLRNLTYQVRTISNRTIQQLWEFDALSFDYFKAIGTYPTVQDLYGCTQKKIDGYIYHILQSKYPDIHKGNMSTTLQKIIKTWKSRRNEIRKGEMSIPSFRNRIPIDLHNNSVDIKKEKNGDYIAGISLFSRDFHKENSDVPKGKIFVKLATKKQKSMKIILDRLMNQTYSKGACMIHKYKNKWYLSITYKFNAIKENNFDKELIMGIDMGGINTVYFAFNEGFIRSNIKSDEIKAFNEKIRQRRINLLKQSNYCSNSRTGKGRAKQLQPIDVLSNKIAKFRNSTNHKYANYIIKQCLKHNCGRIQIELLKGISKNDKVLKDWTYFDLQEKIKNQAEVHGIEVIKVASAYTSQRCSQCGYICKENRCTQAVFECKQCGYKTHADYNAAKNIATYDIENIINKQLAVQSKLHSKKCMEEYIEELGYLD

SEQ ID NO: 182 - protein, 437 aa, Unknown
  Bacillus sp. multi
MGVTIKIMKYQILCPLNVDWTIFEKHLRNLTYQVRTISNRTIQQLWEFDALSFDYFKERGTYPTVQDLYGCTQKKIDGYIYHTLQSKYPDIHKGNMSTTLQKIIKTWKSRRNEIRKGEMSIPSFRNRIPIDLHNNSVDITKEKNGDYIAGISLFSRDFHKENDDVPKGKIFVKLATQKQKSMKVILDRLINQTYSKGACMIHKYKNKWYLSITYKFNAIKENKFDKELIMGIDLGGINTVYSAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKNVWKSI

SEQ ID NO: 183 - protein, 448 aa, Unknown
  Bacillus sp. multi
MKYQILCPMNVDWTIFEKHLRNLTYQVRTISNRTIQQLWEFDALSFDYFKAIGTYPTVQDLYGCTQKKIDGYIYHTLQSKYPDIHKGNMSTTLQKIIKTWKSRRNEIRKGEMSIPSFRNRIPIDLHNNSVDIKKEKNGDYIAGISLFSRDFHKENSDVPKGKIFVKLATKKQKSMKIILDRLMNQTYSKGACMIHKYKNKWYLSITYKFNAIKENNFDKELIMGIDMGGINTVYFAFNEGFIRSNIKSDEIKAFNEKIRQRRINLLKQSNYCSNSRTGKGRAKRLQPIDVLSNKIAKFRNSTNHKYANYIIKQCLKHNCGRIQIELLKGISKNDKVLKDWTYFDLQEKIKNQAEVHGIEVIKVASAYTSQRCSQCGYICKENRCTQAVFECKQCGYKTHADYNAAKNIATYDIENIINKQLAVQSKLHSKKCMEEYIEEYIEELGYLD

SEQ ID NO: 184 - protein, 396 aa, Unknown
  Bacillus sp. multi
MLYPLTTLKKEGHTLLSKICMGVHRRKLMAIYHTLQSKYPDIHKGNMSTTLQKIIKTWKSRRNEIRKGEMSIPSFRNRIPIDLHNNSVDITKEKNGDYIAGISLFLRDFHKENDDVPKGKIFVKLATQKQKSMKVILDRLINQTYSKGACMIHKYKNKWYLSITYKFNAIKENKFDKELIMGIDLGGINTVYFAFNEGFIRSNIKSDEIIRQRRINLLKQSKYCSNSRTGKGRTKRLQPIDVLSNKIAKFRNSTNHKYANYIVKQCLKHNCGRIQMELLKGISKNDRILKDWTYFDLQEKIKNQAEIHGIEVIKVAPAYTSQRCSQCGYICKENRCTQATFECKQCGYKTHADYNAAKNISTYDIENIINKQLAVQSKLHSKKCMEEYIEKLGYLD

SEQ ID NO: 185 - protein, 450 aa, Unknown
  Bacillus sp. multi
MSTVVKVMKYQIVCPVNIEWKVFETYLRTLTYQVRTIGNRTIQKLWEFDNQSLNHFKENGVYPSTQQLYGCTQKTISGYIYDQLKFEYLDINKANMSTTLQKTIKTWNSRKKEIWSGEMSIPSFRNNLPIDIHGNSIQLTKEKSGDYIANLSLFSSSFIRENELSSGKILVKLSTRKQNSMKVILDRLIDGTYAKGASMLHKYKNKWYLSVTYKANAIEESKFDEDFIMGIDMGKVNVLYFAFNKGFIRGSISGEEIEAFRKKIEHRRISLLRQGKYCSENRIGKGRKKRIKPVDVLNDKVARFRNSTNHKYANYIVQQCLKYKCGCIQLENLQGISKEQTFLKNWTYFDLQEKIENQANQYGIKVVKIAPSYTSQRCSECGYIHKNNRQDQSTFECQQCNLKVHADYNAAKNISIYNIEKLIQKQLKLQEKLNSKKYTEQYKEQIENIT

SEQ ID NO: 186 - protein, 443 aa, Unknown
  Bacillus sp. multi
MKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFINENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIAPSYTSQRCSECGYIHKNNRQDQSTFECQQCSFKVHADYNAAKNISVYNIEKVIQKQLELQEKLNQTKYKEQYIEQMKNIN

SEQ ID NO: 187 - protein, 453 aa, Unknown
  Bacillus sp. multi
MTYLSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFINENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIAPSYTSQRCSECGYIHKNNRQDQSTFECQQCSFKVHADYNAAKNISVYNIEKVIQKQLELQEKLNQTKYKEQYIEQMKNIN

SEQ ID NO: 188 - protein, 450 aa, Bacillus
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFINENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIAPSYTSQRCSECGYIHKNNRQDQSTFECQQCSFKVHADYNAAKNISVYNIEKVIQKQLELQEKLNQTKYKEQYIEQMKNIN

SEQ ID NO: 189 - protein, 443 aa, Unknown
  Bacillus sp. multi
MKYQIVCPVNIEWKAFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDKDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKNNRQDQSTFECQQCSFKVHADYNAAKNISMYNIEKVIQKQLELQEKLNLTKYKEQYLEQMENIN

SEQ ID NO: 190 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKNNRQDQSTFECQQCSFKVHADYNAAKNISVYNIEKVIQKQLELQEKLNQTKYKEQYIEQMKNIN

SEQ ID NO: 191 - protein, 450 aa, Unknown
  Bacillus sp. multi
MSIAVKVMKYQIVCPVNIEWKTFEIYLRTLSYHFRTIGNRTIQKLWEYDNHSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKNNRQDQSTFECQQCSFKVHADYNAAKNISVYNIEKVIQKQLELQEKLNQTKYKEKYIEQMKNIN

SEQ ID NO: 192 - protein, 443 aa, Unknown
  Bacillus sp. multi
MKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKNNRQDQSTFECQQCSFKVHADYNAAKNISVYNIEKVIQKQLELQEKLNQTKYKEQYIEQMKNIN

SEQ ID NO: 193 - protein, 450 aa, Unknown
  Bacillus sp. multi
MSLAVKVMKYQIVCPVNVEWKVFETYLRTLSYQSRTIGNRTIQKIWEFDNLSLKHFKETGEYPSAQQLYGCTQKTISGYIYDQLKEEYKDINKANMSTTIQKTLKNWNSRKKEIWRGEMSIPSFRSDLPIDIHGNSIQLIKEKGGDYIASVSLFSSKFIKENDLPNGKILVKLSTRKQNSMKVILDRLINSTYSKGACMLHKHKKKWYLSITYKSNIKEELKFDEDLIMGIDMGKINVLYFAFNKSLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKDNRQDQSTFECLQCSFKVHADYNAAKNISVYNIEKVIQKQLELQEKLNLTKYKEHYIEQMKNIN

SEQ ID NO: 194 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGRKKRIKPIEVLNDKIAKFRNATNHKYANYIVQQCLKYNCGTIQLEDLQGISKEQTFLKNWTYFDLQEKIKNLANQYGIKVVKIDPSYTSQRCSECGYIHKNNRQNQSTFECQQCSFKVHADYNAAKNISVYNIEKVIQKQLKLQEKLNLTKYKEQYIEQMENIN

SEQ ID NO: 195 - protein, 450 aa, Bacillus thuringiensis
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGMKVVKIDPSYTSQRCSECGYIHKNNRQDQSTFECQQCSFKVHADYNAAKNISVYNIEKVIQKQLELQEKLNQTKYKEQYIEQMKNIN

SEQ ID NO: 196 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKNNRQDQSTFECQQCSFKVHADYNAAKNISVYNIEKVIQKQLELQEKLNQTKYKEKYIEQMKNIN

SEQ ID NO: 197 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKNNRQDQSTFECQQCSFKVHADYNAAKNISLYNIEKVIQKQLELQEKLNQTKYKEQYIEQMKNIN

SEQ ID NO: 198 - protein, 398 aa, Bacillus thuringiensis
MKDFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDNTYAKGACMLHKHKKKWYLSITYKSNIKEELKFDEDLIMGIDMGKINVLYFAFNKGLVRGGISGEEIEAFRKKIEHRRISLLRQGKYCSGNRIGKGRKKRIKPIEVLNDKIAKFRNATNHKYANYIVQQCLKYNCGTIQLEDLQGISKEQTFLKNWTYFDLQEKIKNQANQYGIKVVKIDPSYTSQRCSECGYIHKNNRQNQSTFECQQCSFKVHADYNAAKNISVYNIEKVIQKQLKLQEKLNLTKYKEQYIEQMENIN

SEQ ID NO: 199 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANLYGVKVMKIDPSYTSQRCSECGYIHKNNRQNQSTFECQQCSFKVHADYNAAKNISLYNIEKVIQKQLELQEKLNLTKYKEQYMEQMKNIN

SEQ ID NO: 200 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRSISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKNNRQDQSTFECQQCSFKVHADYNAAKNISLYNIEKVIQKQLELQEKLNQTKYKEQYIEQMKNIN

SEQ ID NO: 201 - protein, 450 aa, Unknown
  Bacillus sp. multi
MSTVVKVMKYQIVCPVNIEWKAFETYLRTLSYQVRTIGNRTIQKLWDFDNQSLNHFRENGVYPSAQQLYGCTQKTISGYIYDQLKEEYQDINKANMSTTLQKTIKTWNSRKKEIRSGEMSIPSFRNNLPIDIHGNSIQITKEKSGDYIASLSLFSSNFIKENNLPNGKIQVKLSTRKQNSMKVILDRIIENTYAKGACMLHKHKNKWYLSIIYKPTVKEEHNFEEDLVMGIDMGKINVLYFSFNKGWIRGAISGEEIEAFRKKIEHRRISLLRQGKYCSGNRVGKGREKRIKPIDVLNNKVAKFRNATNHKYANYIVQQCLKYNCGTIQLENLQGISKEQTFLKNWTYFDLQEKIKQQAHQYGIKVVTIDPSYTSQRCSECGYIHKNNRQSQSTFECQQCNLKVHADYNAAKNISIYNIEKVIQKQLKLQEKLNSKKFTEQYIEQIENIN

SEQ ID NO: 202 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGTISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECEYIHKNNRQDQSTFECQQCSFKVHADYNAAKNISVYNIEKVIQKQLELQEKLNQTKYKEQYIEQMKNIN

SEQ ID NO: 203 - protein, 450 aa, Unknown
  Bacillus sp. multi
MSLAVKVMKYQIVCPVNVEWKVFETYLRTLSYQSRTIGNRTIQKIWEFDNLSLKHFKETGEYSSAQQLYGCTQKTISGYIYDQLKEEYKDINKANMSTTIQKTLKNWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKNNRQDQSTFECQQCSFKVHADYNAAKNISVYNIEKVIQKQLELQEKLNQTKYKEQYIEQMKNIN

SEQ ID NO: 204 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPDGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECEYIHKNNRQDQSTFECQQCSFKVHADYNAAKNISVYNIEKVIQKQLELQEKLNQTKYKEQYIEQMKNIN

SEQ ID NO: 205 - protein, 443 aa, Unknown
  Bacillus sp. multi
MKYQIVCPVNVEWKVFETYLRTLSYQSRTIGNRTIQKIWEFDNLSLKHFKETGEYPSAQQLYGCTQKTISGYIYDQLKEEYKDINKANMSTTIQKTLKNWNSRKKEIWRGEMSIPSFRSDLPIDIHGNSIQLIKEKGGDYIASVSLFSSKFIKENDLPNGKILVKLSTRKQNSMKVILDRLINSTYSKGACMFHKHKKKWYLSITYKSNIKEELKFDEDLIMGIDMGKINVLYFTFNKGLVRGTISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKDNRQDQSTFECLQCSFKVHADYNAAKNISVHNIEKVIQKQLELQEKLNLTKYKEHYIEQMKNIN

SEQ ID NO: 206 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIHLEDLKGISKEQTFLKNWTYFDLQEKIKNQANQYGVKVVKIDPSYTSQRCSECGYIHKNNRQDQSTFECQQCSFKVHADYNAAKNISVYNIEKVIQKQLELQEKLNQTKYKEQYIEQMKNIN

SEQ ID NO: 207 - protein, 443 aa, Unknown
  Bacillus sp. multi
MKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGRKKRIKPIEVLNDKIAKFRTATNHKYANYIVQQCLKYNCGTIQLEDLQGISKEQTFLKNWTYFDLQEKIKNQANQYGIKVVKIDPSYTSQRCSECGYIHKNNRQNQSTFECQQCSFKVHADYNAAKNISVYNIEKVIQRQLKLQEKLNLTKYKEQYIEQMENIN

SEQ ID NO: 208 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGRKKRIKPIEVLNDKIAKFRTATNHKYANYIVQQCLKYNCGTIQLEDLQGISKEQTFLKNWTYFDLQEKIKNQANQYGIKVVKIDPSYTSQRCSECGYIHKNNRQNQSTFECQQCSFKVHADYNAAKNISVYNIEKVIQKQLKLQEKLNLTKYKAQYIEQMENIN

SEQ ID NO: 209 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGRKKRIKPIEVLNDKIAKFRTATNHKYANYIVQQCLKYNCGTIQLEDLQGISKEQTFLKNWTYFDLQEKIKNQANQYGIKVVKIDPSYTSQRCSECGYIHKNNRQNQSTFECQQCSFKVHADYNAAKNISVYNIEKVIQRQLKLQEKLNLTKYKEQYIEQMENIN

SEQ ID NO: 210 - protein, 450 aa, Bacillus weihenstephanensis
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECEYIHKNNRQDQSTFECQQCSFKVHADYNAAKNISVYNIEKVIQKQLELQEKLNQTKYKEQYIEQMKNIN

SEQ ID NO: 211 - protein, 450 aa, Bacillus
MSKVVKVMKYQIVCPLNIEWKVFEIYLRTLSYHFRTIGNRTIQKLWEYDNQSLKHFKDTGQYPSVQQLYGCTQKTVSGYIYDQLKEEYQDINKANMSTTLQKTIKTWNSRKKEIWSGEMSIPSFRNNLPIDVHGNSVQVTKEKSGDYIASVSLFSSKFIKENDLPNGKILVKLSTRKQNSMKVILDKIIDSTYAKGACMLHKHKNKWYLSITYKATKKEGHKFDEDLIMGIDMGKINALYFAYNKGLVRGVISGEEIEAFRKKVEYRRISLLRQGKYCSENRIGKGRKKRIKPIEVLNDKIAKFRNATNHKYANYIVQQCLKYNCGTIQLEDLKGISKEQTFLKNWTYFDLQEKIKNQANQYGVKVVKIDPSYTSQRCSECGYIHKNNRQDQSTFECQQCSFKAHADYNAAKNISIYNIEKVIQKQLELQEKLNLTKYKEQYIEQMENIN

SEQ ID NO: 212 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGQGRKKRIKPIEVLNDKIAKFRTATNHKYANYIVQQCLKYNCGTIQLEDLQGISKEQTFLKNWTYFDLQEKIKNQANQYGIKVVKIDPSYTSQRCSECGYIHKNNRQNQSTFECQQCSFKVHADYNAAKNISVYNIEKVIQRQLKLQEKLNLTKYKEQYIEQMENIN

SEQ ID NO: 213 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGNYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECEYIHKNNRQDQSTFECQQCSFKVHADYNAAKNISVYNIEKVIQKQLELQEKLNQTKYKEQYIEQMKNIN

SEQ ID NO: 214 - protein, 443 aa, Unknown
  Bacillus sp. multi
MKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGRKKRIKPIEVLNDKIAKFRTATNHKYANYIVQQCLKFNCGTIQLEDLQGISKEQTFLKNWTYFDLQEKIKNQANQYGIKVVKIDPSYTSQRCSECGCIHKNNRQNQSTFECQQCSFKVHADYNAAKNISVYNIEKVIQKQLKLQEKLNLTKYKEQYIEQMENIN

SEQ ID NO: 215 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGTISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSKRCSECEYIHKNNRQDQSTFECQQCSFKVHADYNAAKNISVYNIEKVIQKQLELQEKLNQTKYKEQYIEQMKNIN

SEQ ID NO: 216 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLANGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECEYIHKNNRQDQSTFECQQCSFKVHADYNAAKNISVYNIEKVIQKQLELQEKLNQTKYKEQYIEQMKNIN

SEQ ID NO: 217 - protein, 452 aa, Unknown
  Bacillus sp. multi
MYLSKVVKVMKYQIVCPVNIEWKAFEIYLRTLSYHFRTIGNRTIQKLWEYDNHSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIANVSLFSSKFIKENDLPNGKILVKLSTRKQNSMKVILDRIIDSTYAKGACMLHKHKNKWYLSITYKATIKEEHKFDEELIMGIDMGKINVLYFAYNKGSVRGAISGEEIEAFRKKTEYRRISLLRQGKHCSENRIGKGRKKRIKPIDVLNDKVAKFRNATNHKYANYIVQQCLKYNCGTIQLEDLQGISKEQTFLKNWTYFDLQEKIKNQANQYGVKVVKIDPCYTSQRCSECGYIHKNNRQDQSTFECQQCSFKVHADYNAAKNISVYNIEKVIKKQLELQEKLNLTKYKEQYIEQMENIN

SEQ ID NO: 218 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDNVAKFRNATNHKYANYIVQQCLKYNCGTIQLEDLKGISKEQTFLKNWTYFDLQEKIKNQANQYGVKVVKIDPSYTSQRCSECGYIHKNNRQDQSTFECQHCSFKVHADYNAAKNISLYNIEKVIQKQLELQEKLNQTKYKEQYIEQMKNIN

SEQ ID NO: 219 - protein, 452 aa, Unknown
  Bacillus sp. multi
MYLSKVVKVMKYQIVCPVNIEWKAFEIYLRTLSYHFRTIGNKTIQKLWEYDNHSLKHFKDTGQYPSAQQLYGCTQKTISGYIYDQLKEEYQDINKANMSTTLQKTIKTWNSRKKEIWSGEMSIPSFRNNLPIDIHGNSIQIIKEKSGDYIANVSLFSSKFIKENDLPNGKILVKLSTRKQNSMKVILDRIIDSTYAKGACMLHKHKNKWYLSITYKATIKEEHKFDEELIMGIDMGKINVLYFAYNKGLVRGAISGEEIEAFRKKTEYRRISLLRQGKYCSENRIGKGRKKRIKPIDVLNDKVAKFRNATNHKYANYIVQQCLKYNCGTIQLEDLQGISKEQTFLKNWTHFDLQEKIKNQANQYGVKVVKIDPSYTSQRCSECGYIHKNNRQDQSTFECQQCSFKVHADYNAAKNISVYNIEKVIQKQLELQEKLNLTKYKEQYIEQMENIN

SEQ ID NO: 220 - protein, 450 aa, Unknown
  Bacillus sp. multi
MSTVVKVMKYQIVCPLNLDWKMFEKYLRTLSYQVRTIGNRTIQKLWDFDNQSLNHFRENGVYPSAKQLYGCTQKTISGYIYDQLKEEYQDINKANMSTTLQKTIKTWNSRKKEIRSGDMSIPSFRNNLPIDIHGNSIQITKEKSGDYIASLSLFSSNFIKENNLPNGKIQVKLSTRKQNSMKVILDRIIENTYAKGACILHKHKNKWYLSIIYKPIVKEEHKFEEDLVMGIDMGKINVLYFAFNKGWIRGAISGEEIEAFRKKIEHRRISLLRQGKYCSGNRVGKGREKRIKPINVLNNKVAKFRNATNHKYANYIVQQCLKYNCGTIQLENLQGISKEQTFLKNWTYFDLQEKIKQQAHQYGIKVVTIDPSYTSQRCSECGYIHKNNRQSQSTFECQRCNLKVHADYNAAKNISIYNIEKVIQKQLKLQEKLNSKKFTEQYIEQIENIN

SEQ ID NO: 221 - protein, 329 aa, Unknown
  Bacillus sp. multi
MSVLIKTYLHGYHSILYNKRKTSYEVGRGKPMSNQQLVNLRIDFAFKQLFGTSGNEDILIAFLNAILQDSLESPIVSLQLEDPHLHREHEEDKLSILDISATLDTGTKVNVEIQLNNNHDMIKRSLYYWGRLYTSQLQKGMPYSSLHKTITINLLNFVMFPEYEAFHTTGILWNQQQQKKLSDDIEVHMVEIPKLMQQWRNEQVNPWEDSFVRWLLLLPANEDEQLTQTLEDIAMNQDPILQKAINKWERMSQDSSFRQAYEAREKALMDEAAKFAYAEQKGIEKGIEKGIEQGKIQLIRGMHKNGMPIKDIAKFTNLSIEEIQEILEL

SEQ ID NO: 222 - protein, 331 aa, Unknown
  Bacillus sp. multi
MYGSKQALMSTDIRACLHMDHSFMYNERKTSYEMGRGKPMSNQQLVNLRIDFAFKQLFGTSGNEDILIAFLNAMLQDSLESPIASLQLEDPHLHREHEEDKLSILDISATLDTGTKVNVEIQLNNNHDMIKRSLYYWGRLYTSQLQKGMPYSSLHKTITINLLNFVIFPEYEAFHTTGILWNQQQQTILSSDIEVHIVEIPKLMQQWRNEQVNPWEDSFVRWLLLLPANEDEQLTQTLEDIAMNQDPILQKAMNKWERMSQDSSFRQAYEAREKALMDEAAKFAHARNEGIQEGKIQMIKGMHELGVPIETIAKASKLSIEEVQHILSRNS

SEQ ID NO: 223 - protein, 331 aa, Bacillus thuringiensis
MYGSKQALMSTDIRACLHMDHSFMYNERKTSYEMGRGKPMSNQQLVNLRIDFAFKQLFGTSGNEDILIAFLNAMLQDSLESPIASLQLEDPHLHREHEEDKLSILDISATLDTGTKVNVEIQLNNNHDMIKRSLYYWGRLYTSQLQKGMPYSSLHKTITINLLNFVIFPEYEAFHTTGILWNQQQQTILSSDIEVHIVEIPKLMQQWRNEQVNPWEDSFVRWLLLLPANEDEQLTQTLEDIAMNQDPILQKAMNKWERMSQDSSFRQAYEAREKALMDEAAKFAHARNEGIQEGKIQMIKGMYELGVPIETIAKASKLSIEEVELILKGNS

SEQ ID NO: 224 - protein, 506 aa, Bacillus megaterium
MSTPLQQPHQKSKKTSQMITTRKFKLAIVSDNRNEAYSFIRNEIRNQNKALNAAYNHLYFEHIATEKLKHSDEEYQKHLTKYREVSTNKYQDYLKVKEKVNASKDDEKLQKRVDKAREAYNKAQEKVYKIEKEFNKKSMETYQKVVGLSKQTRIGKLLKSQFTLHYDTEDRITSTVLSHFNNDMKTGVLRGDRSLRTYKNSHPLLVRARSMKVYEENGDYFIKWVKGIVFKIVISAGSKQKANIGELKSVLINILNGHYKVCDSSISLNKDLILNLSLNIPVSKENVFVPGRVVGVDLGLKIPAYVSLNDTPYIKKGIGNIDDFLNVRTQLQNQRKRLQKTLECTSGGKGRSKKLKGLDRLKAKEKNFVNTYNHFLSKKIIQFAVKNNAGVIHLEELQFDKLKNKSLLRNWSYYQLQTMIEYKAEREGIEVKYVDASYTSQTCSKCGHYEKGQRVLQDTFTCKNKECKGYAHKVNADFNASQNIAKSTDIIRCTEMAKNNDIEKNA

SEQ ID NO: 225 - protein, 496 aa, Unknown
  Bacillus sp. multi
MILTRKVKLVIVSDNRDEGYKLIRNEIREQHKALNLAYNHLYFEHNAIQILKQNDEDYKQKRNKLQELINKKYEEHQKAKNLERKEALREAYNNKKQELYKFERECNEEARKAYQQVVGFTQQTRVRNLINREYNLMSDTKDGITSKVTQDYKNDCKAGLLIGKRSLRNYKKDNPLLVRGRSLKFYKEDGDYFIKWNKGTVFKCILHIRKKNVAELQSVLENVLLGAYKICDSSIGFNNKDMILNLSLNIPDKETYDYIPGRVVGVDLGLKIPAYVSLSDKVYVRKGIGGIDDFLRVRTQMQKRRRQLQESLAAVKGGKGREKKLKALDHLKGKEANFAKTYNHFLSTQIVTFAVKNQAGQINMEFLEFDKMKNKSLLRNWSYYQLQMMVEYKAKREGIIIKYVDAYLTSQTCSKCDYYEEGQREKQEKFICKSCAFEVNADYNASQNIAKSARYISDSTEREYHKKKQEDLKEILGENDIINEQLSLFDNHDDIA

SEQ ID NO: 226 - protein, 496 aa, Unknown
  Bacillus sp. multi
MILTRKVKLVIVSDNRDEGYKLIRNEIREQHKALNLAYTRLYFEHNAIQILKQNDEDYKQKRNKLQQLINKKYEEHQKAKNLEKKEALREAYNKKKQELYNFEKEYNEKARQAYQQVVGFTQQTRVRNLISRECNLMSDTKDGITSKVTQDYKNDCKAGLLAGKRSLRNYKKDNPLLVRGRSLKFYKEDGDYFIKWNKGTIFKCILHIRKKNVAELQSVLENVLLDIYKVCDSSIAFNNRDMILNLTLNIPNKETQDYIPGRVVGVDLGLKIPAYVSLSDKVYVRKGIGSIDDFLRVRTQMQKRRRRFQESLAAVKGGKGREKKLKALDHLKGKEANFAKTYNHFLSTQIVTFAVKNQAGQINMEFLEFDKMKNKSLLRNWSYYQLQMMVEYKAKREGIIIKYVDAYLTSQTCSKCDHYEEGQRETQERFMCKSCGFEVNADYNASQNIAKSTKHISDSVESEYYKKKQEALKEILRENDTINEQLSLLDNCDDIA

SEQ ID NO: 227 - protein, 496 aa, Unknown
  Bacillus sp. multi
MILTRKVKLVIVSDNRDEGYKLIRNEIREQHKALNLAYTRLYFEHNAIQILKQNDEDYKQKRNKLQQLINKKYEEHQKAKNLEKKEALREAYNKKKQELYNFEKEYDEKARQAYQQVVGFTQQTRVRNLISRECNLMSDTKDGITSKVTQDYKNDCKAGLLAGKRSLRNYKKDNPLLVRGRSLKFYKEDGDYFIKWNKGTIFKCILHIRKKNVAELQSVLENVLLDIYKVCDSSIAFNNRDMILNLTLNIPNKETQDYIPGRVVGVDLGLKIPAYVSLSDKVYVRKGIGSIDDFLRVRTQMQKRRRRFQESLAAVKGGKGREKKLKALDHLKGKEANFAKTYNHFLSTQIVTFAVKNQAGQINMEFLEFDKMKNKSLLRNWSYYQLQMMVEYKAKREGIIIKYVDAYLTSQTCSKCDHYEEGQRETQERFMCKSCGFEVNADYNASQNIAKSTKHISDSVESEYYKKKQEALKEILRENDTINEQLSLLDNCDDIA

SEQ ID NO: 228 - protein, 351 aa, Unknown
  Paenibacillus thiaminolyticus (multi)
MGTETDEHHTVHHRHDTSYRFLLSSKKLFVELLRSFVQKEWVERIDETNVQEIPHSFVLQDFKRKEADLVYRVKLNGQDVVFYLLLEMQSKVDFLMPYRLLLYQVEIWRYLMKDQEKAKGKPKTFRLPPIVPIVLYNGKRRWTASRQFRQLLANETMFGSELLNFEYVLIDVARYTEEELLALSNTIGSVFLLDQTADQTELLNRLGKLMHTIQQLPEDSQQQLVAWMANILSQKLPENEPQLRELIQNVKGGVSVMGLEKTLDAIKREGRREGRREGLREGLREGLREGILEGKQEGKREGILEGKQEGKREAKEEVVKQMIAENLDPDLIARVTGFPLDIITQLREKSH

SEQ ID NO: 229 - protein, 347 aa, Unknown
  Paenibacillus thiaminolyticus (multi)
MGTETDEHHTVHHRHDTSYRFLLSSKKLFVELLRSFVQKEWVERIDETNVQEIPHSFVLQDFKRKEADLVYRVKLNGQDVVFYLLLEMQSKVDFLMPYRLLLYQVEIWRYLMKDQEKAKGKPKTFRLPPIVPIVLYNGKRRWTASRQFRQLLANETMFGSELLNFEYVLIDVARYTEEELLALSNTIGSVFLLDQTADQTELLNRLGKLMHTIQQLPEDSQQQLVAWMANILSQKLPENEPQLRVLIQNVKGGVSVMGLEKTLDAIKREGRREGRREGLRQGLQEGIREGKREGIREGVLEGKQEGKREAKEEVAKQMISENLDPELIARVTGFSLDIIAQLREKSK

SEQ ID NO: 230 - protein, 339 aa, Unknown
  Paenibacillus sp. multi
MGTETDEHHTVHHRHDTSYRFLLSSKKLFVELLRSFVQKEWVERIDETNVQEIPHSFVLQDFKRKEADLVYRVKLNGQDIVFYLLLEMQSKVDFLMPYRLLLYQVEIWRYLMKDQEKAKGKPKTFRLPPIVPIVLYNGKRRWTASRQFRQLLANETMFGSELLNFEYVLIDVARYTEEELLALSNTIGSVFLLDQTADQTELLNRLGQLMHTIQQLPEDSQQQLIAWMANILSQKLPENEPQLRELIQNVKGGVSVMGLEKTLDAIKREGRREGRREGLREGIREGKQEGIREGKQEGKREAKEEVVKHMISENLDPELIARVTGFSLDIIAQLREKTK

SEQ ID NO: 231 - protein, 351 aa, Unknown
  Paenibacillus lentimorbus (multi)
MGTETDEHHTVHHRHDTSYRFLLSSKKLFVELLRYFVQKEWVERIDETNVQEIPHSFVLQDFKRKEADLVYRVKLNGQDVVFYLLLEMQSKVDFLMPYRLLLYQVEIWRYLMKDQEQAKGKPKTFRLPPIVPIVLYNGKRRWTANRQFRQLLANETMFGSELLNFEYVLIDVARYTEEELLALSNTIGSVFLLDQTADQAELLNRLGKLMHTIQQLPEDSQQQLVAWMANILSQKLPENEPQLRELIQNVKGGVSVMGLEKTLDAIKREGRREGRREGLREGLREGLREGILEGKQEGKREGLLEGKQEGKREAKEEVVKQMIAENLDPDLIARVTGFPLDIITQLREKSH

SEQ ID NO: 232 - protein, 325 aa, Unknown
  Paenibacillus thiaminolyticus (multi)
MGTETEEHNTVHHRHDTSYRFLLSSKKLFVELLRSFVQKEWVKRIDETNVQEIPHSFVLQDFKRKEADLVYRVKLNGQDVVFYLLLEMQSTVDFLMPYRLLLYQVEIWRYLMKDQEKTKGKPKAFRLPPIVPIVLYNGKRRWTANRQFRQLLANETMFGSELLNFEYVLIDVARYTEEELLALSNTIGSVFLLDQTEDQTELLNRLGKLMHTIQQMPEDSQQQLVAWMANILSQKLPENEPHLRELIQNEKGGVSVMGLEKTLDAIKREGRREGRREGKQEGKREAKEEVVQQMIAENLDPELIARITGFSLDIIAQLREKSKSK

SEQ ID NO: 233 - protein, 339 aa, Unknown
  Paenibacillus thiaminolyticus (multi)
MGTETDEHCTVHHRHDTSYRFLLSSKKLFVELLRSFVQKEWVERIDETNVQEIPHSFVLQDFRRKEADLVYRVKLNGQDVVFYLLLEMQSKVDFLMPYRLLLYQVEIWRYLMKDQEKANGKPKTFRLPPIVPIVLYNGKRRWTASRQFRQLLANETMFGSELLNFEYVLIDVARYTEEELLALSNTIGSVFLLDQTADQAELLDRLGKLMHTIQQLPEDSQQQLVAWMANILSQKLPENEPQLRELIQNVKGGVSVMGLEKTLDAIKREGRREGRREGLRQGLQEGIREGKREGLLEGKREAIEEVAKQMISENLDPELIARVTGFSLEIITQLREKSH

SEQ ID NO: 234 - protein, 347 aa, Unknown
  Paenibacillus thiaminolyticus (multi)
MGTETDEHHTVHHRHDTSYRFLLSSKKLFVELLRSFVQKEWVERIDETNVQEIPHSFVLQDFKRKEADLVYRVKVNGQDVVFYLLLEMQSKVDFLMPYRLLLYQVEIWRYLMKDQEKAKGKPKTFRLPPIVPIVLYNGKRRWTASRQFRQLLANETMFGSELLNFEYVLIDVARYTEEELLALSNTIGSVFLLDQTADQAELLDRLGKLMHTIQQLPEDSQQQLIAWMANILSQKLPENEPQLRELIQNVKGGVSVMGLEKTLDAIKREGRREGRREGLRQGLQEGIREGIREGIREGLLEGKQEGKREAKEEVAKQMISENLDPELIARVTGFSLDIIAQLREKSN

SEQ ID NO: 235 - protein, 351 aa, Paenibacillus terrae
MGTETDEHHTVHHRHDTSYRFLLSSKKLFVELLRSFVQKEWVERIDETNVQEIPHSFVLQDFKRKEADLVYRVKLNGQDVVFYLLLEMQSKVDFLMPYRLLLYQVEIWRYLMKDQEKAKGKPKTFRLPPIVPIVLYNGKRRWTASRQFRQLLANETMFGSELLNFEYVLIDVARYTEEELLALSNTIGSVFLLDQTADQAELLDRLGKLMHTIQQLPEDSQQQLVAWMANILSQKLPENEPQLHELIQNVKGGVSVMGLEKTLDAIKREGRREGRREGLRQGLQEGIREGIREGIREGKREGLLEGKQEGKREAKEEVAKQMISENLDPELIARVTGFSLDIIAQLREKSK

SEQ ID NO: 236 - protein, 313 aa, Unknown
  Paenibacillus thiaminolyticus (multi)
MGKESDEHNTIHYRHDTSYRFLLSSKKLFVELLRSFVQKEWVERIDETNVQEIPHSFVLQDFKRKEADLVYRVKLNGQDVVFYLLLEMQSKVDFLMPYRLLLYQVEIWRYLMKDQETVKGKPKTFRLPPIVPIVLYNGKRRWTASRQFRQLLANETMFGSELLNFEYVLIDVARYTEEELLALSNTIGSVFLLDQTADQTELLNRLGKLMHTIQQLPEDSQQQLVAWMANILSQKLPENEPQLRELIQNVKGGVSVMGLEKTLDAIKREGRREGKREAKEEVVKQMLAEDLEPELIARVTGFSLEMITQLREQ

SEQ ID NO: 237 - protein, 432 aa, Unknown
  Paenibacillus thiaminolyticus (multi)
MKHKLKQKQNQRITRITDSTLVVGADIAKKIHVARAVDFRGIELGKDCVFPNDQQGLTKLTTWMKELGQAHSKTDIVFGIEPTGHYWFPLAAYLHAQGIQIVVVNPHHVNKSKELEDNSQTKSDYKDAKVIADLIRNGKYSEPKLPTKEYADLRILMNLREKVSASLTQVKGRIGHWFDRFFPEYSTVCKDWDGKTSLMTMRSFPLPSDIVSKSAREVLAHWKTEVKRGVGIKRAEKLVAAAAASIGLTEGSAAARIELSTLLGQFELFREQLEGIMKEVTQILENIPGAEHMLSVPGVGTVTVAGFLAEVGDLSNYDHGQQIIRLAGLNLKENSSGKRKGKTGISKRGRSRLRALLFRAVMPMVAKNEAFKTLHKHYTNRSQNPLKKKQSLIALCGKLIRVLHTLGTKQRAYNADEMLGPVRQSQMQLEAA

SEQ ID NO: 238 - protein, 478 aa, Unknown
  Bacillus sp. multi
MIITRKIKLIIVGEERDNQYKFIREERYKQNKALNVAINHLYFLHVAKEKIRLLDHKFVQDEQKLQETIDKLYDEKRKQKDEKKKDTIEQKIEKKRNKLKELRSKGNKEAAKTLQDAIKINFTTTTREIINKQFDLMSDTKDRITQKVTQDFSIDLKNGLLSGERSLRTYKKNNPLFIRGRTLYFYQEGKSILIKWCKGIVFKCILGRHQNNSHELWTILKKVLEQSYKVCDSSISVGKDFILNLSLDIGESDNRTAFVEGRVLGVDLGMKVPAYMSINDKPYIRKALGSLEDFLKIRVQMQKRRKNLHKTLVSVKGGKGRERKVKALDRFKEKEQNFATTYNHFLSHNIVKFAKKHRSGQINMEFLALAGEDKDKILRNWSYYQLQEFIEYKANQEGIKVKYVDPYRTSQTCSKCGSYEPGQRESQEKFICKVCKLEINADYNASQNIAHSTKYMTNKQQSEYFKRLQQTTKLEKYS

SEQ ID NO: 239 - protein, 474 aa, Unknown
  Bacillus sp. multi
MIIARKIKLIIIGENRDTQYKFIREERYKQNKALNVAMNHLYFLHVAKEKIRLLDKKFLQDEKKLQEGINKLYAEKKKVIKDEKKRNELEKKIQKQTNELKKLRSKGNKEADKILQEAIKINLSSTTREVISKQFDLISDTKDRITQKVYQDFKSDLKNGLLSGERVLRTYKKNNPLLIRGRALNFYREGKDVMIKWFGGIIFKCMLGQHKNNAQELKATLNKVLEGSYKVCDSSISVGKELILNISLDIGEVDSNVSCKKGRVLGVDLGMKVPAYMSINDKPYIRKSLGSLDDFLKIRVQMQKRRRNLHKTLVSVKGGKGREKKLQALDRLKEKEKNFATTYNHFLSYNIVKFAKDNLAEQINMEFLALAGEDKNIILRNWSYYQLQQFVEYKAKREGIDVKYVDPYRTSQMCSKCGNYEPGQRESQEKFICKSCHLEINADYNASQNIAHSTKYITNKNQSEYFKKLQHTIE

SEQ ID NO: 240 - protein, 396 aa, Unknown
  Streptomyces sp. multi
MAAIWAGIDAGKTHHHCVAIDESGRRLLSRRVANDEPELLELLTDVLALGDEVTWGIDLADGGAALAIAILLNHDQPVNYISGRAIHRASESYRGEGKTDAKDAAVIADQVRIRRDLNPLRTGDETVTDLKILTGRRMDLVADRTRTINRLRAQLSGIFPGLERALDLTNKGPLTLLTGYQTSAAIRRLGTKRLETWLRNRKVLRADQLAETAVAAAERQHTSLPGEKLTAQMVHTLAKEVMVLTEQVAEVDKLIEARFRDHRHFDVITSMPGLGIILGAEFLAATGGDMTIFDTPDRLAAFGGVAPVPRDSGKISGNLRRPQRYNRRLQRVFYTSALFSIRKCEESRRFYDRKRAEGKRHTQAVLALARRRVNVLWALLRDGRAYELTPPTALAA

SEQ ID NO: 241 - protein, 376 aa, Unknown
  Bacillus sp. multi
MRVQEVILENGKRYILVDSDGVPVIPVVKYLKYLDVTGKSSNTQKTYCYALKQYFLYLQETEKDYKHIRLEDLVEFVGWLRNPYESTKVMSLRPVQTKKTERTVNLTVTAVTNFYDYLYRNEELPLDMEEKLIRQVFTGGRTRYKSFLHHVNKDKPSMRNVLKIKEPRKRVQTLTIEQVEQVLAATTNIRDTFLIRLLFETGLRIGEALSLFLEDFKFSHQKGHRIRLTDRGELENSAKLKTGEREIFVSQELMDLYDDYMYDVVDELDFETNFVFVKLRGKNRGKPMTYGDVEALFKRLRQKIGLNIHPHLFRHTHATMYYQETKDIKQVQERLGHSQIQTTMNLYLHPSDEDTRKVWEKAQGAFQIKQQNGGKE

SEQ ID NO: 242 - protein, 1005 aa, Unknown
  Bacillus sp. multi
MPSIEDTAYPRLKSNPSQKELQELYSPTIEEIHWMKPHVKGDVAKLGVFVLLKTFQRLGYFLPVTEIPEDIVIHIAQKMNLTLVSRNDLQKYHNSGTQKRHHALIREYRNIHFFNDQARKIMIDTMNQVSSTKDDSADFINAAIDELIRQRFELPTFSTLNETAKRLRSQSYHVVYEQVYQSINENDKNKIDSLFQTNDGTVYTPWHHLKQDAKNPTIKHFRELVTQMEWLMAQKVNTTILKSIPSVKIRQMTSEAKTLDAARMKKMEPKKRYALALSFIQSQLAHVLDNIGEMMVKRMMSARNKSRDQLQHYQMKNQKRTDLLITTLYDVILAYRSGNESQDKMEAIEQVVGNRHEEILHDCESHLAYSGDNYFVFVWDYYKSSRSTLFKILNTVSLRSTNQDQGLEDAIAFLKTHQNSRKESLSIVSIEKKGYWKKEIKPLLDLSWIPDAWWRWIAPNRKSGCYPEEVNRRHFEACVFTQIMWGLKSGDLYIEGSEKYADYRQQLISWNEYEQKLLDFCHKSNLPSTGKEYVKQLRKRFMKIAKKTDASFPYNKQVRIENGEIVIGKSKKRKPSPKLKSLEKYMTQNLVPINVLDMLGDTEHWLNWTRFFKPISKHEARLEDPIERYLTTVFCYGCNLGPVQTARSLGNMDRRQISWVNQRHITTENLDQAIQFIINSYNKFGLPKYWGDGKSASADGTIWALYEQNLLSERHIRYGGYGGIGYYHVSDNYIALFSHFIPCGVWEGLYILDVLMNNNSEIQPEVIHSDTQGQSATIFGLSTLMGIELMPRIRNWKDLKMFRPDKESRFKHIDDIFTDEIDWDLIEIHYKDMLRVAMSIEVGKITPSTILNKLGTYSKKNKLYQAFRELGRVIRTMFLLKYIADEQLRRTIQTATNKSESFNGFTKWLFFGGEGIITENNRENQRKVIKFNHLVANCLIFYNVFALTQVLHAYRQDGNELDEEVLSELSPYITAHVNRFGKYGIDPNRQPPDLQFDMPIYQVAN

SEQ ID NO: 243 - protein, 487 aa, Unknown
  Bacillus sp. multi
MITSRKIRLSIVSDNSTEAYNFIRKEMREQNKALNVAMNHLYFNYVARQKISFADKAYQHKLNKAIEAQQKSFILLKELEQKQIVETDSSKKSILKERLIKSKTTYEKTKEKLSSLRKARNKELFQEYNNMIGQLEETHLRDIVSSQFNLLSDTKDRLTKIAYQDFKNDITEVLSGDRSLRTYKKNNPLYIRGRTLNLFKESEEFFIKWTKKIVFKCVLGVKYQNKTELYKTLECILTGEYTLCDSSMNFNQQNKLILNLALNIPEKSENRKVPGRIAGIDLGLKIPAYFAVNDVPYIRKALGKIEDFLKVRTNIQSQKRSLQRALQSSKGGKGRKKKLKALDQFKEKEKNYIITYNHFISKKIISLAVQYGVEQINLELLTLKETQKKSLLRNWSYYQLQQFIEYKANREEISIKYVDPFHTSQTCSKCGHYEDGQREKQDTFCCKSCGFIDNADYNAARNIAASTRYITNKEESEYYRKNNNEIA

SEQ ID NO: 244 - protein, 487 aa, Unknown
  Bacillus sp. multi
MITSRKIRLSIVSDNSTEAYNFIRKEMREQNKALNVAMNHLYFNYVARQKISFADKAYQQKLNKAIEAQQNSFILLKELEQKQIAETDSSKKSILKERLIKSKTTYEKTKEKLSSLRKARNKELFQEYNNMIGQLEETHLRDIVSSQFNLLSDTKDRLTKIAYQDFKNDITEVLSGDRSLRTYKKNNPLYIRGRTLNLFKESEEFFIKWTKKIVFKCVLGVKYQNKTELYKTLECILTGEYTLCDSSMNFNQQNKLILNLALNIPEKSENRKVPGRIAGIDLGLKIPAYFAVNDVPYIRKALGKIEDFLKVRTNIQSQKRSLQRALQSSKGGKGRKKKLKALDQFKEKEKNYITTYNHFISKKIISLAVQYGVEQINLELLTLKETQKKSLLRNWSYYQLQQFIEYKANREEISIKYVDPFHTSQTCSKCGHYEDGQREKQDTFCCKSCGFIDNADYNAARNIAASTRYITNKEEGEYCRKNNNEIA

SEQ ID NO: 245 - protein, 486 aa, Unknown
  Bacillus sp. multi
MITSRKIRLSIVSDNAAEAYNFIRKEMREQNKALNVAMSHLYFNSIARQKILLADEAYQQKLKDAINSQEKSFNTLKELERKQCIEGDSEKKQTLKERLIKTQNAYEKSKEKVSNLRKSRSKDSFQEYNNIIGQVEQTHLRDVISSQFNLHSDTKDRLTMIANQDFKNDIGEVLSGNCSLRTYKKNNPLYIRGRNTVLYKEGNEFFIKWIKGIVLKCILGVKNQNKTELYKTLECVLAGVYKICDSSMNFNQQNKLILNLALNMPDKSENKKVPGRIAGIDLGLKIPAYFSVNDAPYIRKGIGKIEDFLKVRTSIQSQKRSLERALQSSKGGKGRKKKLKALNQFKEKEKSYVTTYNHFISKKIISLAIQYGVERINLELLTLKETQKKSLLRNWSYYQLQQFIEYKANREGILIKYVDPFHTSQTCSKCGHYEDGQREKQDNFHCKSCGFKENADYNAARNIAKSTNYITKKEESEYYKRNNEIA

SEQ ID NO: 246 - protein, 612 aa, Unknown
  Lysinibacillus sp. multi
MLAYFPRPYENETIYSIAARYARHMGILSKRNVLKDLFEIVNPTSSEDYTFHIYTLVNKIRHFSNEYTDEYFLNKHTVSPLYSPFIKDSSGNPSRSLDNFIKGKKRYMWDIPEKENLFYCSECVEEDLEKYGECYWNRIFQIPGIMICGKHERPLSKSQLNIHRNPLNKFIMPNQEVAVDIKIDNEIFEQLLEITRNVEYFFTNKVDTFNYQELYEKYFEFIKIASIAIPLSHLKKKLGELIISRFNEKTLDFLNSNPRKNDWLSYLSVERIKHIHPIRHVLLMMSLALSVERFINIVPKYQPFGSGAWICMNSLSEHYLEKVVTNVNITFNKDIGNFQGEFKCSCGFTYVLYNGENNPCNISKFSPRVKEKGHIWRKEFDELVSRGASIKEIALKTNYSTGTVRKIIKQGHNYHENEKKRRQQNLEERRIIREKNDKMDWNGIRRKYPNSSRTELMYENKALYNRLLRYDREWLIENSPTSQRGAVKTSDDINHKRDVLYLKVAQDMLENWSEYEKQAGKIIKKTQFTLYTRLGMKTRNNDKYPLTVAFISTFIESNEDYQIRLINQCIENHFINSEIKRYRILEYSGLRYLHPKAEKYLEVIINENNKRN

SEQ ID NO: 247 - DNA, 374 bp, Unknown
  Bacillus sp. multi
attaacataagatgtatttagatatttgatacactgtcgtttcaaagtactcaccgtgtttagtattattagatcgtaacgcaatgaaattaacataagatgtatttaaatattcctcccttgaggtcaatcaaagtgaatttaacgtttaacattaacataagatgtatttaaattatctacgtattcttgatatcttcctaaattaaaacgtttaacattaacataagatgtatttaaatatttcaacggtgttatcatcaatttctctttcttcagtttagtactaacataagatgtatttaaattcggtttggcatgggtcatgcacacgctgaaaattcgtttaaaactaacataagatatatttacat

SEQ ID NO: 248 - DNA, 414 bp, Unknown
  Bacillus sp. multi
taacataagatgtatttaaattggtacaatagaccaagacattaagtaaaataataagtttgtactaacataagatgtatttaaatggtgtcattttaccatttaaggataagttccctaaaagtttagtactaacacaagatgtatttaaatgagtctagtcagtaactcagtagtttgtccctcgtgtttaacattaacataagatgtatttaaataattgagcttaatcctaacgatgataaggtctttgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaat

SEQ ID NO: 249 - DNA, 427 bp, Unknown
  Bacillus sp. multi
gtttaacactaacataagatgtatttaaattatcccatgttaaaagcttttagggtaagcaaacaatttaacactaacataagatgtatttaaatatgtagaattgatatgttaaacgaattgttctaaagtttaacactagcataagatgtatttaaatgagtacctatgaggtagctaatgccccccccctcattgtttagtactaacataagatgtatttaaatatttcaacggtgttatcatcaatttccctttcttcagtttagtactaacacaagatgtatttaaatgtgataaagttaagagctttagctctttctggatcaggtttaaaactaacataagatgtatttaaattcatggattattgcaacaagaatttaacaaaagattagtttagcactaacataagatgtatttgaac

SEQ ID NO: 250 - DNA, 551 bp, Unknown
  Bacillus sp. multi
agtactaacataagatgtattaaatattctgaggtgttctgtgattaatttagacatgtatgttcagtactaacataagatgtatttaaatctttggccgttgaaccaattaaaaacccgattaaagtttagtactaacataagatgtatttaaattggggagagtgcgcaaagtgtttttgtagattaatttgtttaacactaacacaagatgtatttaaatactccttaaattcctttcgctacgctctagtaaccacctaacttgtgattgtttaacagtagcataagatgtatttaaattactaatggtaaaacaaaacatagctttaatgcatgatttgacactaacataagatgtatttaaatttttatgctcatcgcataattcaagatgaaaaggcggtttaataccaacataagatgtatttaaattcggtttggcatgagccatacagaagctgaaaagaatataagatgtatttaaatactagcctatcttaaagtattactaccctctatatcagtttaagactaacataagatatatt

SEQ ID NO: 251 - DNA, 353 bp, Unknown
  Bacillus sp. multi
tactaacataagatgtatttaaattggtacaatagacctagacattaagtaaaataataagtttgtactaacataagatgtatttaaatgcaggggttcgctaacggtacacctgatatagaaggtttagtactaacataagatgtatttaaatggtgtcattttaccatttaaggataagttccctaaaagtttagtactaacacaagatgtatttaaatgagtctagtcagtaactcagtagtttgtccctcgtgtttaacattaacataagatgtatttaaatcgtttaatgtgtaatttttatatcaaagaaggactttgtttactataaacataaggggtatttaaat

SEQ ID NO: 252 - DNA, 356 bp, Unknown
  Bacillus sp. multi
gttaaaacataacaatagatgtattgaaattcgatataatccaagcaatcacctattgtcatatcgttaaaacataacaatagatgtattgaaattttatagtagccttggcctcaaatgcaacaaatcggttaaaacataacaatagatgtattgaaatctaaaaagattaagtggtgtaattgtaaacttcttagttaaaacataataatagatgtattgaaatgtttgagcagcagttgctttcatcacctgtttcttgttaaaacataacaatagatgtattgaaatatgcattctttatgtgcagcctggtattttcctgagttaaaacaaaacgatagatatttaggaat

SEQ ID NO: 253 - DNA, 326 bp, Unknown
  Bacillus sp. multi
gataaaacataacaatagatgtattgaaatgcgtcctctttttatataaaaggaggaacctggtaggtaaaacataataatagatgtattgaaatcataacggttggtttatagtctccaaaacgataacctgttaaaacataacaatagatgtattgaaatatctccgcctactcttattgatgaaatatatttaagttaaaacataacaatagaagcgctaatcccgaaacctcctaaacgttaaaacataacaatagatgtattgaaatcagcttgccggcacgaaagagcgttctctacactagttagaacaaaacaataga

SEQ ID NO: 254 - DNA, 155 bp, Unknown
  Bacillus sp. multi
ataacaatagatgtattgaaatgggtttattcttgtctttcttcgccctgatcacaatagtttaaatataacaatagatgtattgaaatgtcttataagtcctcgtaatacttaacgatctactggttaaaacagaacaataaatgttttgaaat

SEQ ID NO: 255 - DNA, 521 bp, Unknown
  Bacillus sp. multi
tagcatttggtttatttaaattaggtcttttgtcttggtgattctctacactacgactagttaatgttagcatttggtgtatttaaattagatattttatatcattaaaaagattcattgttggcttagctttaacattggatgcatttgaattagctctattgcaaataatttagattgaaattttcgtttaacattaatataagatgtatttaaatcctcaaaagaatcttattttaaaaaatccatagcgtttaacatcaacataagatgtatttaaattcgtgtatgtaatcaccatcaatatcccgatattcgtttaccattagcataagatgtatttaaatgagtacctatgaggtagctaatgccctccctcattgtttagtactaacataagatgtatttaaattcggtttggcatggttcatgcacacgccgaaaattcgtttaaaactaacataagatatatttacatatgtttacaaaagttattaaactaagttaagaatgtatactaa

SEQ ID NO: 256 - DNA, 617 bp, Bacillus megaterium
gtcacaccctacatgggtgtaaggattgaaatatggcatcggatgtatttacacctagttcagtaatgtcacaccctacatgggtgtaaggattgaaattggatccgcccactcataaagatcttggcttatagtcacaccctacatgggtgtgaggattgaaattctccccctttttttcgtacagaaattggcgaaggggcacattctacatgaatgtaaggattgaaattaatacaacatttacttataacgacatcggcacagtcacatcttacatggatgtgaggattgaaattgttcgtggcttttggtacatcctacgagacttagtcacattctacatagatgtgaggattgaaattgttggtccatacttttcaagataagggattactgtcacaccctacatgggtgtgaggattgaaatcaccaataaaacataaatcataaccattacttacatcacatcctacatagatgtgaagattgaaataatatgtagatgaacctaattatgcggctatcttgtcacatcctacatgggtgtgtggattgaaattatctatttttgtccatatggcattttaatgcatggtcacatcctacaaggatgt

SEQ ID NO: 257 - DNA, 223 bp, Unknown
  Bacillus sp. multi
tttgatatcaactatgtagaatgtaaattttctacaaaatgaaatttttataatcaatcttcatcatttgatatcaactatgtggaatgtaaattgaaacgaggattaagcgtattacagaaaaaagtttgtttaatatcaactatatggaatgtaaatcctaagggtttgtgttttctcttctcagattctatgtttgatatcaattatgtggaatgtaaat

SEQ ID NO: 258 - DNA, 1825 bp, Unknown
  Paenibacillus thiaminolyticus (multi)
ttatgtatctacgcatccgcgtaggatgcgacatctcccgattcggcttgttcggacgtccgtcagatttcaatccacgcatccgcgtaggttgcgacatcgactctctcccagcctagcggcttgttgaatgatttcaatccacgcatccgcgtaggatgcgactgctggtagtccggcgtcgtcgtgacatctgtttatttcaatccacgcatccgcgtaggatgcgaccttcgtttctatcaagtatggcagatcattacgatttcaatccacgcatccgcgtaggatgcgacgtttccgttttttcttcccatccactatgacggatttcaatccacgcatccgcgtaggatgcgaccataataacattgcgagccataaccctacttatttaatttcaatccacgcatccgcgtaggatgcgacattgagccgacgccggccgatccaactgtcggcgtagatttcaatccacgcatccgcgtaggatgcgactcatagaccgtcatagttgttccgtccttcagtgtatttcaatccacgcatccgcgtaggatgcgaccgtcggtaacatagacctcttccagcggctccaacatttcaatccacgcatccgcgtaggatgcgacagtccccatatacgacgacgtatgcacgcttacatttcaatccacgcatccgcgtaggatgcgacgtatacagaaagtgcgctgcagctcgcacctcctatttcaatccacgcatccgcgtaggatgcgacgtgagaatgtctataccgggacaggtcaagataatttcaatccacgcatccgcgtaggatgcgaccgccacctgaatcagacttttttggcgttaacgaatttcaatccacgcatccgcgtaggatgcgacggtatacagggataactaagacctttagagatatttcaatccacgcatccgcgtaggatgcgacaatcataaagacttgcaaatcacacttccaattgatttcaatccacgcatccgcgtaggatgcgaccaagttgaattaagacaagggacaatactgaataatttcaatccacgcatccgcgtaggatgcgactaattcctcgcctaaagtgcctttcattgcagataatttcaatccacgcatccgcgtaggatgcgacttgtatggttctgatgaatattggccttctccgtatttcaatccacgcatccgcgtaggatgcgactttccgaacactgacgacgtcaccattctggtaggtatttcaatccacgcatccgcgtaggatgcgacgaaaggccctaagtcctcccgcgcgataaattccaaatttcaatccacgcatccgcgtaggatgcgacgggctcgccttgacggccgtgcagttggaccgcgcgacatttcaatccacgcatccgcgtaggatgcgaccagagcggcaatatgttcgctcggcacagggaaacatttcaatccacgcatccgcgtaggatgcgacgcatacgacaggacagccgtattgcgacactgacatttcaatccacgcatccgcgtaggatgcgaccgggcatgacgggcggtctgctatacttcgcgcaatttcaatccacgcatccgcgtaggatgcgactataagctggagacgaaagatccaatgtacatcggatttcaatccacgcatccgcgtaggatgcgactcgatcttcttcttctcttcttcggtgtatctcatttcaatccacgcatccgcgtaggatgcgacgacggtgtaggaatgacaataaaaatctataacatttcaatccacgcatccgcgtaggatgcgac

SEQ ID NO: 259 - DNA, 434 bp, Unknown
  Paenibacillus thiaminolyticus (multi)
gtttcaatccaggcatctgcataggatgcgacaatacgaaaagaacgttgtagcaacgtttactaaatttcaatccacgtatccgcgtaggatgcgacactcgtattctcttgtcttgtacctttaattttcataatttcaatccacgcatccgcgtaggatgcgactgacaacgccagaatccgagtcaatgccgattattatttcaatccacgcatccgcgtaggatgcgacgatatacgacaagattttaacgtttgaagtaaatatttcaatccacgcatccgcgtaggatgcgaccattcatgagggtttcaagctcgcccatcgcctgcgatttcaatccacgcatccgcgtaggatgcgacatagtcctttgtttgcggtctatacgtgagttccatttcaatccacgcatccgcgtaggatgcgac

SEQ ID NO: 260 - DNA, 625 bp, Unknown
  Paenibacillus thiaminolyticus (multi)
aaatgtatccgggcatccgcgtaggatgcgaccgtcgcctggacgaacccgcatcactcaaatcacatttcaatccacgcatccgtgtaggatgcgacgatgtgtgccgcgttgaaccggcccacatagacatttcaatccacgcatccgcgtaggatgcgacatggtcaacctcgataaagcgtactcatcaagaatttcaatccacgcatccgtgtaggatgcgacgctaacactcggagggcgttgcattccggtgttgaatttcaatccacgcatccgcgtaggatgcgacatttcgaggccgacgcggatgcctccgtaattaaatttcaatccacgcatccgcgtaggatgcgacttccggaacctcttcggctggcttgcgtatatatatttcaatccacgcatccgcgtaggatgcgactgttggatacgggagattccggtgtccgacagtaatttcaatccacgcatccgcgtaagatgcgacaaacgctcggcatactcttcgacaaagacatacggatttcaatccacgcatccgcgtaagatgcgacgctttgcttcggtcagttgggctgcaggcgttgatttcaatccacgcatccgcgtaagatgcgac

SEQ ID NO: 261 - DNA, 166 bp, Unknown
  Paenibacillus thiaminolyticus (multi)
atttcaatccacgcatccacgtaggatgcgacaaatgagagatataactatgtggtgtcctcgatgcatttcaatccacgcatccacgtaggatgcgacgcgaggacatcgtactcatcgagaatggcgtgagtatttcaatccacgcatccacgtaggatgcgac

SEQ ID NO: 262 - DNA, 563 bp, Unknown
  Paenibacillus thiaminolyticus (multi)
acctcaatccacgcatccgcgtaggatgcgactatcgacttgccgcggcctttccacttcttcgagcgatttcaatccacgcatccgcgtagggcgcgacgcatttcactcatacacggagacgattccatgagtgatttcaatccacgcatccgcgtaggatgcgacaaaagatcgttattgtcgcgggcggaggtaaggcatttcaatccacgcatccgcgtaggatgcgactaaagggacgtcagacaagtcaaaaagtcagacaatttcaatccacgcatccgcgtaggatgcgacgcatcaccggatccggtgtgataggggagtcctatttcaatccacgcatccgcgtaggatgcgaccttcccactaaagggggatcttgaacctcttgcatttcaatccacgcatccgcgtaggatgcgacgcgtcatgccctctaaaatcaattggatcatcttcatttcaatccacgcatccgcgtaggatgcgacttcaattatcaggcggaacttgtcctccagcttaatttcaatccacgcatccgcgtaggatgcgac

SEQ ID NO: 263 - DNA, 890 bp, Unknown
  Paenibacillus thiaminolyticus (multi)
agatcaatccacgcatccgcataggatgcgacacgctacgggcgagccggtgccgccgacagatgatatttcaatccacgcatccgcataggatgcgactcttcgaggttgaaatggatgggaagccctaccgatttcaatccacgcatccgcataggatgcgacttccaagtaataacgcggcagaaggtattaggaatttcaatccacgcatccgcataggatgcgaccacggcagcgtgggggctattttaattgaggggatttcaatccacgcatccgcataggatgcgaccatagtacgacattaaactggagggatatgagttatttcaatccacgcatccgcataggatgcgacatttaaatatgtcgcccccttgggggcgtggactatttcaatccacgcatccgcataggatgcgactcgttatgcaacggaataatccaccaaaagtattatttcaatccacgcatccgcataggatgcgacgagtaggacaacattgcatgtttccgagatgcgaatttcaatccacgcatccgcataggatgcgacgccacggtagcattgcaagacgtgctgcacgtcatttcaatccacgcatccgcataggatgcgacgatttggttacggccggaaccgcgctagttgacaatttcaatccacgcatccgcataggatgcgacttggcatgtcactctttgcgcagcactataggcaatttcaatccacgcatccgcataggatgcgactccaaggcttatcataatcggatcaacttgagttgatttcaatccacgcatccgcataggatgcgacttgccgatccaatctcgaaaaacgttttaaacacgatttcaatccacgcatccgcataggatgcgac

SEQ ID NO: 264 - DNA, 300 bp, Unknown
  Paenibacillus thiaminolyticus (multi)
aatttcaatccacgcatccacataggatgcgacaagcatgtgagaatggggtagccaatcagcttaaatttcaatccacgcatccacataggatgcgacgcctttccaactaatcgtaagtgggttcccatccaatttcaatccacgcatccacataggatgcgacacgatgacatagatagattcatcgccgaggtgagcaatttcaatccacgcatccacataggatgcgacctacagcaaacgcgagaatcagccagtagctggaatttcaatccacgcatccacataggatgcgac

SEQ ID NO: 265 - DNA, 151 bp, Unknown
  Bacillus sp. multi
tataaacactatgtagaatgtaaattatcacatgattctagccctttttcaatgtaatcttgttttataaacactatgtagaatgtgaatgttagcacttgtaatttagttctaaaacggctgcaagttctataaacactatgtagaatgt

SEQ ID NO: 266 - DNA, 260 bp, Unknown
  Bacillus sp. multi
gttttaaatgaactatgtagaatgtgaataatatagctgaattcttgtgcataactcgaaattatgttttaaatgaactatgtagaatgtgaattttggtgaaaacatcaatgaaatagaattagagcgtgttttaaatgaactatgcagaatgtgaatcactgagccaataaccaagcatttgagacttgcaacgttttaaatgaactatgtagaatgtgaatgttcttgtttgcgttcatcttcatcaagttttcgcg

SEQ ID NO: 267 - DNA, 519 bp, Unknown
  Streptomyces sp. multi
ggggtcatccccgcgtacgcggggagcagacggtcggggtgcggacgtcatcacgctccccggggtcatccccgcgtgcgcggggagcagcggcggtgcgtcgatgatcatgacgtcgtagtcggggtcatccccgcgtacgcggggagcagcaagagtcgtgcacggtgtagcggttcgcgtcggggtcatccccgcgtacgcggggagcaggggtcaccggggaacttgaggctcttggtctcggggtcatccccgcgtacgcggggagcaggtccgccccgtctgcggttgtctgccctcacgggggtcatccccgcgtacgcggggagcagcggggcggcccggacgaggagaccggccccctgagggtcatccccgcgtacgcggggagcagcgagcatcgctgcgcgacgatcatcgcctgcaggggtcatccccgcgtacgcggggagcagaggactgcggcgaggaatgcgagcagcgcgagggggtcatccccgcgtacgcggggagcag

SEQ ID NO: 268 - DNA, 206 bp, Unknown
  Streptomyces sp. multi
gctccccgcgcacgcggggatgaccccttggcattgactcagggggtggggctcaagaatggctccccgcgcacgcggggatgaccccgactcctcgtccatgtcggccgtcacgccgagctgctccccgcgcacgcggggatgaaccctgcgggactggggtagcccaggtgccgggtcactgctccccgcgcggggatgacccc

SEQ ID NO: 269 - DNA, 480 bp, Unknown
  Bacillus sp. multi
ctatagtccccgaagaaccaacattatgatatggtaacaagaagaatatgagtacaatcattacgctatagttccaaaagaaccatcgttatgatatggtcacatccgacttcgaatggaatgcaatgtggctatagttccaaaagaaccatcgctatgatatggtgtaacagcaagtgcaatatctgcatgggaggctatagttccaaaagaaccatcgctatgatatggtgtcaagcagcaaaaaagtaacagcctctgaactatagttccaaaagaaataatgctatgctatgattcataattttttaagtggtgttagtaattcgctatagttccatagaaacatcgttatgatatggtctgattcctagtcagaaaaccgagtctcctactatagttccaaaagaaccatcgctatggtatggtctattcttttgtcctttgatatacaccgaggctatagttccataaaaatat

SEQ ID NO: 270 - DNA, 882 bp, Unknown
  Bacillus sp. multi
tctatgattcctaagaaaagtcgttatacttatgcaatgtttgagaaaaatgtaatgtctttgacaaacttacgctataactccaaagaaaacatcgtatgctatgataatcaagtttcctatgctgttgtttcatgctgctatagttccataagaaatatcgctatgctaggatctttactacttaatgcagttagtaagtttggctatagttccataaaaaatatcgctatgctatgattgtatctagactcttattacaaggtcgttggctatagttccataagaaatattaatgctatgattataatcatttttgcgtatattgtgtcgtcagctatagttccataagaaacatcgctatgctatgattatacctcttgaaaagtatgatctcgtgttactatagttccataaaaaatatcgctatgctatgatctgataatcccagcatgtagtcaacagatagctatagttccctaagaaccatcgctatgctatgattagtaaatcaacaattagtcgtgtatgtcagctatagttccaaaagaaacattgctatgctatgatcacgccattatgttctgtgaaggtcagcgagctatagttccataagaaagattgctatgctatgatccttatcccaatctgttacacgtggtatttgctatagttccataaggaaaatcgctatgctatgatttaaaaggtttttagaaaaataatgaagggctatagttccaaaagaaacattgctatgctatgatcgaacgattgacaatttggcggctgatatcgctatagttccaagagaaaaattgctatgctatgattgcttgatgattataaagacacattgaatggctatagttccaaaagaac

SEQ ID NO: 271 - DNA, 485 bp, Unknown
  Bacillus sp. multi
atgtaaatatatcttatgttagtcttaaactgatatagagggtagtaatactttaagataggctagtatttaaatacatcttatattcttttcagcttctgtatggctcatgccaaaccgaatttaaatacatcttatgttggtattaaaccgccttttcatcttgaattatgcgatgagcataaaaatttaaatacatcttatgttagtgtcaaatcatgcattaaagctatgttttgttttaccattagtaatttaaatacatcttatgctactgttaaacaatcacaagttaggtggttactagagcgtagcgaaaggaatttaaggagtatttaaatacatcttgtgttagtgttaaacaaattaatctacaaaaacactttgcgcactctccccaatttaaatacatcttatgttagtactgaacatacatgtctaaattaatcacagaacacctcagaatatttaatacatcttatatt

SEQ ID NO: 272 - DNA, 215 bp, Unknown
  Bacillus sp. multi
ttttaaatacaatatgtattgttagaattcgcttctgctaataattgattcacttcaaatgttcgttttaaatacaatatgtattgctagaatggctgccaaacgaggctatcatggaaaaacgctcgtattttaaatacaatatgtattgttagaatagatataatgacacgttttcttataaatgaaaaatgtcacaaatacactgtgtatta

SEQ ID NO: 273 - DNA, 367 bp, Unknown
  Bacillus sp. multi
ttttaaatctaatatgtatggttagaatttccccttttctacaaaatggttgttaatatcgttcgttttaaatctaatatgtatcgttagaatactctttaatattgaaacaaatcaaacgattattaagttttaaatctaatatgtatcgttagaattccataaaatctttgatgcttattttctcagttgcgttttagatctaacatgtatcgttagaatttccaataaacgtaagggtcaatttattatttcatcgtgttttagatctaatatgtatggttagagtataatagtcgaaaagatttttaaaatgtaatttatatgtttgatccagtataaaatttatttaaaatcaacttaattt

SEQ ID NO: 274 - DNA, 142 bp, Unknown
  Lysinibacillus sp. multi
aggttacaactttattattctttttgaatctcacattcaggaaaaaattgtaattctaggttacaactttattattaataaagctagcgtgtaacctatataatgcgcttttttggggtattcaggttacaactttattatt

SEQ ID NO: 275 - protein, 476 aa, Unknown
  Bacillus sp. multi
MSVSVSDELQLFAQEIQSFLSPNTLRDLARDVGFVQRTSKYQAKDLVALCIWMSQNIATTSLAQLSSCLESSTEVLISPEGLNQRFNTSAVQFLQHILTNLLNKKLTSSMPLSSPYTSVFKRIRILDSTAFQLPDIFSTIYPGAGGCSHTAGMKIQLEYDLLSGQFLHIHTGPGKQHDRTYGSLCVPTVTPNDLCIRDLGYFHLKDLQHIQDKKAYYISRIKSNTRIYQKNLTPDYFQDGRIKKGTEYIQIDMEVLMNSLQPGQTYEISDAYVGMTDKVPTRVIVHRLTDEQQQKRLQDQAVREKKKGIKYSPRSKRLSGINVYMTNTSTDTVPMGQVHDWYSLRWQIEILFKTWKSFFHIHHCKKIKRERLECHLYGQLIAILLCSSTMFQMRQLLLMKKKRELSEYKAIYMIRDYFFLIYQAIQKDTQELSKILIRLFNLLQQNGRKSHRYEKKTVFDILGVVYNSTISEDQAA

SEQ ID NO: 276 - protein, 275 aa, Unknown
  Streptomyces sp. multi
MSERRRYPSDLSDASWQLVEPVLAAWRCERRGRGLDIGRPPDHDLRSLLDAVLYVNRTGIPWRYLPHDYPHWNTVYAYFARWQEEDIFDQLNTLLRRQEGREEEPTACVIDSQSIKTSTNVPAREQGIDAGKKIVGHKRNIVIDTVGLLRTVLVTAASVQDSIAGQTLIDRIAADHPTVRKTWVDGGYRQYLVEHAATLGIDMHIVRRDPTTRGFTVLPRRWTVERTLGWLMNHRRLARDYEAHSRCSEAMIHLAMINLMTRRPTAECTPTWRGA

SEQ ID NO: 277 - protein, 443 aa, Unknown
  Bacillus sp. multi
MKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECEYIHKNNRQDQSTFECQQCSFKVHADYNAAKNISVYNIEKVIQKQLELQEKLNQTKYKEQYIEQMKNIN

SEQ ID NO: 278 - protein, 453 aa, Unknown
  Bacillus sp. multi
MTYLSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECEYIHKNNRQDQSTFECQQCSFKVHADYNAAKNISVYNIEKVIQKQLELQEKLNQTKYKEQYIEQMKNIN

SEQ ID NO: 279 - protein, 270 aa, Unknown
  Bacillus sp. multi
MKVILDRIIDSTYAKGACMLHKHKKKWYLSITYKSNIKEELKFDEDLIMGIDMGKINVLYFAFNKGLVRGGISGEEIEAFRKKIEHRRISLLRQGKYCSGNRIGKGRKKRIKPIEVLNDKIAKFRNATNHKYANYIVQQCLKYNCGTIQLEDLQGISKEQTFLKNWTYFDLQEKIKNQANQYGIKVVKIDPSYTSQRCSECGYIHKNNRQNQSTFECQQCSFKVHADYNAAKNISVYNIEKVIQKQLKLQEKLNLTKYKEQYIEQMENIN

SEQ ID NO: 280 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCIQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFDEDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKNNRQDQSTFECQQCSFKVHADYNAAKNISVYNIEKVIQKQLELQEKLNQTKYKEQYIEQMKNIN

SEQ ID NO: 281 - protein, 100 aa, Unknown
  Bacillus sp. multi
MQEKIKNQANQYGVKVVKIDPSYTSQRCSECGFIHKNNRQDQSTFECQQCSFKVHADYNAAKNISVYNIEKVIQKQLELQEKLNQTKYKEQYIEQMKNIN

SEQ ID NO: 282 - protein, 443 aa, Unknown
  Bacillus sp. multi
MKYQIVCPVNVEWKVFETYLRTLSYQSRTIGNRTIQKIWEFDNLSLKHFKETGEYPSAQQLYGCTQKTISGYIYDQLKEEYKDINKANMSTTIQKTLKNWNSRKKEIWRGEMSIPSFRSDLPIDIHGNSIQLIKEKGGDYIASVSLFSSKFIKENDLPNGKILVKLSTRKQNSMKVILDRLINSTYSKGACMLHKHKKKWYLSITYKSNIKEELKFDEDLIMGIDMGKINVLYFAFNKSLVRGAISGEEIEAFRKKIEHRRISLLRQGKYCSGNRIGKGREKRIKPIDVLNDKVAKFRNATNHKYANYIVQQCLKYNCGTIQLEDLKGISKEQTFLKNWTYFDLQEKIKNQANQYGVKVVKIDPSYTSQRCSECGYIHKDNRQDQSTFECLQCSFKVHADYNAAKNISVYNIEKVIQKQLELQEKLNLTKYKEHYIEQMKNIN

SEQ ID NO: 283 - protein, 450 aa, Unknown
  Bacillus sp. multi
MSIAVKVMKYQIVCPVNIEWKTFEIYLRTLSYHFRTIGNRTIQKLWEYDNQSLKHFKDTGQYPSAQQLYGCTQKTISGYIYDQLKEEYQDINKANMSTTLQKTIRTWNSRKKEIWSGEMSIPSFRNNLPIDIHGNSIQIIKEKSGDYIASVSLFSSKFIKENDLPNGKILVKLSTRKQNSMKVILDRIIDSTYAKGACMLHKHKKKWYLSITYKSNIKEELKFYQDLIMGIDMGKINVLYFAFNKGLVRGAISGEEIEAFRKKIEHRRISLLRQGKYCSGNRIGKGREKRIKPIDVLNDKVAKFRNATNHKYANYIVQQCLKYHCSTIQLEDLKGISKEQTLLKNWTYFDLQEKIKNQANQYGVKVVKIDPSYTSQRCSECGYIHKNNRQDQSTFECQQCSFKVHADYNAAKNISVYNIEKVIQKQLELQEKLNQTKYKEQYIEQMKNIN

SEQ ID NO: 284 - protein, 197 aa, Unknown
  Paenibacillus thiaminolyticus (multi)
MGKRRWTASRQFRQLLANETMFGSELLNFEYVLIDVARYSEEELLALSNTIGSVFLLDQTADQAELLDRLGKLMHTIQQLPEDSQQQLVAWMANILSQKLPENEPQLRELIQNVKGGVSVMGLEKTLDAIKREGRREGRREGLRQGLQEGIREGKQEGKREAKKEVVKQMIAEDLDPELIARVTGFSLEMITQLREQ

SEQ ID NO: 285 - protein, 228 aa, Unknown
  Paenibacillus lentimorbus (multi)
MPYRLLLYQVEIWRYLMKDQEKTKGKPKTFRLPPIVPIVLYNGKRRWTASRQFRQLLANETMFGSELLNFEYVLIDVARYTEEEPLALSNTIGSVFLLDQTVDQAELLDRLGKLMHTIQQLPEDSQQQLVAWMANILSHKLPENEPQLRDLIQNVKGGVSVMGLEKTLDAIKREGRREGRREGKQEGKREAKEEVVKQMIAEDLDPELIARVTGFPLDIITQLKKQSH

SEQ ID NO: 286 - protein, 200 aa, Unknown
  Paenibacillus thiaminolyticus (multi)
MRDQENAKGKPKTFRLPPIVPIVLYNGKRRWTASRQFRQLLANETMFGSELLNFEYVLIDVARYTEEELLALSNTIGSVFLLDQTADQTELLNRLGKLMHTIQQLPEESQQQLVAWMANILSQKLPENEPQLRELIQNVKGGVSVMGLEKTLDAIKREGKREAKEEVVKQMIAEDLDPELIARVTGFPVDIIAKLREQSH

SEQ ID NO: 287 - protein, 149 aa, Unknown
  Stenotrophomonas sp. multi
MASPRLRYGRYSRTGNVYSLTTTTHGREPFFSDAGNVAVLVDALRFVERSGISHSLAWVVMPDHLHWLMELQKGTLAQCMALLKSRSSRQLNRISGRKGPLWQHGYHDHAVRTDESLHDNAMYILGNPVRAGLAGGLGDYPHAWCRWPL

SEQ ID NO: 288 - DNA, 1356 bp, Unknown; identical to SEQ ID NO: 4
  Bacillus sp. multi

SEQ ID NO: 289 - DNA, 1356 bp, Unknown; identical to SEQ ID NO: 4
  Bacillus sp. multi

SEQ ID NO: 290 - DNA, 1356 bp, Unknown; identical to SEQ ID NO: 4
  Bacillus sp. multi

SEQ ID NO: 291 - DNA, 1356 bp, Unknown; identical to SEQ ID NO: 4
  Bacillus sp. multi

SEQ ID NO: 292 - DNA, 1356 bp, Unknown; identical to SEQ ID NO: 6
  Bacillus sp. multi

SEQ ID NO: 293 - DNA, 1356 bp, Unknown; identical to SEQ ID NO: 6
  Bacillus sp. multi

SEQ ID NO: 294 - DNA, 1356 bp, Unknown; identical to SEQ ID NO: 6
  Bacillus sp. multi

SEQ ID NO: 295 - DNA, 1356 bp, Unknown; identical to SEQ ID NO: 7
  Bacillus sp. multi

SEQ ID NO: 296 - DNA, 1356 bp, Unknown; identical to SEQ ID NO: 7
  Bacillus sp. multi

SEQ ID NO: 297 - DNA, 1356 bp, Unknown; identical to SEQ ID NO: 7
  Bacillus sp. multi

SEQ ID NO: 298 - DNA, 1356 bp, Unknown; identical to SEQ ID NO: 7
  Bacillus sp. multi

SEQ ID NO: 299 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaaccattcaacaattatgggagtttgatgctttatcctttgactactttaaagcaagagggacataccctactgtccaagatttgtatgggtgtacacagaagaaaattgacggttatatataccatacattacaaagtaaatatccagatatacataaaggaaacatgtctaccactcttcaaaaaattataaaaacgtggaagagtagaagaaatgaaattagaaaaggtgaaatgtcaattccttcttttcgaaatcgcataccaattgatctccataataattcagtagacataacaaaagagaagaatggagattatattgctggtatatctcttttttcacgagattttcataaggaaaatgacgatgtcccaaaagggaagatttttataaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttattttgcgtttaatgaagggtttattcgtagcaatattaaaagtgatgaaattaaaacgtttaatgaaagaattcgacagagacgtatcaatttactgaaacaaagtaaatattgtagtaatagtagaactggaaaaggtaggacgaaacgattacagccaatagacgtgttaagtaataaaatagctaaatttagaaatagcactaatcataaatatgcaaactatataataaaacagtgtctaaaacataattgtgggcgtattcaaatggaacttttaaaaggcatatcaaaaaacgataaggttcttaaagattggacttattttgacttgcaggagaagatcaaaaatcaagcagagattcatggaattgaagttattaaaattgccccagcatatacaagtcaacgctgtagtcaatgcggatatatttgtaaagaaaatcgttgtacacaagctatgtttgaatgtaagcagtgtggatataaaacacatgctgattataatgcagcgaaaaacatttctacttatgacatcgaaaatattataaacaaacaattagcggtacaaagcaaattgcattcaaaaaaatgtatggcagagtatatggaagagttaggatacctggattaa

SEQ ID NO: 300 - DNA, 1335 bp, Unknown; identical to SEQ ID NO: 9
  Bacillus sp. multi

SEQ ID NO: 301 - DNA, 1335 bp, Bacillus thuringiensis; identical to SEQ ID NO: 9

SEQ ID NO: 302 - DNA, 1335 bp, Bacillus thuringiensis; identical to SEQ ID NO: 9

SEQ ID NO: 303 - DNA, 1356 bp, Unknown; identical to SEQ ID NO: 11
  Bacillus sp. multi

SEQ ID NO: 304 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 305 - DNA, 1356 bp, Unknown; identical to SEQ ID NO: 13
  Bacillus sp. multi

SEQ ID NO: 306 - DNA, 1356 bp, Unknown; identical to SEQ ID NO: 304
  Bacillus sp. multi

SEQ ID NO: 307 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgccttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 308 - DNA, 1356 bp, Unknown; identical to SEQ ID NO: 307
  Bacillus sp. multi

SEQ ID NO: 309 - DNA, 1356 bp, Unknown; identical to SEQ ID NO: 13
  Bacillus sp. multi

SEQ ID NO: 310 - DNA, 1356 bp, Unknown; identical to SEQ ID NO: 13
  Bacillus sp. multi

SEQ ID NO: 311 - DNA, 1356 bp, Unknown; identical to SEQ ID NO: 304
  Bacillus sp. multi

SEQ ID NO: 312 - DNA, 1356 bp, Unknown; identical to SEQ ID NO: 304
  Bacillus sp. multi

SEQ ID NO: 313 - DNA, 1356 bp, Unknown; identical to SEQ ID NO: 304
  Bacillus sp. multi

SEQ ID NO: 314 - DNA, 1356 bp, Unknown; identical to SEQ ID NO: 304
  Bacillus sp. multi

SEQ ID NO: 315 - DNA, 1356 bp, Unknown; identical to SEQ ID NO: 304
  Bacillus sp. multi

SEQ ID NO: 316 - DNA, 1356 bp, Unknown; identical to SEQ ID NO: 304
  Bacillus sp. multi

SEQ ID NO: 317 - DNA, 1356 bp, Unknown; identical to SEQ ID NO: 304
  Bacillus sp. multi

SEQ ID NO: 318 - DNA, 1356 bp, Unknown; identical to SEQ ID NO: 304
  Bacillus sp. multi

SEQ ID NO: 319 - DNA, 1356 bp, Unknown; identical to SEQ ID NO: 304
  Bacillus sp. multi

SEQ ID NO: 320 - DNA, 1356 bp, Unknown; identical to SEQ ID NO: 304
  Bacillus sp. multi

SEQ ID NO: 321 - DNA, 1356 bp, Unknown; identical to SEQ ID NO: 304
  Bacillus sp. multi

SEQ ID NO: 322 - DNA, 1356 bp, Unknown; identical to SEQ ID NO: 304
  Bacillus sp. multi

SEQ ID NO: 323 - DNA, 1356 bp, Unknown; identical to SEQ ID NO: 307
  Bacillus sp. multi

SEQ ID NO: 324 - DNA, 1356 bp, Unknown; identical to SEQ ID NO: 17
  Bacillus sp. multi

SEQ ID NO: 325 - DNA, 1356 bp, Unknown; identical to SEQ ID NO: 17
  Bacillus sp. multi

SEQ ID NO: 326 - DNA, 1356 bp, Unknown; identical to SEQ ID NO: 17
  Bacillus sp. multi

SEQ ID NO: 327 - DNA, 1356 bp, Unknown; identical to SEQ ID NO: 17
  Bacillus sp. multi

SEQ ID NO: 328 - DNA, 1356 bp, Unknown; identical to SEQ ID NO: 17
  Bacillus sp. multi

SEQ ID NO: 329 - DNA, 1335 bp, Unknown; identical to SEQ ID NO: 18
  Bacillus sp. multi

SEQ ID NO: 330 - DNA, 1335 bp, Unknown; identical to SEQ ID NO: 18
  Bacillus sp. multi

SEQ ID NO: 331 - DNA, 1356 bp, Unknown; identical to SEQ ID NO: 20
  Bacillus sp. multi

SEQ ID NO: 332 - DNA, 1356 bp, Unknown; identical to SEQ ID NO: 20
  Bacillus sp. multi

SEQ ID NO: 333 - DNA, 1356 bp, Unknown; identical to SEQ ID NO: 20
  Bacillus sp. multi

SEQ ID NO: 334 - DNA, 1356 bp, Unknown; identical to SEQ ID NO: 20
  Bacillus sp. multi

SEQ ID NO: 335 - DNA, 1356 bp, Unknown; identical to SEQ ID NO: 21
  Bacillus sp. multi

SEQ ID NO: 336 - DNA, 1356 bp, Unknown; identical to SEQ ID NO: 21
  Bacillus sp. multi

SEQ ID NO: 337 - DNA, 1356 bp, Unknown; identical to SEQ ID NO: 21
  Bacillus sp. multi

SEQ ID NO: 338 - DNA, 1356 bp, Unknown; identical to SEQ ID NO: 21
  Bacillus sp. multi

SEQ ID NO: 339 - DNA, 1356 bp, Unknown; identical to SEQ ID NO: 21
  Bacillus sp. multi

SEQ ID NO: 340 - DNA, 1356 bp, Unknown; identical to SEQ ID NO: 21
  Bacillus sp. multi

SEQ ID NO: 341 - DNA, 1356 bp, Unknown; identical to SEQ ID NO: 21
  Bacillus sp. multi

SEQ ID NO: 342 - DNA, 1356 bp, Unknown; identical to SEQ ID NO: 21
  Bacillus sp. multi

SEQ ID NO: 343 - DNA, 1356 bp, Unknown; identical to SEQ ID NO: 21
  Bacillus sp. multi

SEQ ID NO: 344 - DNA, 1356 bp, Unknown; identical to SEQ ID NO: 21
  Bacillus sp. multi

SEQ ID NO: 345 - DNA, 1356 bp, Unknown; identical to SEQ ID NO: 21
  Bacillus sp. multi

SEQ ID NO: 346 - DNA, 1356 bp, Unknown; identical to SEQ ID NO: 21
  Bacillus sp. multi

SEQ ID NO: 347 - DNA, 1356 bp, Unknown; identical to SEQ ID NO: 21
  Bacillus sp. multi

SEQ ID NO: 348 - DNA, 1356 bp, Unknown; identical to SEQ ID NO: 21
  Bacillus sp. multi

SEQ ID NO: 349 - DNA, 1356 bp, Unknown; identical to SEQ ID NO: 21
  Bacillus sp. multi

SEQ ID NO: 350 - DNA, 1356 bp, Unknown; identical to SEQ ID NO: 21
  Bacillus sp. multi

SEQ ID NO: 351 - DNA, 1356 bp, Unknown
  Bacillus sp. multi
ttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggttatatataccatacattacaaagtaaatatccagatatacataagggaaacatgtctaccactcttcaaaaaattataaaaacctggaagagtagaagaaatgaaattagaaaaggtgagatgtcaattccttcttttcgaaatcgcataccaattgatctccataataattcagtagacataataaaagagaagaatggagattatattgctggtatatctcttttttcacgagattttcataaggaaaatggcgatgtcccaaaagggaagatttttgtaaagttaggtacccaaaaacaaaaaagcatgaaagttattttagaccgattaatcaatcaaacatacagcaaaggcgcatgtatgattcataaatacaaaaataagtggtatttatcaattacttataaattcaatgctataaaagaaaataaatttgataaagaattaatcatgggaattgatatgggtggaataaatacagtttactttgcatttaatgaaggatttattcgtagcaatattaaaagtgatgaaattaaaatgtttaatgaaagaattcgacagagacgtatcaacttattgaaacaaagtaaatattgtagtaatagcagaactggaaaaggtaggacgaaacgattacagcccatagacgtgttaagtaataaaatagctaagtttcgaaatagcactaatcataaatatgcaaactatatagtgaaacagtgtctaaaacataattgcgggcgtattcaaatggaacttttaaaaggtatatcaaaaaatgataaggttcttaaagattggacttattttgatttgcaggagaaaatcaaaaatcaggcagagatttatggaattgaagttattaaagttgtcccagcgtatacgagtcaacgatgtagtcaatgcggatatatttgtaaagaaaatcgttgtacacaagctatgtttgaatgtaagcagtgtggatataaaacacatgctgattataatgcggcgaaaaacatttccacttatgacatcgaaaatattataaataaacaattagcggtacaaagcaaattgcattcaaaaaaatgtatggaagagtatatagaagagttaggatacctggattaa

SEQ ID NO: 352 - DNA, 1356 bp, Unknown; identical to SEQ ID NO: 21
  Bacillus sp. multi

SEQ ID NO: 353 - DNA, 1356 bp, Unknown; identical to SEQ ID NO: 21
  Bacillus sp. multi

SEQ ID NO: 354 - DNA, 1356 bp, Unknown; identical to SEQ ID NO: 21
  Bacillus sp. multi

SEQ ID NO: 355 - DNA, 1356 bp, Unknown; identical to SEQ ID NO: 21
  Bacillus sp. multi

SEQ ID NO: 356 - DNA, 1356 bp, Unknown; identical to SEQ ID NO: 21
  Bacillus sp. multi

SEQ ID NO: 357 - DNA, 1356 bp, Unknown; identical to SEQ ID NO: 21
  Bacillus sp. multi

SEQ ID NO: 358 - DNA, 1356 bp, Unknown; identical to SEQ ID NO: 21
  Bacillus sp. multi

SEQ ID NO: 359 - DNA, 1356 bp, Unknown; identical to SEQ ID NO: 21
  Bacillus sp. multi

SEQ ID NO: 360 - DNA, 1356 bp, Unknown; identical to SEQ ID NO: 21
  Bacillus sp. multi

SEQ ID NO: 361 - DNA, 1356 bp, Bacillus thuringiensis; identical to SEQ ID NO: 21

SEQ ID NO: 362 - DNA, 1356 bp, Unknown; identical to SEQ ID NO: 21
  Bacillus sp. multi

SEQ ID NO: 363 - DNA, 1356 bp, Unknown; identical to SEQ ID NO: 21
  Bacillus sp. multi

SEQ ID NO: 364 - DNA, 1356 bp, Unknown; identical to SEQ ID NO: 21
  Bacillus sp. multi

SEQ ID NO: 365 - DNA, 1356 bp, Unknown; identical to SEQ ID NO: 21
  Bacillus sp. multi

SEQ ID NO: 366 - DNA, 1356 bp, Unknown; identical to SEQ ID NO: 21
  Bacillus sp. multi

SEQ ID NO: 367 - DNA, 1356 bp, Unknown; identical to SEQ ID NO: 21
  Bacillus sp. multi

SEQ ID NO: 368 - DNA, 1356 bp, Unknown; identical to SEQ ID NO: 21
  Bacillus sp. multi

SEQ ID NO: 369 - DNA, 1356 bp, Unknown; identical to SEQ ID NO: 21
  Bacillus sp. multi

SEQ ID NO: 370 - DNA, 1356 bp, Unknown; identical to SEQ ID NO: 21
  Bacillus sp. multi

SEQ ID NO: 371 - DNA, 1356 bp, Unknown; identical to SEQ ID NO: 21
  Bacillus sp. multi

SEQ ID NO: 372 - DNA, 1356 bp, Unknown; identical to SEQ ID NO: 21
  Bacillus sp. multi

SEQ ID NO: 373 - DNA, 1356 bp, Unknown; identical to SEQ ID NO: 21
  Bacillus sp. multi

SEQ ID NO: 374 - DNA, 1356 bp, Unknown; identical to SEQ ID NO: 21
  Bacillus sp. multi

SEQ ID NO: 375 - DNA, 1356 bp, Unknown; identical to SEQ ID NO: 21
  Bacillus sp. multi

SEQ ID NO: 376 - DNA, 1356 bp, Unknown; identical to SEQ ID NO: 21
  Bacillus sp. multi

SEQ ID NO: 377 - DNA, 1356 bp, Unknown; identical to SEQ ID NO: 21
  Bacillus sp. multi

SEQ ID NO: 378 - DNA, 1356 bp, Unknown; identical to SEQ ID NO: 21
  Bacillus sp. multi

SEQ ID NO: 379 - DNA, 1356 bp, Unknown; identical to SEQ ID NO: 21
  Bacillus sp. multi

SEQ ID NO: 380 - DNA, 1356 bp, Unknown; identical to SEQ ID NO: 21
  Bacillus sp. multi

SEQ ID NO: 381 - DNA, 1356 bp, Unknown; identical to SEQ ID NO: 21
  Bacillus sp. multi

SEQ ID NO: 382 - DNA, 1356 bp, Unknown; identical to SEQ ID NO: 21
  Bacillus sp. multi

SEQ ID NO: 383 - DNA, 1356 bp, Unknown; identical to SEQ ID NO: 21
  Bacillus sp. multi

SEQ ID NO: 384 - DNA, 1356 bp, Unknown; identical to SEQ ID NO: 21
  Bacillus sp. multi

SEQ ID NO: 385 - DNA, 1356 bp, Unknown; identical to SEQ ID NO: 21
  Bacillus sp. multi

SEQ ID NO: 386 - DNA, 1356 bp, Unknown; identical to SEQ ID NO: 21
  Bacillus sp. multi

SEQ ID NO: 387 - DNA, 1356 bp, Unknown; identical to SEQ ID NO: 21
  Bacillus sp. multi

SEQ ID NO: 388 - DNA, 1356 bp, Unknown; identical to SEQ ID NO: 21
  Bacillus sp. multi

SEQ ID NO: 389 - DNA, 1356 bp, Unknown; identical to SEQ ID NO: 21
  Bacillus sp. multi

SEQ ID NO: 390 - DNA, 1356 bp, Unknown; identical to SEQ ID NO: 21
  Bacillus sp. multi

SEQ ID NO: 391 - DNA, 1356 bp, Unknown; identical to SEQ ID NO: 21
  Bacillus sp. multi

SEQ ID NO: 392 - DNA, 1356 bp, Unknown; identical to SEQ ID NO: 21
  Bacillus sp. multi

SEQ ID NO: 393 - DNA, 1356 bp, Unknown; identical to SEQ ID NO: 21
  Bacillus sp. multi

SEQ ID NO: 394 - DNA, 1356 bp, Unknown; identical to SEQ ID NO: 21
  Bacillus sp. multi

SEQ ID NO: 395 - DNA, 1356 bp, Unknown; identical to SEQ ID NO: 21
  Bacillus sp. multi

SEQ ID NO: 396 - DNA, 1356 bp, Unknown; identical to SEQ ID NO: 21
  Bacillus sp. multi

SEQ ID NO: 397 - DNA, 1356 bp, Unknown; identical to SEQ ID NO: 21
  Bacillus sp. multi

SEQ ID NO: 398 - DNA, 1356 bp, Unknown; identical to SEQ ID NO: 21
  Bacillus sp. multi

SEQ ID NO: 399 - DNA, 1356 bp, Unknown; identical to SEQ ID NO: 21
  Bacillus sp. multi

SEQ ID NO: 400 - DNA, 1356 bp, Unknown; identical to SEQ ID NO: 21
  Bacillus sp. multi

SEQ ID NO: 401 - DNA, 1356 bp, Unknown; identical to SEQ ID NO: 21
  Bacillus sp. multi

SEQ ID NO: 402 - DNA, 1356 bp, Unknown; identical to SEQ ID NO: 21
  Bacillus sp. multi

SEQ ID NO: 403 - DNA, 1356 bp, Unknown; identical to SEQ ID NO: 21
  Bacillus sp. multi

SEQ ID NO: 404 - DNA, 1356 bp, Unknown; identical to SEQ ID NO: 21
  Bacillus sp. multi

SEQ ID NO: 405 - DNA, 1356 bp, Unknown; identical to SEQ ID NO: 21
  Bacillus sp. multi

SEQ ID NO: 406 - DNA, 1356 bp, Unknown; identical to SEQ ID NO: 21
  Bacillus sp. multi

SEQ ID NO: 407 - DNA, 1356 bp, Unknown; identical to SEQ ID NO: 21
  Bacillus sp. multi

SEQ ID NO: 408 - DNA, 1356 bp, Unknown; identical to SEQ ID NO: 21
  Bacillus sp. multi

SEQ ID NO: 409 - DNA, 1356 bp, Unknown; identical to SEQ ID NO: 21
  Bacillus sp. multi

SEQ ID NO: 410 - DNA, 1356 bp, Unknown; identical to SEQ ID NO: 21
  Bacillus sp. multi

SEQ ID NO: 411 - DNA, 1356 bp, Unknown; identical to SEQ ID NO: 21
  Bacillus sp. multi

SEQ ID NO: 412 - DNA, 1356 bp, Unknown; identical to SEQ ID NO: 21
  Bacillus sp. multi

SEQ ID NO: 413 - DNA, 1356 bp, Unknown; identical to SEQ ID NO: 21
  Bacillus sp. multi

SEQ ID NO: 414 - DNA, 1356 bp, Unknown; identical to SEQ ID NO: 21
  Bacillus sp. multi

SEQ ID NO: 415 - DNA, 1356 bp, Unknown; identical to SEQ ID NO: 21
  Bacillus sp. multi

SEQ ID NO: 416 - DNA, 1356 bp, Unknown; identical to SEQ ID NO: 351
  Bacillus sp. multi

SEQ ID NO: 417 - DNA, 1356 bp, Unknown; identical to SEQ ID NO: 21
  Bacillus sp. multi

SEQ ID NO: 418 - DNA, 1356 bp, Unknown; identical to SEQ ID NO: 21
  Bacillus sp. multi

SEQ ID NO: 419 - DNA, 1356 bp, Unknown; identical to SEQ ID NO: 21
  Bacillus sp. multi

SEQ ID NO: 420 - DNA, 1356 bp, Unknown; identical to SEQ ID NO: 21
  Bacillus sp. multi

SEQ ID NO: 421 - DNA, 1356 bp, Unknown; identical to SEQ ID NO: 21
  Bacillus sp. multi

SEQ ID NO: 422 - DNA, 1356 bp, Unknown; identical to SEQ ID NO: 21
  Bacillus sp. multi

SEQ ID NO: 423 - DNA, 1356 bp, Bacillus thuringiensis; identical to SEQ ID NO: 21

SEQ ID NO: 424 - DNA, 1356 bp, Bacillus thuringiensis; identical to SEQ ID NO: 21

SEQ ID NO: 425 - DNA, 1356 bp, Bacillus thuringiensis; identical to SEQ ID NO: 21

SEQ ID NO: 426 - DNA, 1356 bp, Unknown; identical to SEQ ID NO: 21
  Bacillus sp. multi

SEQ ID NO: 427 - DNA, 1356 bp, Unknown; identical to SEQ ID NO: 21
  Bacillus sp. multi

SEQ ID NO: 428 - DNA, 1356 bp, Unknown; identical to SEQ ID NO: 21
  Bacillus sp. multi

SEQ ID NO: 429 - DNA, 1356 bp, Unknown; identical to SEQ ID NO: 21
  Bacillus sp. multi

SEQ ID NO: 430 - DNA, 1356 bp, Unknown; identical to SEQ ID NO: 21
  Bacillus sp. multi

SEQ ID NO: 431 - DNA, 1356 bp, Unknown; identical to SEQ ID NO: 21
  Bacillus sp. multi

SEQ ID NO: 432 - DNA, 1356 bp, Unknown; identical to SEQ ID NO: 21
  Bacillus sp. multi

SEQ ID NO: 433 - DNA, 1356 bp, Unknown; identical to SEQ ID NO: 21
  Bacillus sp. multi

SEQ ID NO: 434 - DNA, 1356 bp, Unknown; identical to SEQ ID NO: 21
  Bacillus sp. multi

SEQ ID NO: 435 - DNA, 1356 bp, Unknown; identical to SEQ ID NO: 21
  Bacillus sp. multi

SEQ ID NO: 436 - DNA, 1356 bp, Unknown; identical to SEQ ID NO: 21
  Bacillus sp. multi

SEQ ID NO: 437 - DNA, 1356 bp, Unknown; identical to SEQ ID NO: 21
  Bacillus sp. multi

SEQ ID NO: 438 - DNA, 1356 bp, Unknown; identical to SEQ ID NO: 21
  Bacillus sp. multi

SEQ ID NO: 439 - DNA, 1356 bp, Unknown; identical to SEQ ID NO: 21
  Bacillus sp. multi

SEQ ID NO: 440 - DNA, 1356 bp, Unknown; identical to SEQ ID NO: 351
  Bacillus sp. multi

SEQ ID NO: 441 - DNA, 1356 bp, Unknown; identical to SEQ ID NO: 21
  Bacillus sp. multi

SEQ ID NO: 442 - DNA, 1356 bp, Unknown; identical to SEQ ID NO: 21
  Bacillus sp. multi

SEQ ID NO: 443 - DNA, 1356 bp, Unknown; identical to SEQ ID NO: 21
  Bacillus sp. multi

SEQ ID NO: 444 - DNA, 1356 bp, Unknown; identical to SEQ ID NO: 351
  Bacillus sp. multi

SEQ ID NO: 445 - DNA, 1356 bp, Unknown; identical to SEQ ID NO: 21
  Bacillus sp. multi

SEQ ID NO: 446 - DNA, 1356 bp, Unknown; identical to SEQ ID NO: 21
  Bacillus sp. multi

SEQ ID NO: 447 - DNA, 1356 bp, Unknown; identical to SEQ ID NO: 351
  Bacillus sp. multi

SEQ ID NO: 448 - DNA, 1356 bp, Unknown; identical to SEQ ID NO: 351
  Bacillus sp. multi

SEQ ID NO: 449 - DNA, 1335 bp, Unknown; identical to SEQ ID NO: 26
  Bacillus sp. multi

SEQ ID NO: 450 - DNA, 1356 bp, Unknown; identical to SEQ ID NO: 28
  Bacillus sp. multi

SEQ ID NO: 451 - DNA, 1356 bp, Unknown; identical to SEQ ID NO: 28
  Bacillus sp. multi

SEQ ID NO: 452 - DNA, 1356 bp, Unknown; identical to SEQ ID NO: 31
  Bacillus sp. multi

SEQ ID NO: 453 - DNA, 1335 bp, Unknown; identical to SEQ ID NO: 33
  Bacillus sp. multi

SEQ ID NO: 454 - DNA, 1335 bp, Unknown; identical to SEQ ID NO: 34
  Bacillus sp. multi

SEQ ID NO: 455 - DNA, 1335 bp, Bacillus thuringiensis; identical to SEQ ID NO: 37

SEQ ID NO: 456 - DNA, 1335 bp, Unknown; identical to SEQ ID NO: 37
  Bacillus sp. multi

SEQ ID NO: 457 - DNA, 1335 bp, Unknown; identical to SEQ ID NO: 37
  Bacillus sp. multi

SEQ ID NO: 458 - DNA, 1335 bp, Unknown; identical to SEQ ID NO: 37
  Bacillus sp. multi

SEQ ID NO: 459 - DNA, 1335 bp, Unknown; identical to SEQ ID NO: 37
  Bacillus sp. multi

SEQ ID NO: 460 - DNA, 1356 bp, Unknown; identical to SEQ ID NO: 42
  Bacillus sp. multi

SEQ ID NO: 461 - DNA, 1338 bp, Unknown; identical to SEQ ID NO: 48
  Bacillus sp. multi

SEQ ID NO: 462 - DNA, 1338 bp, Unknown; identical to SEQ ID NO: 48
  Bacillus sp. multi

SEQ ID NO: 463 - DNA, 1338 bp, Unknown; identical to SEQ ID NO: 48
  Bacillus sp. multi

SEQ ID NO: 464 - DNA, 1338 bp, Unknown
  Bacillus sp. multi
ttgggagtaacaattaagataatgaaatatcaaattttatgtccactgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaataattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggctataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaa

SEQ ID NO: 465 - DNA, 1338 bp, Unknown; identical to SEQ ID NO: 48
  Bacillus sp. multi

SEQ ID NO: 466 - DNA, 1338 bp, Unknown; identical to SEQ ID NO: 464
  Bacillus sp. multi

SEQ ID NO: 467 - DNA, 1338 bp, Unknown; identical to SEQ ID NO: 48
  Bacillus sp. multi

SEQ ID NO: 468 - DNA, 1317 bp, Unknown; identical to SEQ ID NO: 50
  Bacillus sp. multi

SEQ ID NO: 469 - DNA, 1335 bp, Unknown; identical to SEQ ID NO: 51
  Bacillus sp. multi

SEQ ID NO: 470 - DNA, 1335 bp, Unknown; identical to SEQ ID NO: 51
  Bacillus sp. multi

SEQ ID NO: 471 - DNA, 1338 bp, Unknown; identical to SEQ ID NO: 52
  Bacillus sp. multi

SEQ ID NO: 472 - DNA, 1338 bp, Unknown
  Bacillus sp. multi
ttgggagtaacaattaagataatgaaatatcaaattttatgtccactgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaataattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaaaagttaggatacctggattaa

SEQ ID NO: 473 - DNA, 1338 bp, Unknown; identical to SEQ ID NO: 52
  Bacillus sp. multi

SEQ ID NO: 474 - DNA, 1338 bp, Unknown; identical to SEQ ID NO: 53
  Bacillus sp. multi

SEQ ID NO: 475 - DNA, 1338 bp, Unknown; identical to SEQ ID NO: 53
  Bacillus sp. multi

SEQ ID NO: 476 - DNA, 1338 bp, Unknown; identical to SEQ ID NO: 53
  Bacillus sp. multi

SEQ ID NO: 477 - DNA, 1338 bp, Unknown; identical to SEQ ID NO: 53
  Bacillus sp. multi

SEQ ID NO: 478 - DNA, 1338 bp, Unknown; identical to SEQ ID NO: 53
  Bacillus sp. multi

SEQ ID NO: 479 - DNA, 1338 bp, Unknown; identical to SEQ ID NO: 53
  Bacillus sp. multi

SEQ ID NO: 480 - DNA, 1338 bp, Bacillus; identical to SEQ ID NO: 53

SEQ ID NO: 481 - DNA, 1338 bp, Unknown; identical to SEQ ID NO: 53
  Bacillus sp. multi

SEQ ID NO: 482 - DNA, 1356 bp, Unknown; identical to SEQ ID NO: 55
  Bacillus sp. multi

SEQ ID NO: 483 - DNA, 1356 bp, Unknown; identical to SEQ ID NO: 55
  Bacillus sp. multi

SEQ ID NO: 484 - DNA, 1335 bp, Unknown; identical to SEQ ID NO: 56
  Bacillus sp. multi

SEQ ID NO: 485 - DNA, 1335 bp, Unknown; identical to SEQ ID NO: 56
  Bacillus sp. multi

SEQ ID NO: 486 - DNA, 1335 bp, Unknown; identical to SEQ ID NO: 56
  Bacillus sp. multi

SEQ ID NO: 487 - DNA, 1335 bp, Unknown; identical to SEQ ID NO: 56
  Bacillus sp. multi

SEQ ID NO: 488 - DNA, 1335 bp, Unknown; identical to SEQ ID NO: 56
  Bacillus sp. multi

SEQ ID NO: 489 - DNA, 1335 bp, Unknown; identical to SEQ ID NO: 56
  Bacillus sp. multi

SEQ ID NO: 490 - DNA, 1335 bp, Unknown; identical to SEQ ID NO: 56
  Bacillus sp. multi

SEQ ID NO: 491 - DNA, 1335 bp, Unknown; identical to SEQ ID NO: 56
  Bacillus sp. multi

SEQ ID NO: 492 - DNA, 1335 bp, Unknown; identical to SEQ ID NO: 56
  Bacillus sp. multi

SEQ ID NO: 493 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaactattcaacaattatgggagtttgatgctttatcttttgactactttaaagcaatagggacataccctactgtccaagatttgtatgggtgtacacagaagaaaattgacggttatatataccatacattacaaagtaaatatccagatatacataaaggaaacatgtctaccactcttcaaaaaattataaaaacatggaagagtagaagaaatgaaattagaaaaggtgaaatgtcaattccttcttttcgaaatcgcataccaattgatctccataataattctgtagacataaaaaaagagaagaatggagattatattgctgggatatctcttttttcacgagattttcataaggaaaatagcgatgtcccaaaagggaagatttttgtaaagttagctaccaaaaaacaaaaaagcatgaaaattattttagaccgattaatgaatcaaacatacagcaaaggcgcatgtatgattcataaatacaaaaataagtggtatttatcaattacttataaattcaatgctataaaagaaaataattttgataaagaattaatcatgggaattgatatgggtggaataaatacagtttactttgcgtttaatgaagggtttattcgtagcaatattaaaagtgatgaaattaaagcatttaatgaaaaaattcgacagagacgtatcaatttactgaaacaaagtaattattgtagtaatagtagaacgggaaaaggtagggcaaaacggttacagccaatagacgtgttaagtaataaaatagctaagtttcgaaatagcactaaccataaatatgcaaactatataataaaacagtgcctaaaacataattgcgggcgtattcaaatagaacttttaaaaggcatatcaaaaaatgataaggttcttaaagattggacgtattttgatttgcaggagaaaatcaagaatcaagctgaggttcatggaattgaagttattaaagttgcttccgcatatacgagtcaacgatgtagtcaatgcggatatatttgtaaagaaaatcgttgtacacaagcggtttttgaatgtaagcagtgtggatataaaacacatgctgattataatgcggccaaaaacattgctacttatgacatcgaaaatattataaataaacaattagcggtacaaagcaaattacattcaaaaaaatgtatggaagagtatatagaagagttaggatacctggattaa

SEQ ID NO: 494 - DNA, 1335 bp, Unknown; identical to SEQ ID NO: 56
  Bacillus sp. multi

SEQ ID NO: 495 - DNA, 1335 bp, Unknown; identical to SEQ ID NO: 56
  Bacillus sp. multi

SEQ ID NO: 496 - DNA, 1335 bp, Unknown; identical to SEQ ID NO: 56
  Bacillus sp. multi

SEQ ID NO: 497 - DNA, 1335 bp, Unknown; identical to SEQ ID NO: 56
  Bacillus sp. multi

SEQ ID NO: 498 - DNA, 1335 bp, Unknown; identical to SEQ ID NO: 56
  Bacillus sp. multi

SEQ ID NO: 499 - DNA, 1335 bp, Unknown
  Bacillus sp. multi
atgaaatatcaaattttatgtccaatgaatgtcgattggacaatatttgaaaagcatttacgaaacttaacatatcaggtcagaacgataagtaatcgaactattcaacaattatgggagtttgatgctttatcttttgactactttaaagcaatagggacataccctactgtccaagatttgtatgggtgtacacagaagaaaattgacggttatatataccatacattacaaagtaaatatccagatatacataaaggaaacatgtctaccactcttcaaaaaattataaaaacatggaagagtagaagaaatgaaattagaaaaggtgaaatgtcaattccttcttttcgaaatcgcataccaattgatctccataataattctgtagacataaaaaaagagaagaatggagattatattgctgggatatctcttttttcacgagattttcataaggaaaatagcgatgtcccaaaagggaagatttttgtaaagttagctaccaaaaaacaaaaaagcatgaaaattattttagaccgattaatgaatcaaacatacagcaaaggcgcatgtatgattcataaatacaaaaataagtggtatttatcaattacttataaattcaatgctataaaagaaaataattttgataaagaattaatcatgggaattgatatgggtggaataaatacagtttactttgcgtttaatgaagggtttattcgtagcaatattaaaagtgatgaaattaaagcatttaatgaaaaaattcgacagagacgtatcaatttactgaaacaaagtaattattgtagtaatagtagaacgggaaaaggtagggcaaaacggttacagccaatagacgtgttaagtaataaaatagctaagtttcgaaatagcactaaccataaatatgcaaactatataataaaacagtgcctaaaacataactgcgggcgtattcaaatagaacttttaaaaggcatatcaaaaaatgataaggttcttaaagattggacgtattttgatttgcaggagaaaatcaagaatcaagctgaggttcatggaattgaagttattaaagttgcttccgcatatacgagtcaacgatgtagtcaatgcggatatatttgtaaagaaaatcgttgtacacaagcagtttttgaatgtaagcagtgtggatataaaacacatgctgattataatgcggccaaaaacattgctacttatgacatcgaaaatattataaataaacaattagcggtacaaagcaaattacattcaaaaaaatgtatggaagagtatatagaagagttaggatacctggattaa

SEQ ID NO: 500 - DNA, 1335 bp, Unknown; identical to SEQ ID NO: 56
  Bacillus sp. multi

SEQ ID NO: 501 - DNA, 1335 bp, Unknown; identical to SEQ ID NO: 56
  Bacillus sp. multi

SEQ ID NO: 502 - DNA, 1335 bp, Unknown; identical to SEQ ID NO: 56
  Bacillus sp. multi

SEQ ID NO: 503 - DNA, 1335 bp, Unknown; identical to SEQ ID NO: 56
  Bacillus sp. multi

SEQ ID NO: 504 - DNA, 1335 bp, Unknown; identical to SEQ ID NO: 56
  Bacillus sp. multi

SEQ ID NO: 505 - DNA, 1332 bp, Unknown; identical to SEQ ID NO: 63
  Bacillus sp. multi

SEQ ID NO: 506 - DNA, 1353 bp, Unknown; identical to SEQ ID NO: 65
  Bacillus sp. multi

SEQ ID NO: 507 - DNA, 1353 bp, Unknown; identical to SEQ ID NO: 65
  Bacillus sp. multi

SEQ ID NO: 508 - DNA, 1353 bp, Unknown; identical to SEQ ID NO: 65
  Bacillus sp. multi

SEQ ID NO: 509 - DNA, 1353 bp, Unknown; identical to SEQ ID NO: 65
  Bacillus sp. multi

SEQ ID NO: 510 - DNA, 1353 bp, Unknown; identical to SEQ ID NO: 65
  Bacillus sp. multi

SEQ ID NO: 511 - DNA, 1353 bp, Unknown; identical to SEQ ID NO: 65
  Bacillus sp. multi

SEQ ID NO: 512 - DNA, 1353 bp, Unknown; identical to SEQ ID NO: 65
  Bacillus sp. multi

SEQ ID NO: 513 - DNA, 1353 bp, Unknown; identical to SEQ ID NO: 65
  Bacillus sp. multi

SEQ ID NO: 514 - DNA, 1353 bp, Bacillus; identical to SEQ ID NO: 65

SEQ ID NO: 515 - DNA, 1353 bp, Bacillus; identical to SEQ ID NO: 65

SEQ ID NO: 516 - DNA, 1353 bp, Bacillus; identical to SEQ ID NO: 65

SEQ ID NO: 517 - DNA, 1353 bp, Unknown; identical to SEQ ID NO: 65
  Bacillus sp. multi

SEQ ID NO: 518 - DNA, 1332 bp, Unknown; identical to SEQ ID NO: 69
  Bacillus sp. multi

SEQ ID NO: 519 - DNA, 1353 bp, Unknown; identical to SEQ ID NO: 70
  Bacillus sp. multi

SEQ ID NO: 520 - DNA, 1353 bp, Unknown; identical to SEQ ID NO: 70
  Bacillus sp. multi

SEQ ID NO: 521 - DNA, 1353 bp, Unknown; identical to SEQ ID NO: 70
  Bacillus sp. multi

SEQ ID NO: 522 - DNA, 1353 bp, Unknown; identical to SEQ ID NO: 70
  Bacillus sp. multi

SEQ ID NO: 523 - DNA, 1353 bp, Unknown; identical to SEQ ID NO: 71
  Bacillus sp. multi

SEQ ID NO: 524 - DNA, 1353 bp, Unknown; identical to SEQ ID NO: 71
  Bacillus sp. multi

SEQ ID NO: 525 - DNA, 1353 bp, Unknown; identical to SEQ ID NO: 71
  Bacillus sp. multi

SEQ ID NO: 526 - DNA, 1353 bp, Unknown; identical to SEQ ID NO: 71
  Bacillus sp. multi

SEQ ID NO: 527 - DNA, 1353 bp, Unknown; identical to SEQ ID NO: 71
  Bacillus sp. multi

SEQ ID NO: 528 - DNA, 1353 bp, Unknown; identical to SEQ ID NO: 71
  Bacillus sp. multi

SEQ ID NO: 529 - DNA, 1353 bp, Unknown; identical to SEQ ID NO: 71
  Bacillus sp. multi

SEQ ID NO: 530 - DNA, 1353 bp, Unknown; identical to SEQ ID NO: 71
  Bacillus sp. multi

SEQ ID NO: 531 - DNA, 1353 bp, Unknown; identical to SEQ ID NO: 71
  Bacillus sp. multi

SEQ ID NO: 532 - DNA, 1353 bp, Unknown; identical to SEQ ID NO: 74
  Bacillus sp. multi

SEQ ID NO: 533 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctttgtacaatattgagaaggtaatacaaaaacaattggagttacaagaaaaattaaatcaaacaaaatataaagaacagtatatagaacaaatgaaaaatattaattaa

SEQ ID NO: 534 - DNA, 1353 bp, Unknown; identical to SEQ ID NO: 74
  Bacillus sp. multi

SEQ ID NO: 535 - DNA, 1353 bp, Unknown; identical to SEQ ID NO: 74
  Bacillus sp. multi

SEQ ID NO: 536 - DNA, 1353 bp, Unknown; identical to SEQ ID NO: 74
  Bacillus sp. multi

SEQ ID NO: 537 - DNA, 1353 bp, Unknown; identical to SEQ ID NO: 74
  Bacillus sp. multi

SEQ ID NO: 538 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcactttaaagatactggccaatatccaagtgcccaacaattatatgggtgtactcaaaaaaccataagtggatatatttatgatcagttaaaagaagaatatcaagatattaataaagcgaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctttgtacaatattgagaaggtaatacaaaaacaattggagttacaagaaaaattaaatcaaacaaaatataaagaacagtatatagaacaaatgaaaaatattaattaa

SEQ ID NO: 539 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctttgtacaatattgagaaggtaatacaaaaacaattggagttacaagaaaaattaaatcaaacaaaatataaagaacagtatatagaacaaatgaaaaatattaattaa

SEQ ID NO: 540 - DNA, 1353 bp, Unknown
  Bacillus sp. multi
ttgagcatagctgtaaaagtaatgaaataccaaatagtctgtcctgtaaatatagaatggaaaacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctttgtacaatattgagaaggtaatacaaaaacaattggagttacaagaaaaattaaatcaaacaaaatataaagaacagtatatagaacaaatgaaaaatattaattaa

SEQ ID NO: 541 - DNA, 1353 bp, Unknown; identical to SEQ ID NO: 539
  Bacillus sp. multi

SEQ ID NO: 542 - DNA, 1353 bp, Unknown; identical to SEQ ID NO: 539
  Bacillus sp. multi

SEQ ID NO: 543 - DNA, 1197 bp, Unknown; identical to SEQ ID NO: 75
  Bacillus sp. multi

SEQ ID NO: 544 - DNA, 1197 bp, Unknown; identical to SEQ ID NO: 75
  Bacillus sp. multi

SEQ ID NO: 545 - DNA, 1197 bp, Unknown; identical to SEQ ID NO: 75
  Bacillus sp. multi

SEQ ID NO: 546 - DNA, 1197 bp, Bacillus cereus; identical to SEQ ID NO: 75

SEQ ID NO: 547 - DNA, 1197 bp, Unknown; identical to SEQ ID NO: 75
  Bacillus sp. multi

SEQ ID NO: 548 - DNA, 1197 bp, Unknown; identical to SEQ ID NO: 75
  Bacillus sp. multi

SEQ ID NO: 549 - DNA, 1197 bp, Unknown; identical to SEQ ID NO: 75
  Bacillus sp. multi

SEQ ID NO: 550 - DNA, 1197 bp, Bacillus cereus; identical to SEQ ID NO: 75

SEQ ID NO: 551 - DNA, 1197 bp, Unknown; identical to SEQ ID NO: 75
  Bacillus sp. multi

SEQ ID NO: 552 - DNA, 1197 bp, Unknown; identical to SEQ ID NO: 75
  Bacillus sp. multi

SEQ ID NO: 553 - DNA, 1197 bp, Unknown; identical to SEQ ID NO: 75
  Bacillus sp. multi

SEQ ID NO: 554 - DNA, 1197 bp, Unknown; identical to SEQ ID NO: 75
  Bacillus sp. multi

SEQ ID NO: 555 - DNA, 1197 bp, Unknown; identical to SEQ ID NO: 75
  Bacillus sp. multi

SEQ ID NO: 556 - DNA, 1197 bp, Unknown; identical to SEQ ID NO: 75
  Bacillus sp. multi

SEQ ID NO: 557 - DNA, 1197 bp, Bacillus thuringiensis; identical to SEQ ID NO: 75

SEQ ID NO: 558 - DNA, 1197 bp, Unknown; identical to SEQ ID NO: 75
  Bacillus sp. multi

SEQ ID NO: 559 - DNA, 1353 bp, Unknown; identical to SEQ ID NO: 78
  Bacillus sp. multi

SEQ ID NO: 560 - DNA, 1353 bp, Unknown; identical to SEQ ID NO: 78
  Bacillus sp. multi

SEQ ID NO: 561 - DNA, 1353 bp, Unknown; identical to SEQ ID NO: 78
  Bacillus sp. multi

SEQ ID NO: 562 - DNA, 1332 bp, Unknown; identical to SEQ ID NO: 82
  Bacillus sp. multi

SEQ ID NO: 563 - DNA, 1353 bp, Unknown; identical to SEQ ID NO: 87
  Bacillus sp. multi

SEQ ID NO: 564 - DNA, 1353 bp, Unknown; identical to SEQ ID NO: 87
  Bacillus sp. multi

SEQ ID NO: 565 - DNA, 1353 bp, Unknown; identical to SEQ ID NO: 87
  Bacillus sp. multi

SEQ ID NO: 566 - DNA, 1353 bp, Unknown; identical to SEQ ID NO: 87
  Bacillus sp. multi

SEQ ID NO: 567 - DNA, 1353 bp, Unknown; identical to SEQ ID NO: 87
  Bacillus sp. multi

SEQ ID NO: 568 - DNA, 1353 bp, Bacillus weihenstephanensis; identical to SEQ ID NO: 87

SEQ ID NO: 569 - DNA, 1353 bp, Unknown; identical to SEQ ID NO: 87
  Bacillus sp. multi

SEQ ID NO: 570 - DNA, 1353 bp, Unknown; identical to SEQ ID NO: 87
  Bacillus sp. multi

SEQ ID NO: 571 - DNA, 1353 bp, Unknown; identical to SEQ ID NO: 87
  Bacillus sp. multi

SEQ ID NO: 572 - DNA, 1353 bp, Unknown; identical to SEQ ID NO: 87
  Bacillus sp. multi

SEQ ID NO: 573 - DNA, 1353 bp, Unknown; identical to SEQ ID NO: 87
  Bacillus sp. multi

SEQ ID NO: 574 - DNA, 1353 bp, Unknown; identical to SEQ ID NO: 87
  Bacillus sp. multi

SEQ ID NO: 575 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaacagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgagtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 576 - DNA, 1353 bp, Unknown; identical to SEQ ID NO: 575
  Bacillus sp. multi

SEQ ID NO: 577 - DNA, 1353 bp, Unknown; identical to SEQ ID NO: 87
  Bacillus sp. multi

SEQ ID NO: 578 - DNA, 1353 bp, Unknown; identical to SEQ ID NO: 87
  Bacillus sp. multi

SEQ ID NO: 579 - DNA, 1353 bp, Unknown; identical to SEQ ID NO: 87
  Bacillus sp. multi

SEQ ID NO: 580 - DNA, 1353 bp, Unknown; identical to SEQ ID NO: 87
  Bacillus sp. multi

SEQ ID NO: 581 - DNA, 1353 bp, Unknown; identical to SEQ ID NO: 87
  Bacillus sp. multi

SEQ ID NO: 582 - DNA, 1353 bp, Unknown; identical to SEQ ID NO: 87
  Bacillus sp. multi

SEQ ID NO: 583 - DNA, 1353 bp, Unknown; identical to SEQ ID NO: 87
  Bacillus sp. multi

SEQ ID NO: 584 - DNA, 1353 bp, Bacillus; identical to SEQ ID NO: 88

SEQ ID NO: 585 - DNA, 1353 bp, Unknown; identical to SEQ ID NO: 90
  Bacillus sp. multi

SEQ ID NO: 586 - DNA, 1353 bp, Unknown; identical to SEQ ID NO: 90
  Bacillus sp. multi

SEQ ID NO: 587 - DNA, 1353 bp, Unknown; identical to SEQ ID NO: 90
  Bacillus sp. multi

SEQ ID NO: 588 - DNA, 1353 bp, Unknown; identical to SEQ ID NO: 90
  Bacillus sp. multi

SEQ ID NO: 589 - DNA, 1353 bp, Unknown; identical to SEQ ID NO: 90
  Bacillus sp. multi

SEQ ID NO: 590 - DNA, 1353 bp, Unknown; identical to SEQ ID NO: 90
  Bacillus sp. multi

SEQ ID NO: 591 - DNA, 1353 bp, Unknown; identical to SEQ ID NO: 93
  Bacillus sp. multi

SEQ ID NO: 592 - DNA, 1353 bp, Unknown; identical to SEQ ID NO: 93
  Bacillus sp. multi

SEQ ID NO: 593 - DNA, 1353 bp, Unknown; identical to SEQ ID NO: 93
  Bacillus sp. multi

SEQ ID NO: 594 - DNA, 1353 bp, Unknown; identical to SEQ ID NO: 97
  Bacillus sp. multi

SEQ ID NO: 595 - DNA, 996 bp, Bacillus thuringiensis; identical to SEQ ID NO: 100

SEQ ID NO: 596 - DNA, 996 bp, Bacillus thuringiensis; identical to SEQ ID NO: 100

SEQ ID NO: 597 - DNA, 996 bp, Unknown; identical to SEQ ID NO: 100
  Bacillus sp. multi

SEQ ID NO: 598 - DNA, 1491 bp, Unknown; identical to SEQ ID NO: 102
  Bacillus sp. multi

SEQ ID NO: 599 - DNA, 978 bp, Unknown; identical to SEQ ID NO: 109
  Paenibacillus thiaminolyticus (multi)

SEQ ID NO: 600 - DNA, 978 bp, Unknown
  Paenibacillus thiaminolyticus (multi)
atggggacggaaaccgaggaacacaatacggtacatcaccgccacgatacgtcatatcgcttcctgttgtccagtaaaaagctctttgtcgagttgcttcgctcttttgttcaaaaagaatgggtgaagcgcatagatgaaacgaacgtgcaggaaattccccattcctttgtccttcaagacttcaagcggaaggaagccgatttggtgtaccgggtgaagctgaatggacaagatgtcgtattttacttgttgttggaaatgcagtccacagtggacttcctcatgccgtaccgtctactactttatcaggtggagatctggcgctatcttatgaaagaccaggaaaagacaaagggcaagccgaaagcattccggttgcctcccattgtgccgattgtgctgtacaatggaaagagacgctggaccgccaatcgccaatttcgccagttgttagccaatgagacaatgttcggttcggaactcttgaattttgaatatgtgcttattgatgttgctcgatacacggaagaagagttgttggctctttccaatacgatcggttctgtctttttgcttgatcagacggaggatcagacggaattactgaatcggctcggcaagctgatgcataccatacagcaaatgccagaggacagccagcagcaattggtcgcctggatggcgaatatattgagtcagaaattgccggaaaatgaaccgcatttgcgcgagcttatccaaaacgaaaaaggaggcgtatcggttatggggcttgaaaaaaccttggatgccattaaacgcgagggaagacgcgaaggccgaagagaaggcaaacaagaaggcaagcgggaagcaaaagaggaagttgtccagcaaatgattgccgaaaatctggatcctgaattaatcgccagaattacgggcttttcactcgatattattgcacagttacgggaaaaatctaaatctaagtga

SEQ ID NO: 601 - DNA, 978 bp, Unknown; identical to SEQ ID NO: 109
  Paenibacillus thiaminolyticus (multi)

SEQ ID NO: 602 - DNA, 1437 bp, Unknown; identical to SEQ ID NO: 115
  Bacillus sp. multi

SEQ ID NO: 603 - DNA, 1131 bp, Unknown; identical to SEQ ID NO: 118
  Bacillus sp. multi

SEQ ID NO: 604 - DNA, 1431 bp, Unknown
  Bacillus sp. multi
atgtctgtttctgtgtctgatgaattacaactatttgctcaagagattcaaagttttttatctccaaataccttacgggatcttgctagagatgttggttttgtacaacgaactagtaaataccaagcaaaagatttagtcgctttatgtatatggatgagtcaaaatatcgctacaacctctttagctcagttatctagctgtttagaatcatccacagaagtactcatcagtccagaaggactgaatcaacggtttaatacatcagcagttcagtttttacaacatatattgactaaccttctaaataaaaaattaacttcatctatgccactttcttctccatacacctctgttttcaagcgtattcgcattttagattccactgcatttcagcttccagatatattttcaaccatttatcctggggctggaggatgtagccatactgctgggatgaaaattcaacttgaatatgacctattaagcggacaattcctacatatccatacaggtccagggaaacaacatgatcgaacctatggttctctgtgtgttccaactgtaacaccaaatgatttatgtatccgtgatttagggtattttcatttgaaagatcttcaacatatacaagataaaaaggcttactatatctctcgtattaaatccaatacacgtatttatcaaaaaaatctcacacctgattattttcaagatggaagaatcaagaaaggtacagagtatatacagatagatatggaggtattaatgaactctctccaaccaggacaaacctatgaaatatccgatgcttatgtaggaatgactgataaagtaccaactcgtgtgattgttcatcgacttacagatgaacaacaacaaaaacgattgcaagatcaagctgtaagagagaaaaagaaaggaataaagtattcccctcgtagtaaacgtctcagtggtatcaatgtatatatgacaaacacctctacagatactgtcccgatgggacaagtacatgattggtactctttacgttggcaaatcgagattttatttaaaacatggaaatcattctttcatattcaccattgtaaaaaaataaaacgagaaagattagaatgccatttgtatgggcaactgatcgccattctcctctgttcttctactatgtttcaaatgcgtcaactacttcttatgaaaaagaaacgagagctgagtgaatataaggccatatatatgattagagattatttttttcttatttatcaagccatacagaaagacacccaagaattatcaaagattctcattcgcctgttcaacctcctacagcaaaatgggcgaaaatctcacagatatgagaagaaaacagtctttgatatattaggtgtcgtttacaattctaccatttctgaagatcaagcggcctaa

SEQ ID NO: 605 - DNA, 828 bp, Unknown
  Streptomyces sp. multi
atgtctgaacgccgccgctatccgagcgatctgtccgatgccagctggcagctcgtcgagccggtcctcgcagcctggcggtgtgagcgtcgcggccgcgggctcgacatcggacggccgccggaccacgaccttcgaagtctgctcgacgcggtcctctacgtgaaccgcaccggcatcccctggcgctacctgccgcacgactacccgcactggaacactgtctacgcctacttcgcccgctggcaggaagaagacatcttcgaccagctcaacaccctcctccgcaggcaggaaggccgagaagaggaaccgaccgcatgcgtcatcgactcccaaagcatcaagacctccaccaacgtccccgcccgcgagcaaggcattgatgccggcaagaagatcgtgggccataagcggaacatcgtcatcgacaccgtcggactcctccgcaccgtcctggtcaccgccgcaagcgtccaggactccatcgccggccagaccctcatcgaccgcatcgcagccgaccatcccaccgtccgtaagacctgggttgacggcggctaccgccaatacctcgtcgaacacgccgccaccctcggcatcgacatgcacatcgtccgccgcgaccccaccaccaggggattcaccgtcctgccccgccgctggaccgtcgagagaaccctcggctggctcatgaaccaccgccggctcgcccgcgactacgaagcccactcccgctgctccgaagccatgatccacctcgcaatgatcaacctcatgacccgcagacctaccgccgaatgcacccccacgtggcgcggagcatga

SEQ ID NO: 606 - DNA, 1332 bp, Unknown
  Bacillus sp. multi
atgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaatagtagaaaaaaagaaatttggagcggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgagtatatccacaaaaataatcggcaagatcaatctacctttgaatgtcagcaatgtagttttaaagttcatgcagactacaatgccgcaaaaaatatttctgtgtacaatattgagaaggtaatacaaaaacaattggagttacaagaaaaattaaatcaaacaaaatataaagaacagtatatagaacaaatgaaaaatattaattaa

SEQ ID NO: 607 - DNA, 1332 bp, Unknown; identical to SEQ ID NO: 606
  Bacillus sp. multi

SEQ ID NO: 608 - DNA, 1332 bp, Unknown; identical to SEQ ID NO: 606
  Bacillus sp. multi

SEQ ID NO: 609 - DNA, 1332 bp, Bacillus cereus; identical to SEQ ID NO: 606

SEQ ID NO: 610 - DNA, 1332 bp, Unknown; identical to SEQ ID NO: 606
  Bacillus sp. multi

SEQ ID NO: 611 - DNA, 1332 bp, Unknown; identical to SEQ ID NO: 606
  Bacillus sp. multi

SEQ ID NO: 612 - DNA, 1362 bp, Unknown
  Bacillus sp. multi
gtgacatatttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagcgaatatgtccactactctacagaaaacaattaggacctggaatagtagaaaaaaagaaatttggagcggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgagtatatccacaaaaataatcggcaagatcaatctacctttgaatgtcagcaatgtagttttaaagttcatgcagactacaatgccgcaaaaaatatttctgtgtacaatattgagaaggtaatacaaaaacaattggagttacaagaaaaattaaatcaaacaaaatataaagaacagtatatagaacaaatgaaaaatattaattaa

SEQ ID NO: 613 - DNA, 813 bp, Unknown
  Bacillus sp. multi
atgaaggtaattttagatagaataattgatagtacatatgccaaaggcgcttgcatgctccataaacataaaaagaaatggtatttatctattacttataagtcaaatataaaagaagaacttaaatttgatgaagatttaattatgggcatagatatggggaaaataaatgttctctattttgcgtttaataaaggtttggtaagagggggaattagtggtgaagaaattgaggcttttcgaaaaaaaattgagcatagacgtataagtttattacgccaaggtaagtattgtagtggaaataggatagggaaaggccgtaaaaaacgaattaaaccaattgaagtactaaatgataaaatagccaagtttagaaatgctacgaatcataagtatgccaattatatagtgcaacagtgcttaaaatataattgtggcactatacaattagaggatttacaaggaataagtaaagaacaaacattcctaaaaaattggacgtattttgatttgcaggaaaaaatcaagaatcaggcaaatcaatatgggattaaagtggtgaaaattgacccatcctatacaagtcaacgatgtagtgaatgtgggtatatccataaaaataatcggcaaaatcaatctacctttgaatgtcagcaatgtagttttaaagttcatgcagactacaatgctgccaaaaacatttctgtgtacaatattgagaaggtaatacaaaaacaattgaagttacaagaaaaattaaatttaacaaaatataaagaacagtatatagagcagatggaaaatattaattaa

SEQ ID NO: 614 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtattcaaaaaacgataagtggatatatttatgatcagttaaaagaagaatatcaagatattaataaagcgaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaaacaaaatagtatgaaggtaattttagatagaataattgatagtacgtatgccaaaggcgcttgcatgctccataaacataaaaagaaatggtatttatctattacttataagtcaaatataaaagaagaacttaaatttgatgaagatttgattatgggtatagatatggggaaaataaatgttctctattttgcgtttaataaaggtttggtacgaggggcaattagtggtgaagaaattgaggcttttcgaaaaaaaattgagcacagacgtataagtttattacgccaaggtaagtattgtagtggaaataggatagggaaaggccgtgaaaaacgaattaaaccaattgacgtactaaatgataaagtagctaaattcagaaatgcaacgaatcataaatacgcaaattatatagtacaacagtgtttaaaatataattgtggcactatacagttagaggatctaaaaggaataagtaaggagcaaacattcctaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgccaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 615 - DNA, 303 bp, Unknown
  Bacillus sp. multi
ttgcaggaaaaaatcaagaatcaagcaaatcaatatggggtgaaagtggtgaaaattgacccatcctatacaagtcaacgatgtagtgaatgtgggtttatccacaaaaataatcggcaagatcaatctacctttgaatgccagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 616 - DNA, 303 bp, Unknown; identical to SEQ ID NO: 615
  Bacillus sp. multi

SEQ ID NO: 617 - DNA, 303 bp, Unknown; identical to SEQ ID NO: 615
  Bacillus sp. multi

SEQ ID NO: 618 - DNA, 303 bp, Unknown; identical to SEQ ID NO: 615
  Bacillus sp. multi

SEQ ID NO: 619 - DNA, 303 bp, Unknown; identical to SEQ ID NO: 615
  Bacillus sp. multi

SEQ ID NO: 620 - DNA, 303 bp, Bacillus thuringiensis; identical to SEQ ID NO: 615

SEQ ID NO: 621 - DNA, 303 bp, Unknown; identical to SEQ ID NO: 615
  Bacillus sp. multi

SEQ ID NO: 622 - DNA, 1332 bp, Unknown
  Bacillus sp. multi
atgaaataccaaatagtttgtcctgtaaatgtagaatggaaagtgtttgaaacatatttacgtacactttcatatcaatctagaactattgggaatagaacaatacaaaaaatatgggaatttgacaatctatcgttgaaacactttaaagagactggtgaatatccaagtgctcaacaattatatggatgtactcagaaaaccataagtggatatatttatgatcagttaaaagaagaatataaagatattaataaagctaatatgtccactactatacagaaaacacttaagaactggaatagtagaaaaaaagaaatatggaggggcgagatgtccattccttcatttcgaagcgatctaccaatcgacatccatgggaactccatacagttaataaaagaaaaaggtggtgattatatcgcaagcgtatcccttttttcatcaaaatttattaaagagaatgatttacctaatggcaaaatcttagtgaaattatctacaagaaaacaaaatagtatgaaggtaattttagatagattaattaatagtacatactccaaaggtgcttgcatgctccataaacataaaaagaaatggtatttatctattacttataagtcaaatataaaagaagaacttaaatttgatgaagatttaattatgggcatagatatggggaaaataaatgttctctattttgcgtttaataaaagtttggtaagaggggcaattagtggtgaagaaattgaggcttttcgaaaaaaaattgagcacagacgtataagtttattgcgccaaggtaagtattgtagtggaaataggatagggaaaggccgtgaaaaacgaattaaaccaattgatgtactaaatgataaagtagctaaattcagaaatgcaacgaatcataaatacgcaaattatatagtacaacagtgtttaaaatataattgtggcactatacagttagaggatctaaaaggaataagcaaggagcaaacattcctgaagaattggacgtattttgatttgcaagaaaaaatcaaaaatcaggcaaatcaatatggagttaaagtggtgaaaattgacccatcctatacaagtcaacgatgtagtgaatgtgggtatatccacaaagataatcggcaagatcaatctacctttgaatgtctgcaatgtagttttaaagttcatgcagactacaatgccgcaaaaaacatttctgtgtacaatattgagaaggtaatacaaaaacaattggagttacaagaaaaattaaatctaacaaaatataaagaacattatatagaacaaatgaaaaatattaattaa

SEQ ID NO: 623 - DNA, 1353 bp, Unknown
  Bacillus sp. multi
ttgagcatagctgtaaaagtaatgaaataccaaatagtctgtcctgtaaatatagaatggaagacgtttgaaatatatttacgtacactttcatatcattttagaactattgggaatagaactatacaaaaattgtgggaatatgataatcaatcattgaagcattttaaagatactggccaatatccaagtgcccaacaattatatgggtgtactcaaaaaacgataagtggatatatttatgatcagttaaaagaagaatatcaagatattaataaagccaatatgtccactactctacagaaaacaattaggacctggaatagtagaaaaaaagaaatttggagtggtgagatgtccattccttcattccgaaacaatttaccaattgatattcatggaaactctattcagataataaaagaaaagagtggtgattatattgcaagcgtatctcttttttcatcaaaatttataaaagaaaacgatttacccaatggtaaaatcttagtgaaattatcgacaagaaagcaaaatagtatgaaggtaattttagatagaataattgatagtacgtatgccaaaggcgcttgcatgctccataaacataaaaagaaatggtatttatctattacttataagtcaaatataaaagaagaacttaaattttatcaagatttgattatgggtatagatatggggaaaataaatgttctctattttgcgtttaataaaggtttggtacgaggggcaattagtggtgaagaaattgaggcttttcgaaaaaaaattgagcacagacgtataagtctattacgccaaggtaagtattgtagtggaaataggatagggaaaggccgtgaaaaacgaattaaaccaattgatgtactaaatgataaagtagctaaattcagaaatgcaacgaatcataaatacgcaaattatatagtacaacagtgtttaaaatatcattgtagcactatacagttagaggatctaaaaggaataagtaaggagcaaacattactaaaaaattggacgtattttgatttgcaggaaaaaatcaagaatcaagcaaatcaatatggggtgaaagtggtgaaaattgacccatcctatacaagtcaacgatgtagtgaatgtgggtatatccacaaaaataatcggcaagatcaatctacctttgaatgtcagcaatgtagttttaaagttcatgcagactacaatgccgcaaaaaacatttctgtgtacaatattgagaaggtaatacaaaaacaattggagttacaagaaaaattaaatcaaacaaaatataaagaacagtatatagaacaaatgaaaaatattaattaa

SEQ ID NO: 624 - DNA, 594 bp, Unknown
  Paenibacillus thiaminolyticus (multi)
atggggaagagacgctggaccgccagtcgccaatttcgccagttgttagccaatgaaacgatgttcggctcggaactcctgaattttgaatatgtccttattgatgtagcccgatattcagaagaagagttgttggctctttccaatacgatcggttctgtctttttgcttgatcagacagcggatcaggcggagttgctggatcggctcggcaagctgatgcatacgatacagcaattgccagaggacagccagcagcaattggtcgcctggatggctaatatattaagtcagaaattaccggaaaatgaaccgcagttacgcgagcttattcaaaacgtaaaaggaggcgtatcggttatgggacttgaaaaaaccttggatgccattaagcgcgagggaagacgtgaaggcagaagagaaggtcttcgtcagggtctgcaagaaggtatacgagaaggcaaacaagaaggcaaacgtgaagcaaaaaaagaagttgtcaagcaaatgatcgccgaagacttggatcccgaattgatcgccagagtcacggggttttcattggagatgatcacacaattaagagaacaatag

SEQ ID NO: 625 - DNA, 687 bp, Unknown
  Paenibacillus lentimorbus (multi)
atgccataccgcctgctgctttatcaggttgagatctggcggtatcttatgaaagatcaggaaaaaacgaagggcaaaccgaagacattccggctgcctcccattgtgccaattgtgctgtacaatgggaagagacgctggaccgccagtcgccaatttcgccagttgttagccaatgaaacgatgttcggctcggaactcttgaattttgaatatgtccttattgatgttgctcgatatacagaagaagagccgttggctctttccaatacgatcggttcagtctttttacttgatcagacagtggatcaggcggaattgctggatcggctcggcaagctgatgcatacgatacagcaattgccagaggacagccagcagcaattggtcgcctggatggcgaatatattaagtcataaattaccagaaaatgaaccgcagttgcgcgatcttatccaaaatgtaaaaggaggcgtatcggttatgggacttgaaaaaaccttggatgccattaagcgtgaaggcagacgcgagggcagaagagaaggtaaacaagaaggcaagcgtgaagcaaaagaagaagttgtcaagcaaatgatcgccgaagacttggatcctgaattgatcgccagagtcacgggctttccattagatattatcacgcagttaaagaaacaatcccattga

SEQ ID NO: 626 - DNA, 603 bp, Unknown
  Paenibacillus thiaminolyticus (multi)
atgagagatcaggaaaatgcgaagggcaagcctaaaacatttcggctgcctcccattgtgccgattgtgttatacaatggaaagaggcgctggaccgccagtcgccaatttcgccagttgttagccaatgaaacgatgttcggttcggaactcctgaattttgaatatgtccttattgatgttgcacgatatacagaagaagagttgttggctctttccaatacgattggttctgtgtttttgcttgatcagacggcggatcagacggaattactgaatcggctcggcaagctgatgcataccatacagcaattgccagaggaaagccagcagcaattggtcgcctggatggcgaatatattaagtcagaaattgccggaaaatgaaccgcagttgcgtgagcttatccaaaacgtaaaaggaggcgtatcggttatggggcttgaaaaaaccttggatgccattaagcgtgagggcaagcgtgaagccaaagaagaagttgttaagcaaatgattgccgaagatctggatcctgaattgatcgcgagggtaacaggcttcccagtagatattatcgcaaagttaagggaacaatcccattga

SEQ ID NO: 627 - DNA, 450 bp, Unknown
  Stenotrophomonas sp. multi
atggcaagccccagactccgctacggtcgctactcccgcacgggaaatgtctattccctgaccacgacaacacacggccgggagccattcttctccgacgcaggcaatgtcgctgtgctggtggacgcgctgcgcttcgtcgaacgcagcggcatcagccacagcctcgcctgggtggtgatgcccgaccacctgcactggttgatggaactgcagaagggaacgctggcccagtgcatggcgttgctgaaatcacgcagcagccggcagctgaaccggatatcgggacgaaaagggccgctctggcagcacggctatcacgaccatgcggtgcgtaccgatgaatcccttcatgacaacgcgatgtacatcctgggcaatccggtgcgggccggattggctggtgggctgggggactaccctcacgcctggtgtcgttggccgttgtag

SEQ ID NO: 628 - DNA, 474 bp, Unknown
  Bacillus sp. multi
tttttttcgcatctgttaaagtatctatctttatttcatcggggtttagtattaacataagatgtatttagatatttgatacactgtcgtttcaaagtactcaccgtgtttagtattattagatcgtaacgcaatgaaattaacataagatgtatttaaatattcctcccttgaggtcaatcaaagtgaatttaacgtttaacattaacataagatgtatttaaattatctacgtattcttgatatcttcctaaattaaaacgtttaacattaacataagatgtatttaaatatttcaacggtgttatcatcaatttctctttcttcagtttagtactaacataagatgtatttaaattcggtttggcatgggtcatgcacacgctgaaaattcgtttaaaactaacataagatatatttacatatgtttacaaaaattattaaactaagttaagaatgtatacttatctcctt

SEQ ID NO: 629 - DNA, 474 bp, Unknown; identical to SEQ ID NO: 628
  Bacillus sp. multi

SEQ ID NO: 630 - DNA, 320 bp, Unknown
  Bacillus sp. multi
ccgtgtttagtattaacataagatgtatttagatcgtaacgcaatgaaattaacataagatgtatttaaatattcctcccttgaggtcaatcaaagtgaatttaacgtttaacattaacataagatgtatttaaatatttcaacggtgttatcatcaatttctctttcttcagtttagtactaacataagatgtatttaaattcggtttggcatgggtcatgcacacgctgaaaattcgtttaaaactaacataagatatatttacatatgtttacaaaaattattaaactaagttaagaatgtatacttatctccttca

SEQ ID NO: 631 - DNA, 514 bp, Unknown
  Bacillus sp. multi
tttttcgcatctgttaaagtatctatctttattttatcggggtttggtactaacataagatgtatttaaattggtacaatagaccaagacattaagtaaaataataagtttgtactaacataagatgtatttaaatggtgtcattttaccatttaaggataagttccctaaaagtttagtactaacacaagatgtatttaaatgagtctagtcagtaactcagtagtttgtccctcgtgtttaacattaacataagatgtatttaaataattgagcttaatcctaacgatgataaggtctttgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 632 - DNA, 514 bp, Unknown; identical to SEQ ID NO: 631
  Bacillus sp. multi

SEQ ID NO: 633 - DNA, 514 bp, Unknown; identical to SEQ ID NO: 631
  Bacillus sp. multi

SEQ ID NO: 634 - DNA, 514 bp, Unknown; identical to SEQ ID NO: 631
  Bacillus sp. multi

SEQ ID NO: 635 - DNA, 514 bp, Unknown; identical to SEQ ID NO: 631
  Bacillus sp. multi

SEQ ID NO: 636 - DNA, 514 bp, Unknown; identical to SEQ ID NO: 631
  Bacillus sp. multi

SEQ ID NO: 637 - DNA, 514 bp, Unknown; identical to SEQ ID NO: 631
  Bacillus sp. multi

SEQ ID NO: 638 - DNA, 514 bp, Unknown; identical to SEQ ID NO: 631
  Bacillus sp. multi

SEQ ID NO: 639 - DNA, 514 bp, Unknown; identical to SEQ ID NO: 631
  Bacillus sp. multi

SEQ ID NO: 640 - DNA, 514 bp, Unknown; identical to SEQ ID NO: 631
  Bacillus sp. multi

SEQ ID NO: 641 - DNA, 514 bp, Unknown; identical to SEQ ID NO: 631
  Bacillus sp. multi

SEQ ID NO: 642 - DNA, 514 bp, Unknown; identical to SEQ ID NO: 631
  Bacillus sp. multi

SEQ ID NO: 643 - DNA, 514 bp, Unknown; identical to SEQ ID NO: 631
  Bacillus sp. multi

SEQ ID NO: 644 - DNA, 514 bp, Unknown; identical to SEQ ID NO: 631
  Bacillus sp. multi

SEQ ID NO: 645 - DNA, 514 bp, Unknown; identical to SEQ ID NO: 631
  Bacillus sp. multi

SEQ ID NO: 646 - DNA, 318 bp, Unknown
  Bacillus sp. multi
tatcagattttttccatatctgttaaagtatccatctgtatttcatcggggtttaacactaacataagatgtatttaaatattcgttgaataataaaatcattaacaagcacggtgtttaacactaacataagatgtatttaaatagttcatgaggctttttcattaaaacccatgttggtttaacactaacataagatgtatttaaattgctcatgtaatcaatttcactcccattactttccgtttaacataggatttatttaaactatcaacacgaatcttttttaaaggaataaaaattaaactaagttaagaa

SEQ ID NO: 647 - DNA, 621 bp, Unknown
  Bacillus sp. multi
tttaaataatatgttgccgtctaaacgctgaattatttcaaagataatgttagcatttggtttatttaaattaggtcttttgtcttggtgattctctacactacgactagttaatgttagcatttggtgtatttaaattagatattttatatcattaaaaagattcattgttggcttagctttaacattggatgcatttgaattagctctattgcaaataatttagattgaaattttcgtttaacattaatataagatgtatttaaatcctcaaaagaatcttattttaaaaaatccatagcgtttaacatcaacataagatgtatttaaattcgtgtatgtaatcaccatcaatatcccgatattcgtttaccattagcataagatgtatttaaatgagtacctatgaggtagctaatgccctccctcattgtttagtactaacataagatgtatttaaattcggtttggcatggttcatgcacacgccgaaaattcgtttaaaactaacataagatatatttacatatgtttacaaaagttattaaactaagttaagaatgtatactaatctccttcacaaatcgtgaagggatttttttattcaaaagatacaaaatg

SEQ ID NO: 648 - DNA, 580 bp, Unknown
  Bacillus sp. multi
atttaaataatatgttgccgtctaaacgctgaattatttcaaagataatgttagcattaggtttatttaaattaggtcttttgtcttggtgattctctacactacgactagttaatgttagcatttggtgtatttaaattagatattttatatcattaaaaagattcattgttggcttagctttaacattggatgcatttgaattagctctattgcaaataatttagattgaaattttcgtttaacattaatataagatgtatttaaatcctcaaaagaatcttattttaaaaaatccatagcgtttaacatcaacataagatgtatttaaattcgtgtatgtaatcaccatcaatatcccgatattcgtttaccattagcataagatgtatttaaatgagtacctatgaggtagctaatgactccccctcattgtttagtactaacataagatgtatttaaattcggtttggcatgggtcatgcacacgccgaaagttcgtttaaaactaacataagatatatttacatatgtttacaaaagttattaaactaagttaagaatgtatactgatctcctt

SEQ ID NO: 649 - DNA, 579 bp, Unknown
  Bacillus sp. multi
atttaaataatatgttgccgtctaaacgctgaattatttcaaagataatgttagcatttggtgtatttaaattaggtcttttgtcttggtgattctctacactacgactagttaatgttagcatttggtgtatttaaattagatattttatatcattaaaaagattcattgttggcttagctttaacattggatgcatttgaattagctctattgcaaataatttagattgaaattttcgtttaacattaatataagatgtatttaaatcctcaaaagaatcttattttaaaaaatccatagcgtttaacatcaacataagatgtatttaaattcgtgtatgtaatcaccatcaatatcccgatattcgtttaccattagcataagatgtatttaaatgagtacctatgaggtagctaatgccctccctcattgtttagtactaacataagatgtatttaaattcggtttggcatgggtcatgcacacgccgaaaattcgtttaaaactaacataagatatatttacatatgtttacaaaagttattaaactaagttaagaatgtatactgatctcctt

SEQ ID NO: 650 - DNA, 579 bp, Bacillus thuringiensis; identical to SEQ ID NO: 649

SEQ ID NO: 651 - DNA, 579 bp, Bacillus thuringiensis; identical to SEQ ID NO: 649

SEQ ID NO: 652 - DNA, 514 bp, Unknown
  Bacillus sp. multi
tttttcgcatctgttaaagtatctatctttattttatcggggtttggtactaacataagatgtatttaaattggtacaatagacctagacattaagtaaaatgataagtttgtactaacataagatgtatttaaatggtgtcattttaccatttaaggataagttccctaaaagtttagtactaacacaagatgtatttaaatgagtctagtcagtaactcagtagtttgtccctcgtgtttaacattaacataagatgtatttaaataattgagcttaatcctaacgatgataaggtctttgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 653 - DNA, 579 bp, Bacillus thuringiensis; identical to SEQ ID NO: 649

SEQ ID NO: 654 - DNA, 579 bp, Unknown; identical to SEQ ID NO: 649
  Bacillus sp. multi

SEQ ID NO: 655 - DNA, 318 bp, Unknown
  Bacillus sp. multi
tttttcgcatctgttaaagtatctatctttattttatcggggtttggtactaacataagatgtatttaaattggtacaatagacctagacattaagtaaaatgataagtttgtactaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 656 - DNA, 514 bp, Unknown; identical to SEQ ID NO: 652
  Bacillus sp. multi

SEQ ID NO: 657 - DNA, 514 bp, Unknown; identical to SEQ ID NO: 652
  Bacillus sp. multi

SEQ ID NO: 658 - DNA, 517 bp, Unknown
  Bacillus sp. multi
gttttttcgcatctgttaaagtatctatctttattttatcggggtttggtactaacataagatgtatttaaattggtacaatagacctagacattaagtaaaatgataagtttgtactaacataagatgtatttaaatgcaggggttcgctaacggtacacctgatatagaaggtttagtactaacataagatgtatttaaatggtgtcattttaccatttaaggataagtttcctaaaagtttagtactaacacaagatgtatttaaatgagtctagtcagtaactcagtagtttgtccctcgtgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 659 - DNA, 318 bp, Unknown; identical to SEQ ID NO: 655
  Bacillus sp. multi

SEQ ID NO: 660 - DNA, 318 bp, Unknown; identical to SEQ ID NO: 655
  Bacillus sp. multi

SEQ ID NO: 661 - DNA, 514 bp, Unknown; identical to SEQ ID NO: 652
  Bacillus sp. multi

SEQ ID NO: 662 - DNA, 450 bp, Unknown
  Bacillus sp. multi
tttttcgcatctgttaaagtatctatctttattttatcggggtttggtactaacataagatgtatttaaatgcaggggttcgctaacggtacacctgatatagaaggtttagtactaacataagatgtatttaaatggtgtcattttaccatttaaggataagtttcctaaaagtttagtactaacacaagatgtatttaaatgagtctagtcagtaactcagtagtttgtccctcgtgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 663 - DNA, 514 bp, Unknown; identical to SEQ ID NO: 652
  Bacillus sp. multi

SEQ ID NO: 664 - DNA, 453 bp, Unknown
  Bacillus sp. multi
agttttttcgcatctgttaaagtatctatctttattttatcggggtttggtactaacataagatgtatttaaattggtacaatagacctagacattaagtaaaatgataagtttgtactaacataagatgtatttaaatgcaggggttcgctaacggtacacctgatatagaaggtttagtactaacataagatgtatttaaatggtgtcattttaccatttaaggataagtttcctaaaagtttagtactaacacaagatgtatttaaatgagtctagtcagtaactcagtagtttgtccctcgtgtttaccagtaacataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 665 - DNA, 517 bp, Unknown
  Bacillus sp. multi
gttttttcgcatctgttaaagtatctatctttattttatcggggtttggtactaacataagatgtatttaaattggtacaatagacctagacattaagtaaaatgataagtttgtactaacataagatgtatttaaatgcaggggttcgctaacggtacacctgatatagaaggtttagtactaacataagatgtatttaaatggtgtcattttaccatttaaggataagttccctaaaagtttagtactaacacaagatgtatttaaatgagtctagtcagtaactcagtagtttgtccctcgtgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 666 - DNA, 517 bp, Unknown; identical to SEQ ID NO: 665
  Bacillus sp. multi

SEQ ID NO: 667 - DNA, 581 bp, Unknown
  Bacillus sp. multi
gttttttcgcatctgttaaagtatctatctttattttatcggggtttggtactaacataagatgtatttaaattggtacaatagacctagacattaagtaaaatgataagtttgtactaacataagatgtatttaaatgcaggggttcgctaacggtacacctgatatagaaggtttagtactaacataagatgtatttaaatggtgtcattttaccatttaaggataagttccctaaaagtttagtactaacacaagatgtatttaaatgagtctagtcagtaactcagtagtttgtccctcgtgtttaacattaacataagatgtatttaaataattgagcttaatcctaacgatgataaggtctttgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 668 - DNA, 450 bp, Unknown
  Bacillus sp. multi
tttttcgcatctgttaaagtatctatctttattttatcggggtttggtactaacataagatgtatttaaattggtacaatagacctagacattaagtaaaatgataagtttgtactaacataagatgtatttaaatggtgtcattttaccatttaaggataagttccctaaaagtttagtactaacacaagatgtatttaaatgagtctagtcagtaactcagtagtttgtccctcgtgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 669 - DNA, 517 bp, Unknown; identical to SEQ ID NO: 658
  Bacillus sp. multi

SEQ ID NO: 670 - DNA, 517 bp, Unknown; identical to SEQ ID NO: 658
  Bacillus sp. multi

SEQ ID NO: 671 - DNA, 517 bp, Unknown; identical to SEQ ID NO: 658
  Bacillus sp. multi

SEQ ID NO: 672 - DNA, 517 bp, Unknown; identical to SEQ ID NO: 658
  Bacillus sp. multi

SEQ ID NO: 673 - DNA, 517 bp, Unknown; identical to SEQ ID NO: 658
  Bacillus sp. multi

SEQ ID NO: 674 - DNA, 517 bp, Unknown; identical to SEQ ID NO: 658
  Bacillus sp. multi

SEQ ID NO: 675 - DNA, 517 bp, Unknown; identical to SEQ ID NO: 665
  Bacillus sp. multi

SEQ ID NO: 676 - DNA, 318 bp, Unknown; identical to SEQ ID NO: 655
  Bacillus sp. multi

SEQ ID NO: 677 - DNA, 581 bp, Unknown; identical to SEQ ID NO: 667
  Bacillus sp. multi

SEQ ID NO: 678 - DNA, 580 bp, Unknown; identical to SEQ ID NO: 648
  Bacillus sp. multi

SEQ ID NO: 679 - DNA, 580 bp, Unknown; identical to SEQ ID NO: 648
  Bacillus sp. multi

SEQ ID NO: 680 - DNA, 457 bp, Unknown
  Bacillus sp. multi
tatcaggttttttccatatttgttaaagtatctatctgtatttcatcggggtttaacactaacataagatgtatttaaatgggacacttttccataattccaatattccatgaaagtttaacactaacataagatgtatttaaataatgaggtcaaacggtgtcattcacggacattttcgtttaacactaacataagatgtatttaaattcatgagttcgataaactttttagctccgtctcggaggttaatactaacataagatgtatttaagtatgtataaaatctttgctccaaagaatgttgaccatgtttaacactgacataagatgtatttaaattttagcatggacggactatatttgttttttaatgtgtttacaccattaatatgatgtatttaaatgttacggttactaattgttcagcactcaaacgataagaaagtgaatttta

SEQ ID NO: 681 - DNA, 457 bp, Unknown; identical to SEQ ID NO: 680
  Bacillus sp. multi

SEQ ID NO: 682 - DNA, 457 bp, Unknown; identical to SEQ ID NO: 680
  Bacillus sp. multi

SEQ ID NO: 683 - DNA, 457 bp, Unknown; identical to SEQ ID NO: 680
  Bacillus sp. multi

SEQ ID NO: 684 - DNA, 457 bp, Unknown; identical to SEQ ID NO: 680
  Bacillus sp. multi

SEQ ID NO: 685 - DNA, 457 bp, Unknown; identical to SEQ ID NO: 680
  Bacillus sp. multi

SEQ ID NO: 686 - DNA, 457 bp, Unknown
  Bacillus sp. multi
tatcaggttttttccatatttgttaaagtatctatctgtatttcatcggggtttaacactaacataagatgtatttaaatgggacacttttccataattccaatattccatgaaagtttaacactaacataagatgtatttaaataatgaggtcaaacggtgtcattcacggacattttcgtttaacactaacataagatgtatttaaattcatgagttcgataaactttttagctccgtctcggaggtgaatactaacataagatgtatttaagtatgtataaaatctttgctccaaagaatgttgaccatgtttaacactgacataagatgtatttaaattttagcatggacggactatatttgttttttaatgtgtttacaccattaatatgatgtatttaaatgttacggttactaattgttcagcactcaaacgataagaaagtgaatttta

SEQ ID NO: 687 - DNA, 383 bp, Unknown
  Bacillus sp. multi
ttttttccatatttgttaaagtatctatctgtatttcatcggggtttaacactaacataagatgtatttaaataatgaggtcaaacggtgtcattcacggacattttcgtttaacactaacataagatgtatttaaattcatgagttcgataaactttttagctccgtctcggaggtgaatactaacataagatgtatttaagtatgtataaaatctttgctccaaagaatgttgaccatgtttaacactgacataagatgtatttaaattttagcatggacggactatatttgttttttaatgtgtttacaccattaatatgatgtatttaaatgttacggttactaattgttcagcactcaaacgataagaaagtgaattt

SEQ ID NO: 688 - DNA, 383 bp, Unknown; identical to SEQ ID NO: 687
  Bacillus sp. multi

SEQ ID NO: 689 - DNA, 314 bp, Unknown
  Bacillus sp. multi
tttccgaatttgttaaagtaactatctttatttcattggagcttaacattaacataagatgtatttaaatcctcaaaagaatcttatttaaaaaaatccatagctcttaacattaacataagatgtatttaaattctcggaagtaattctcatcaatttcttctgtctccgtttaacatcaacataagatgtatttaaatccttcctagttaatgatgtaggagaaaaagtcctgtttaaaattaagataagatgtatttaaataaacgattgctacattttttcaattatttaaatatgtttacaaaaagaat

SEQ ID NO: 690 - DNA, 514 bp, Unknown
  Bacillus sp. multi
tttttcgcatctgttaaagtatctatctttattttatcggggtttggtactaacataagatgtatttaaattggtacaatagacctagacattaagtaaaataataagtttgtactaacataagatgtatttaaatggtgtcattttaccatttaaggataagttccctaaaagtttagtactaacacaagatgtatttaaatgagtctagtcagtaactcagtagtttgtccctcgtgtttaacattaacataagatgtatttaaataattgagcttaatcctaacgatgataaggtctttgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 691 - DNA, 514 bp, Unknown; identical to SEQ ID NO: 690
  Bacillus sp. multi

SEQ ID NO: 692 - DNA, 514 bp, Unknown; identical to SEQ ID NO: 690
  Bacillus sp. multi

SEQ ID NO: 693 - DNA, 514 bp, Unknown; identical to SEQ ID NO: 690
  Bacillus sp. multi

SEQ ID NO: 694 - DNA, 514 bp, Unknown; identical to SEQ ID NO: 690
  Bacillus sp. multi

SEQ ID NO: 695 - DNA, 457 bp, Unknown; identical to SEQ ID NO: 686
  Bacillus sp. multi

SEQ ID NO: 696 - DNA, 383 bp, Unknown; identical to SEQ ID NO: 687
  Bacillus sp. multi

SEQ ID NO: 697 - DNA, 383 bp, Unknown; identical to SEQ ID NO: 687
  Bacillus sp. multi

SEQ ID NO: 698 - DNA, 457 bp, Unknown; identical to SEQ ID NO: 686
  Bacillus sp. multi

SEQ ID NO: 699 - DNA, 457 bp, Unknown; identical to SEQ ID NO: 686
  Bacillus sp. multi

SEQ ID NO: 700 - DNA, 457 bp, Unknown; identical to SEQ ID NO: 686
  Bacillus sp. multi

SEQ ID NO: 701 - DNA, 457 bp, Unknown; identical to SEQ ID NO: 686
  Bacillus sp. multi

SEQ ID NO: 702 - DNA, 457 bp, Unknown; identical to SEQ ID NO: 686
  Bacillus sp. multi

SEQ ID NO: 703 - DNA, 383 bp, Unknown; identical to SEQ ID NO: 687
  Bacillus sp. multi

SEQ ID NO: 704 - DNA, 457 bp, Unknown; identical to SEQ ID NO: 686
  Bacillus sp. multi

SEQ ID NO: 705 - DNA, 457 bp, Unknown; identical to SEQ ID NO: 686
  Bacillus sp. multi

SEQ ID NO: 706 - DNA, 457 bp, Unknown; identical to SEQ ID NO: 686
  Bacillus sp. multi

SEQ ID NO: 707 - DNA, 457 bp, Unknown; identical to SEQ ID NO: 686
  Bacillus sp. multi

SEQ ID NO: 708 - DNA, 383 bp, Unknown; identical to SEQ ID NO: 687
  Bacillus sp. multi

SEQ ID NO: 709 - DNA, 457 bp, Unknown; identical to SEQ ID NO: 686
  Bacillus sp. multi

SEQ ID NO: 710 - DNA, 457 bp, Unknown; identical to SEQ ID NO: 686
  Bacillus sp. multi

SEQ ID NO: 711 - DNA, 457 bp, Unknown; identical to SEQ ID NO: 686
  Bacillus sp. multi

SEQ ID NO: 712 - DNA, 383 bp, Unknown
  Bacillus sp. multi
ttttttccatatttgttaaagtatctatctgtatttcatcggggtttaacactaacataagatgtatttaaatgggacacttttccataattccaatgttccatgaaagtttaacactaacataagatgtatttaaattcatgagttcgataaactttttagctccgtctcggaggttaatactaacataagatgtatttaagtatgtataaaatctttgctccaaagaatgttgaccatgtttaacactgacataagatgtatttaaattttagcatggacggactatatttgttttttaatgtgtttacaccattaatatgatgtatttaaatgttacggttactaattgttcagcactcaaacgataagaaagtgaattt

SEQ ID NO: 713 - DNA, 457 bp, Unknown; identical to SEQ ID NO: 686
  Bacillus sp. multi

SEQ ID NO: 714 - DNA, 457 bp, Unknown; identical to SEQ ID NO: 686
  Bacillus sp. multi

SEQ ID NO: 715 - DNA, 457 bp, Unknown; identical to SEQ ID NO: 686
  Bacillus sp. multi

SEQ ID NO: 716 - DNA, 457 bp, Unknown; identical to SEQ ID NO: 686
  Bacillus sp. multi

SEQ ID NO: 717 - DNA, 457 bp, Unknown; identical to SEQ ID NO: 686
  Bacillus sp. multi

SEQ ID NO: 718 - DNA, 383 bp, Unknown; identical to SEQ ID NO: 687
  Bacillus sp. multi

SEQ ID NO: 719 - DNA, 457 bp, Unknown; identical to SEQ ID NO: 686
  Bacillus sp. multi

SEQ ID NO: 720 - DNA, 457 bp, Unknown; identical to SEQ ID NO: 686
  Bacillus sp. multi

SEQ ID NO: 721 - DNA, 457 bp, Unknown; identical to SEQ ID NO: 686
  Bacillus sp. multi

SEQ ID NO: 722 - DNA, 457 bp, Bacillus thuringiensis; identical to SEQ ID NO: 686

SEQ ID NO: 723 - DNA, 457 bp, Unknown; identical to SEQ ID NO: 686
  Bacillus sp. multi

SEQ ID NO: 724 - DNA, 457 bp, Unknown; identical to SEQ ID NO: 686
  Bacillus sp. multi

SEQ ID NO: 725 - DNA, 457 bp, Unknown; identical to SEQ ID NO: 686
  Bacillus sp. multi

SEQ ID NO: 726 - DNA, 457 bp, Unknown; identical to SEQ ID NO: 686
  Bacillus sp. multi

SEQ ID NO: 727 - DNA, 457 bp, Unknown; identical to SEQ ID NO: 686
  Bacillus sp. multi

SEQ ID NO: 728 - DNA, 457 bp, Unknown; identical to SEQ ID NO: 686
  Bacillus sp. multi

SEQ ID NO: 729 - DNA, 457 bp, Unknown; identical to SEQ ID NO: 686
  Bacillus sp. multi

SEQ ID NO: 730 - DNA, 457 bp, Unknown; identical to SEQ ID NO: 686
  Bacillus sp. multi

SEQ ID NO: 731 - DNA, 457 bp, Unknown; identical to SEQ ID NO: 686
  Bacillus sp. multi

SEQ ID NO: 732 - DNA, 457 bp, Unknown; identical to SEQ ID NO: 686
  Bacillus sp. multi

SEQ ID NO: 733 - DNA, 457 bp, Unknown; identical to SEQ ID NO: 686
  Bacillus sp. multi

SEQ ID NO: 734 - DNA, 383 bp, Unknown; identical to SEQ ID NO: 687
  Bacillus sp. multi

SEQ ID NO: 735 - DNA, 457 bp, Unknown; identical to SEQ ID NO: 686
  Bacillus sp. multi

SEQ ID NO: 736 - DNA, 457 bp, Unknown; identical to SEQ ID NO: 686
  Bacillus sp. multi

SEQ ID NO: 737 - DNA, 457 bp, Unknown; identical to SEQ ID NO: 686
  Bacillus sp. multi

SEQ ID NO: 738 - DNA, 457 bp, Unknown; identical to SEQ ID NO: 686
  Bacillus sp. multi

SEQ ID NO: 739 - DNA, 383 bp, Unknown; identical to SEQ ID NO: 687
  Bacillus sp. multi

SEQ ID NO: 740 - DNA, 457 bp, Unknown; identical to SEQ ID NO: 686
  Bacillus sp. multi

SEQ ID NO: 741 - DNA, 457 bp, Unknown; identical to SEQ ID NO: 686
  Bacillus sp. multi

SEQ ID NO: 742 - DNA, 383 bp, Unknown; identical to SEQ ID NO: 687
  Bacillus sp. multi

SEQ ID NO: 743 - DNA, 457 bp, Unknown; identical to SEQ ID NO: 686
  Bacillus sp. multi

SEQ ID NO: 744 - DNA, 457 bp, Unknown; identical to SEQ ID NO: 686
  Bacillus sp. multi

SEQ ID NO: 745 - DNA, 457 bp, Unknown; identical to SEQ ID NO: 686
  Bacillus sp. multi

SEQ ID NO: 746 - DNA, 457 bp, Unknown; identical to SEQ ID NO: 686
  Bacillus sp. multi

SEQ ID NO: 747 - DNA, 383 bp, Unknown; identical to SEQ ID NO: 687
  Bacillus sp. multi

SEQ ID NO: 748 - DNA, 383 bp, Unknown; identical to SEQ ID NO: 687
  Bacillus sp. multi

SEQ ID NO: 749 - DNA, 457 bp, Unknown; identical to SEQ ID NO: 686
  Bacillus sp. multi

SEQ ID NO: 750 - DNA, 457 bp, Unknown; identical to SEQ ID NO: 686
  Bacillus sp. multi

SEQ ID NO: 751 - DNA, 457 bp, Unknown; identical to SEQ ID NO: 686
  Bacillus sp. multi

SEQ ID NO: 752 - DNA, 457 bp, Unknown; identical to SEQ ID NO: 686
  Bacillus sp. multi

SEQ ID NO: 753 - DNA, 457 bp, Unknown; identical to SEQ ID NO: 686
  Bacillus sp. multi

SEQ ID NO: 754 - DNA, 383 bp, Unknown; identical to SEQ ID NO: 687
  Bacillus sp. multi

SEQ ID NO: 755 - DNA, 457 bp, Unknown; identical to SEQ ID NO: 686
  Bacillus sp. multi

SEQ ID NO: 756 - DNA, 457 bp, Unknown; identical to SEQ ID NO: 686
  Bacillus sp. multi

SEQ ID NO: 757 - DNA, 457 bp, Unknown; identical to SEQ ID NO: 686
  Bacillus sp. multi

SEQ ID NO: 758 - DNA, 383 bp, Unknown; identical to SEQ ID NO: 687
  Bacillus sp. multi

SEQ ID NO: 759 - DNA, 457 bp, Unknown; identical to SEQ ID NO: 686
  Bacillus sp. multi

SEQ ID NO: 760 - DNA, 457 bp, Unknown; identical to SEQ ID NO: 686
  Bacillus sp. multi

SEQ ID NO: 761 - DNA, 457 bp, Unknown; identical to SEQ ID NO: 686
  Bacillus sp. multi

SEQ ID NO: 762 - DNA, 457 bp, Unknown; identical to SEQ ID NO: 686
  Bacillus sp. multi

SEQ ID NO: 763 - DNA, 457 bp, Unknown; identical to SEQ ID NO: 686
  Bacillus sp. multi

SEQ ID NO: 764 - DNA, 457 bp, Unknown; identical to SEQ ID NO: 686
  Bacillus sp. multi

SEQ ID NO: 765 - DNA, 457 bp, Unknown; identical to SEQ ID NO: 686
  Bacillus sp. multi

SEQ ID NO: 766 - DNA, 457 bp, Unknown; identical to SEQ ID NO: 686
  Bacillus sp. multi

SEQ ID NO: 767 - DNA, 457 bp, Unknown; identical to SEQ ID NO: 686
  Bacillus sp. multi

SEQ ID NO: 768 - DNA, 457 bp, Unknown; identical to SEQ ID NO: 686
  Bacillus sp. multi

SEQ ID NO: 769 - DNA, 457 bp, Unknown; identical to SEQ ID NO: 686
  Bacillus sp. multi

SEQ ID NO: 770 - DNA, 457 bp, Unknown; identical to SEQ ID NO: 686
  Bacillus sp. multi

SEQ ID NO: 771 - DNA, 457 bp, Unknown; identical to SEQ ID NO: 686
  Bacillus sp. multi

SEQ ID NO: 772 - DNA, 457 bp, Unknown; identical to SEQ ID NO: 686
  Bacillus sp. multi

SEQ ID NO: 773 - DNA, 457 bp, Unknown; identical to SEQ ID NO: 680
  Bacillus sp. multi

SEQ ID NO: 774 - DNA, 457 bp, Unknown; identical to SEQ ID NO: 686
  Bacillus sp. multi

SEQ ID NO: 775 - DNA, 457 bp, Unknown; identical to SEQ ID NO: 686
  Bacillus sp. multi

SEQ ID NO: 776 - DNA, 457 bp, Unknown; identical to SEQ ID NO: 686
  Bacillus sp. multi

SEQ ID NO: 777 - DNA, 383 bp, Unknown; identical to SEQ ID NO: 712
  Bacillus sp. multi

SEQ ID NO: 778 - DNA, 457 bp, Unknown; identical to SEQ ID NO: 686
  Bacillus sp. multi

SEQ ID NO: 779 - DNA, 457 bp, Unknown; identical to SEQ ID NO: 686
  Bacillus sp. multi

SEQ ID NO: 780 - DNA, 457 bp, Unknown; identical to SEQ ID NO: 686
  Bacillus sp. multi

SEQ ID NO: 781 - DNA, 457 bp, Unknown; identical to SEQ ID NO: 686
  Bacillus sp. multi

SEQ ID NO: 782 - DNA, 457 bp, Unknown; identical to SEQ ID NO: 686
  Bacillus sp. multi

SEQ ID NO: 783 - DNA, 457 bp, Unknown; identical to SEQ ID NO: 686
  Bacillus sp. multi

SEQ ID NO: 784 - DNA, 457 bp, Bacillus thuringiensis; identical to SEQ ID NO: 686

SEQ ID NO: 785 - DNA, 457 bp, Bacillus thuringiensis; identical to SEQ ID NO: 686

SEQ ID NO: 786 - DNA, 457 bp, Bacillus thuringiensis; identical to SEQ ID NO: 686

SEQ ID NO: 787 - DNA, 389 bp, Unknown
  Bacillus sp. multi
tatcaggttttttccatatttgttaaagtatctatctgtatttcatcggggtttaacactaacataagatgtatttaaatgggacacttttccataattccaatattccatgaaagtttaacactaacataagatgtatttaaataatgaggtcaaacggtgtcattcacggacattttcgtttaacactaacataagatgtatttaagtatgtataaaatctttgctccaaagaatgttgaccatgtttaacactgacataagatgtatttaaattttagcatggacggactatatttgttttttaatgtgtttacaccattaatatgatgtatttaaatgttacggttactaattgttcagcactcaaacgataagaaagtgaattt

SEQ ID NO: 788 - DNA, 457 bp, Unknown; identical to SEQ ID NO: 686
  Bacillus sp. multi

SEQ ID NO: 789 - DNA, 457 bp, Unknown; identical to SEQ ID NO: 686
  Bacillus sp. multi

SEQ ID NO: 790 - DNA, 383 bp, Unknown; identical to SEQ ID NO: 687
  Bacillus sp. multi

SEQ ID NO: 791 - DNA, 457 bp, Unknown; identical to SEQ ID NO: 686
  Bacillus sp. multi

SEQ ID NO: 792 - DNA, 457 bp, Unknown; identical to SEQ ID NO: 686
  Bacillus sp. multi

SEQ ID NO: 793 - DNA, 457 bp, Unknown; identical to SEQ ID NO: 686
  Bacillus sp. multi

SEQ ID NO: 794 - DNA, 457 bp, Unknown; identical to SEQ ID NO: 686
  Bacillus sp. multi

SEQ ID NO: 795 - DNA, 457 bp, Unknown; identical to SEQ ID NO: 686
  Bacillus sp. multi

SEQ ID NO: 796 - DNA, 457 bp, Unknown; identical to SEQ ID NO: 686
  Bacillus sp. multi

SEQ ID NO: 797 - DNA, 457 bp, Unknown; identical to SEQ ID NO: 686
  Bacillus sp. multi

SEQ ID NO: 798 - DNA, 383 bp, Unknown; identical to SEQ ID NO: 687
  Bacillus sp. multi

SEQ ID NO: 799 - DNA, 457 bp, Unknown; identical to SEQ ID NO: 686
  Bacillus sp. multi

SEQ ID NO: 800 - DNA, 457 bp, Unknown; identical to SEQ ID NO: 686
  Bacillus sp. multi

SEQ ID NO: 801 - DNA, 457 bp, Unknown; identical to SEQ ID NO: 680
  Bacillus sp. multi

SEQ ID NO: 802 - DNA, 457 bp, Unknown; identical to SEQ ID NO: 686
  Bacillus sp. multi

SEQ ID NO: 803 - DNA, 457 bp, Unknown; identical to SEQ ID NO: 686
  Bacillus sp. multi

SEQ ID NO: 804 - DNA, 457 bp, Unknown; identical to SEQ ID NO: 686
  Bacillus sp. multi

SEQ ID NO: 805 - DNA, 383 bp, Unknown
  Bacillus sp. multi
ttttttccatatttgttaaagtatctatctgtatttcatcggggtttaacactaacataagatgtatttaaatgggacacttttccataattccaatattccatgaaagtttaacactaacataagatgtatttaaattcatgagttcgataaactttttagctccgtctcggaggttaatactaacataagatgtatttaagtatgtataaaatctttgctccaaagaatgttgaccatgtttaacactgacataagatgtatttaaattttagcatggacggactatatttgttttttaatgtgtttacaccattaatatgatgtatttaaatgttacggttactaattgttcagcactcaaacgataagaaagtgaattt

SEQ ID NO: 806 - DNA, 457 bp, Unknown; identical to SEQ ID NO: 686
  Bacillus sp. multi

SEQ ID NO: 807 - DNA, 457 bp, Unknown; identical to SEQ ID NO: 686
  Bacillus sp. multi

SEQ ID NO: 808 - DNA, 383 bp, Unknown; identical to SEQ ID NO: 712
  Bacillus sp. multi

SEQ ID NO: 809 - DNA, 457 bp, Unknown; identical to SEQ ID NO: 680
  Bacillus sp. multi

SEQ ID NO: 810 - DNA, 517 bp, Unknown; identical to SEQ ID NO: 665
  Bacillus sp. multi

SEQ ID NO: 811 - DNA, 527 bp, Unknown
  Bacillus sp. multi
tatcaggttttttccgtatttgttaaagtatttatctgtatttcatcggggtttaacactaacataagatgtatttaaattatcccatgttaaaagcttttagggtaagcaaacaatttaacactaacataagatgtatttaaatatgtagaattgatatgttaaacgaattgttctaaagtttaacactagcataagatgtatttaaatgagtacctatgaggtagctaatgccccccccctcattgtttagtactaacataagatgtatttaaatatttcaacggtgttatcatcaatttccctttcttcagtttagtactaacacaagatgtatttaaatgtgataaagttaagagctttagctctttctggatcaggtttaaaactaacataagatgtatttaaattcatggattattgcaacaagaatttaacaaaagattagtttagcactaacataagatgtatttgaacaggtttataaaaagcataagctaaaaaagtgaattttttccggaatgacc

SEQ ID NO: 812 - DNA, 514 bp, Unknown
  Bacillus sp. multi
tttttcgcatctgttaaagtatctatctttattttatcggggtttggtactaacataagatgtatttaaatggtgtcattttaccatttaaggataagttccctaaaagtttagtactaatataagatgtatttaaattcttgatcttcggtgatttggtctagtacttttcagtttagtactaacacaagatgtatttaaatgtgataaagttaagagctttaactctttctggatcaggtttaaaactaacataagatgtatttaaatgagtctagtcagtaactcagtagtttgtccctcgtgtttaacattgacataagatgtatttaaataattgagcttaaccctaacgatgataaggtctttgtttaccagtaacataagatgtatttaaattcgtgtatgtaatcaccatcaatatcccgatattcgtttaccattagcataaggtgtatttaaattttagcatggacggactatatttgttttttaatgtgtttacaccatcaac

SEQ ID NO: 813 - DNA, 201 bp, Unknown
  Bacillus sp. multi
tatcaggttttttccatatttgttaaagtatctatctgtatttcatcggggtttaacactaacataagatgtatttaaatgggacacttttccataattccaatattccatgaaagtttaacactaacataagatgtatttaaataatgaggtcaaacggtgtcattcacggacattttcgtttaacactaacataagatg

SEQ ID NO: 814 - DNA, 448 bp, Unknown
  Bacillus sp. multi
tttttcatatctgttaaagtatatatctgtatttcatcggggtttaacactaacataagatgtatttaaatgagtctagtcagtaactcagtagtttgtccctcgtgtttaactttaacataagatgtatttaaattttgattataacgaggatgaagaaggggatattgagtttaacactaacataagatgtatttaaatacatgattatagcatgaatttaactcatgcaaagggtttattattaatataagatgtatttaaatttctccccatctccttttattaattcgattagctcgtttaacactaacataaagatgtatctaaattcgtcaagaaatccagtaaccacctttcttatgattgtttaacagtagcataaaatgtatttaaataggtttacaaaaatcattaaacttaagctacgaaaatgattttatcaata

SEQ ID NO: 815 - DNA, 448 bp, Unknown; identical to SEQ ID NO: 814
  Bacillus sp. multi

SEQ ID NO: 816 - DNA, 389 bp, Unknown
  Bacillus sp. multi
aacataagatgtatttaaattggggagagtgcgcaaagtgtttttgtagattaatttgtttaacactaacacaagatgtatttaaattactaatggtaaaacaaaacatagctttaatgcatggtttaacactaacataagatgtatttaaatttttatgctcatcgcataattcaagatgaaaaggcggtttaataccaacataagatgtatttaaattcggtttggcatgagccatacagaagctgaaaagaatataagatgtatttaaatactagcctatttaaagtattactactctctatatcagtttaagactaacataagatatatttacatgtgtttacccaaagtattaaactaagttaagaatgtatactgatcccctt

SEQ ID NO: 817 - DNA, 514 bp, Unknown; identical to SEQ ID NO: 690
  Bacillus sp. multi

SEQ ID NO: 818 - DNA, 514 bp, Unknown; identical to SEQ ID NO: 690
  Bacillus sp. multi

SEQ ID NO: 819 - DNA, 514 bp, Unknown; identical to SEQ ID NO: 690
  Bacillus sp. multi

SEQ ID NO: 820 - DNA, 450 bp, Unknown
  Bacillus sp. multi
ttttttccatatttgttaaagtatatatctgtatttcatcggggtttaacactaacataagatgtatttaaataatgaggtcaaacggtgtcattcacggactttttcgtttaacactaacataagatgtatttaaatatataagcgcgtatatattccatagctaccttatcggttaatactaacataagatgtatttaaattcatgagttcgataaactttttagctccgtctcggaggttaatactaacataagatgtatttaagtatgtataaaatctttgctccaaagaatgttgaccatgtttaacactgacataagatgtatttaaattttagcatggacggactatatttgttttttaatgtgtttacaccattaacatgatgtatttaaatgttacggttactaattgttcagcactcaaacgataagaaagtgaatttta

SEQ ID NO: 821 - DNA, 445 bp, Unknown
  Bacillus sp. multi
ttatcaggtttttccgcatctgttaaaatatctatctttatttcatcggggtttatcattaacataagatgtatttaaatatagctgctaatacattatcttttgctaaatcgcccgtttatcattaacataagatgtatttaaatgtataaacctgcataatactaatcgggtcaggttgagtttatcattaacataagatgtatttaaataattgtggtggcatacgatatgtcctacctaccaaggtttatcattaacataaggtgtatttaaatcatatacaagctaccggatgggcgcgacctcaacactaacataagatgtatttaaattaatagtcatcttccattacttcttcatctgtttatcatcaaaataacatgtatttaaataggtttacaaaaagcattaaactaagctaagaaagtgaattttatcaata

SEQ ID NO: 822 - DNA, 513 bp, Unknown
  Bacillus sp. multi
tttccgtatttgttaaagtatttatctgtatttcatcggggtttaacactaacataagatgtatttaaatataacagatttcataacaacacctatttccgtctcctttaacaccaacataagatgtatttaaattatgttgcgctatgaggtttatttagattggcaatagtttagtattaacataagatgtatttaaatatatagaattgatatgttaaacgaattgttctaaagtttaacactaacataggatgtatttaaattggtacaatggagacagacattaagtaaaatattaagtttaacactagcataagatgtatttaaatgagtacctatgaggtagctaatgactccccctcattgtctagtactaacataagatgtatttaaattcgtgtatgtaattaccatcaatatcctgatgttcgtttaccattagcataagatgtatttaaatcgtttaatgtgtaatttctatatcaaagaaggactttgtttactataaac

SEQ ID NO: 823 - DNA, 513 bp, Unknown; identical to SEQ ID NO: 822
  Bacillus sp. multi

SEQ ID NO: 824 - DNA, 439 bp, Unknown
  Bacillus sp. multi
ttttccgcatctgttaaagtagctatctttatttcattggtatttaacactaacataagatgtatttaaatgcatatggagtaggggcatcgcgcgaactgtggtggtttaaaactaacataagatgtatttaaattgtgggaggtacgctttctcactggggacaattccagtttagcactaacataagatgtatttaaataatatgttgccttctaaatgctgaattatttcaaagataatgttagcattaggtttatttaaattaggtcttttgtcttggtgattctctacactacggctagttaatgttaacatttggtgtatttgaattagatattttatatcattaaaaagtgcttagctttaacacttggatgcatttgaattagctcaattgcaaataatttagatgagaattttcgtttaacattaatat

SEQ ID NO: 825 - DNA, 449 bp, Unknown
  Bacillus sp. multi
ttttccatatctgttaaagtatctatctgtatttcatcggggtttaacactaacataagatgtatttaaattatgcgatgcgttcagcgtttccaagttccgttaacgtttaacactaacataagatgtatttaaatgagtctagtcagtaactcagtagtttgtccctcgtgtttaccagtaacataagatgtatttaaataattgagcttaaccctaacgatgataaggtctttgtttaccagtaacataagatgtatttaaattcagttaaccaacaatctaaagtcattcctactcccgtttaacaccaacataagatgtatttaaattcatggattattacaacaagaatttaacaaaagactagtttagcactaatataagatgtatttaaataggttacaaaaagtattaaattaagctaagaaagtgaattttatcaatat

SEQ ID NO: 826 - DNA, 449 bp, Unknown
  Bacillus sp. multi
ttttccatatctgttaaagtatctatctgtatttcatcggggtttaacactaacataagatgtatttaaattatgcgatgcgttcagcgtttccaagttccgttaacgtttaacactaacataagatgtatttaaatgagtctagtcagtaactcagtagtttgtccctcgtgtttaacattaacataagatgtatttaaataattgagcttaaccctaacgatgataaggtctttgtttaccagtaacataagatgtatttaaattcagttaaccaacgatctaaagtcattcctactcccgtttaacaccaacataagatgtatttaaattcatggattattacaacaagaatttaacaaaagactagtttagcactaatataagatgtatttaaataggttacaaaaagtattaaattaagctaagaaagtgaattttatcaatat

SEQ ID NO: 827 - DNA, 325 bp, Unknown
  Bacillus sp. multi
ttatcagttttttttcgcatctgttaaagcatctatcttatttcatcggggtttagtattaacataagatgtatttaaatttgtatctctagctattattgtatctaaggtaccagtttagtattaacataagatgtatttaaatgctactttacccacattctccgcacctttagcgggtttagtattaacataagatgtatttaaattcggtttggcataggtcatgcacacgccgaaaattcgtttaaaactaacataagatatatttacatatgtttaaaaaagttattaaactaagttaagaatgtatacttatctcctt

SEQ ID NO: 828 - DNA, 325 bp, Unknown; identical to SEQ ID NO: 827
  Bacillus sp. multi

SEQ ID NO: 829 - DNA, 450 bp, Unknown; identical to SEQ ID NO: 820
  Bacillus sp. multi

SEQ ID NO: 830 - DNA, 314 bp, Unknown
  Bacillus sp. multi
tttccgaatttgttaaagtaactatctttatttcattggagcttaacattaacataagatgtatttaaatcctcaacagaatcttatttaaaaaaatccatagctcttaacattaacataagatgtatttaaattctcggaagtaattctcatcaatttcttctgtctccgtttaacatcaacataagatgtatttaaatccttcctagttaatgatgtaggagaaaaagtcctgtttaaaattaagataagatgtatttaaataaacgattgctacattttttcaattatttaaatatgtttacaaaaagaat

SEQ ID NO: 831 - DNA, 596 bp, Unknown
  Bacillus sp. multi
ggttatttttcgtatctgttaaagtatctatctttattttattggggtttagtactaacataagatgtattaaatattctgaggtgttctgtgattaatttagacatgtatgttcagtactaacataagatgtatttaaatctttggccggtgaaccaattaaaaacccgattaaagtttagtactaacataagatgtatttaaattggggagagtgcgcaaaatgtttttgtagattaatttgtttaacactaacacaagttgtatttaaatactccttaaattcctttcgctacgctctagtaaccacctaacttgtgattgtttaacagtagcataagatgtatttaaattactaatggtaaaacaaaacatagctttaatgcatagtttaacactaacataagatgtatttaaatttttatgctcatcgcataattcaagatgaaaaggcggtttaataccaacataagatgtatttaaatactagcctatctaaagtattactactctctatatcagtttaagactaacataagatatatttacatgtgtttacccaaagtattaaactaagttaagaatgtatactgatc

SEQ ID NO: 832 - DNA, 596 bp, Bacillus thuringiensis; identical to SEQ ID NO: 831

SEQ ID NO: 833 - DNA, 596 bp, Unknown; identical to SEQ ID NO: 831
  Bacillus sp. multi

SEQ ID NO: 834 - DNA, 596 bp, Unknown; identical to SEQ ID NO: 831
  Bacillus sp. multi

SEQ ID NO: 835 - DNA, 596 bp, Unknown; identical to SEQ ID NO: 831
  Bacillus sp. multi

SEQ ID NO: 836 - DNA, 596 bp, Unknown; identical to SEQ ID NO: 831
  Bacillus sp. multi

SEQ ID NO: 837 - DNA, 509 bp, Unknown
  Bacillus sp. multi
tatcaggttttttccatatctgttaaagtatccatctgtatttcatcggggtttaacactaacataagatgtatttaaatctagcagaataaacaatttcgtccgtcataacgtgtttaacactaacataagatgtatttaaatcaataataatgttcggatcttttgggattaacactaacataagatgtatttaaatcttgtagcagccttttctttctccgctgccatagtgtttaacactaacataagatgtatttaaatttgtttaacttccatctatttaattaattcttgaggtttaacactaacataagatatatttaaatatgattttgtaccctggatagcggatcaggagtaatgtttaacactaacataagatgtatttaaattgtagtcgcacattaaaatgttaatcagcttatagtttaccattaacatgatgtatttagattgctcatgtaatcaatttcactcccattactttccgtttaacataggattta

SEQ ID NO: 838 - DNA, 514 bp, Unknown; identical to SEQ ID NO: 631
  Bacillus sp. multi

SEQ ID NO: 839 - DNA, 323 bp, Unknown
  Bacillus sp. multi
atcaggttttttccatatctgttaaagtatccatctgtatttcatcggggtttaacactaacataagatgtatttaaatcttgctacgctttccagtaaccatgtcgggatccagtttaacactaacataagatgtatttaaatagcgctacatattttgtatagatttcagtaatttgatttaacactaacataagatgtatttaaattgtagtcgcacattaaaatgttaatcagcttatagtttaccattaacatgatgtatttagattgctcatgtaatcaatttcactcccattactttccgtttaacataggattta

SEQ ID NO: 840 - DNA, 325 bp, Unknown
  Bacillus sp. multi
atcaggttttttccatatctgttaaagtatccatctgtatttcatcggggtttaacactaacataagatgtatttaaatcttgctacgctttccagtaaccatgtcgggatccagtttaacactaacataagatgtatttaaatagcgctacatattttgtatagatttcagtaatttgatttaacactaacataagatgtatttaaatgagtacctatgaggtagctaatgactccccctcattgtctagtactaacataagatgtatttaaatcgtttaatgtgtaatttttatatcaaagaaggactttgtttactataaac

SEQ ID NO: 841 - DNA, 379 bp, Unknown
  Bacillus sp. multi
tatcaggttttttccatatctgttaaagtatccatctgtatttcatcggggtttaacactaacataagatgtatttaaatctagcagaataaacaatttcgtccgtcataacgtgtttaacactaacataagatgtatttaaatcaataataatgttcggatcttttgggattaacactaacataagatgtatttaaatcttgtagcagccttttctttctccgctgccatagtgtttaacactaacataagatgtatttaaattgtagtcgcacattaaaatgttaatcagcttatagtttaccattaacatgatgtatttagattgctcatgtaatcaatttcactcccattactttccgtttaacataggatttat

SEQ ID NO: 842 - DNA, 379 bp, Unknown; identical to SEQ ID NO: 841
  Bacillus sp. multi

SEQ ID NO: 843 - DNA, 522 bp, Unknown
  Bacillus sp. multi
ttatcagttttttttcgcatctgttaaagcatctatcttatttcatcggggtttagtattaacataagatgtatttaaatttgtatctctagctattattgtatctaaggtaccagtttagtattaacataagatgtatttaaatgctactttacccacattctccgcacctttagcgggtttagtattaacataagatgtatttaaatatatagaattgatatgttaaacgaattgttctaaagtttaacactaacataggatgtatttaaattggtacaatggagacagacattaagtaaaatattaagtttaacactagcataagatgtatttaaacgagtacctatgaggtagctaatgactccccctcattgtttagtactaacataagatgtatttaaattcggtttggcataggtcatgcacacgccgaaaattcgtttaaaactaacataagatatatttacatatgtttaaaaaagttattaaactaagttaagaatgtatacttatctcctt

SEQ ID NO: 844 - DNA, 509 bp, Unknown; identical to SEQ ID NO: 837
  Bacillus sp. multi

SEQ ID NO: 845 - DNA, 449 bp, Unknown
  Bacillus sp. multi
tttttcgcatctgttaaagtatctatctttattttatcggggtttggtactaacataagatgtatttaaatgcaggggttcgctaacggtacacctgatatagaaggtttagtactaacataagatgtatttaaatggtgtcattttaccatttaaggataagttccctaaaagtttagtactaacacaagatgtatttaaataattgagcttaatcctaacgatgataaggtctttgtttactagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaaatgaattttatcaata

SEQ ID NO: 846 - DNA, 513 bp, Unknown
  Bacillus sp. multi
tttccgtatttgttaaagtatttatctgtatttcatcggggtttaacactaacataagatgtatttaaatataacagatttcataacaacacctatttccgtctcctttaacaccaacataagatgtatttaaattatgttgcgctatgaggtttatttagattggcaatagtttagtattaacataagatgtattcaaatatatagaattgatatgttaaacgaattgttctaaagtttaacactaacataggatgtatttaaattggtacaatggagacagacattaagtaaaatattaagtttaacactagcataagatgtatttaaatgagtacctatgaggtagctaatgactctccctcattgtctagtactaacataagatgtatttaaattcgtgtatgtaattaccatcaatatcctgatgttcgtttaccattagcataagatgtatttaaatcgtttaatgtgtaatttctatatcaaagaaggactttgtttactataaac

SEQ ID NO: 847 - DNA, 517 bp, Unknown; identical to SEQ ID NO: 665
  Bacillus sp. multi

SEQ ID NO: 848 - DNA, 450 bp, Unknown
  Bacillus sp. multi
tttttcgcatctgttaaagtatctatctttattttatcggggtttggtactaacataagatgtatttaaattggtacaatagaccaagacattaagtaaaataataagtttgtactaacataagatgtatttaaatggtgtcattttaccatttaaggataagttccctaaaagtttagtactaacacaagatgtatttaaatgagtctagtcagtaactcagtagtttgtccctcgtgtttaacattaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 849 - DNA, 450 bp, Unknown; identical to SEQ ID NO: 848
  Bacillus sp. multi

SEQ ID NO: 850 - DNA, 450 bp, Unknown; identical to SEQ ID NO: 848
  Bacillus sp. multi

SEQ ID NO: 851 - DNA, 450 bp, Unknown; identical to SEQ ID NO: 848
  Bacillus sp. multi

SEQ ID NO: 852 - DNA, 450 bp, Unknown; identical to SEQ ID NO: 848
  Bacillus sp. multi

SEQ ID NO: 853 - DNA, 514 bp, Unknown; identical to SEQ ID NO: 631
  Bacillus sp. multi

SEQ ID NO: 854 - DNA, 450 bp, Unknown; identical to SEQ ID NO: 848
  Bacillus sp. multi

SEQ ID NO: 855 - DNA, 514 bp, Unknown; identical to SEQ ID NO: 631
  Bacillus sp. multi

SEQ ID NO: 856 - DNA, 383 bp, Unknown
  Bacillus sp. multi
ttttccgcatctgttaaagtagctatctttatttcattggtatttaacactaacataagatgtatttaaatgcatatggagtagaggcatcgcgcgaactgtggtggtttaaaactaacataagatgtatttaaattgtggaaggtacgctttctcactggggacaattccagtttagcactaacataagatgtatttaaataatatgttgccttctaaatgctgaattatttcaaagataatgttagcattaggtttatttaaattaggtcttttgtcttggtgattctctacactacggctagttaatgttaacatttggtttatttaaattagatattttatatcattaaaaagtgcttagctttaacacttggatgcat

SEQ ID NO: 857 - DNA, 514 bp, Unknown
  Bacillus sp. multi
tttttcgcatctgttaaagtatctatctttattttatcggggtttggtactaacataagatgtatttaaatgcaggggttcgctaacggtacacctgatatagaaggtttagtactaacataagatgtatttaaatggtgtcattttaccatttaaggataagttccctaaaagtttagtactaacacaagatgtatttaaatgagtctagtcagtaactcagtagtttgtccctcgtgtttaacattaacataagatgtatttaaataattgagcttaatcctaacgatgataaggtctttgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 858 - DNA, 514 bp, Unknown; identical to SEQ ID NO: 857
  Bacillus sp. multi

SEQ ID NO: 859 - DNA, 439 bp, Unknown
  Bacillus sp. multi
ttttccgcatctgttaaagtagctatctttatttcattggtatttaacactaacataagatgtatttaaatgcatatggagtagaggcatcgcgcgaactgtggtggtttaaagctaacataagatgtatttaaattgtggaaggtacgctttctcactggggacaattccagtttagcactaacataagatgtatttaaataatatgttgccttctaaatgctgaattatttcaaagataatgttagcattaggtttatttaaattaggtcttttgtcttggtgattctctacactacggctagttaatgttaacatttggtgtatttaaattagatattttatatcattaaaaagtgcttagctttaacacttggatgcatttgaattagctcagctgcaaataatttagatgggaattttcgtttaacattaatat

SEQ ID NO: 860 - DNA, 439 bp, Unknown; identical to SEQ ID NO: 859
  Bacillus sp. multi

SEQ ID NO: 861 - DNA, 439 bp, Unknown; identical to SEQ ID NO: 859
  Bacillus sp. multi

SEQ ID NO: 862 - DNA, 514 bp, Unknown; identical to SEQ ID NO: 857
  Bacillus sp. multi

SEQ ID NO: 863 - DNA, 581 bp, Unknown
  Bacillus sp. multi
gttttttcgcatctgttaaagtatctatctttattttatcggggtttggtactaacataagatgtatttaaattggtacaatagacctagacattaagtaaaataataagtttgtactaacataagatgtatttaaatgcaggggttcgctaacggtacacctgatatagaaggtttagtactaacataagatgtatttaaatggtgtcattttaccatttaaggataagttccctaaaagtttagtactaacacaagatgtatttaaatgagtctagtcagtaactcagtagtttgtccctcgtgtttaacattaacataagatgtatttaaataattgagcttaatcctaacgatgataaggtctttgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 864 - DNA, 581 bp, Unknown; identical to SEQ ID NO: 863
  Bacillus sp. multi

SEQ ID NO: 865 - DNA, 581 bp, Unknown; identical to SEQ ID NO: 863
  Bacillus sp. multi

SEQ ID NO: 866 - DNA, 581 bp, Paenibacillus sp. novel; identical to SEQ ID NO: 863

SEQ ID NO: 867 - DNA, 514 bp, Unknown; identical to SEQ ID NO: 857
  Bacillus sp. multi

SEQ ID NO: 868 - DNA, 581 bp, Unknown; identical to SEQ ID NO: 863
  Bacillus sp. multi

SEQ ID NO: 869 - DNA, 581 bp, Unknown; identical to SEQ ID NO: 863
  Bacillus sp. multi

SEQ ID NO: 870 - DNA, 581 bp, Unknown; identical to SEQ ID NO: 863
  Bacillus sp. multi

SEQ ID NO: 871 - DNA, 581 bp, Unknown
  Bacillus sp. multi
gttttttcgcatctgttaaagtatctatctttattttatcggggtttggtactaacataagatgtatttaaattggtacaatagacctagacattaagtaaaataataagtttgtactaacataagatgtatttaaatgcaggggttcgctaacggtacacctgatatagaaggtttagtactaacataagatgtatttaaatggtgtcattttaccatttaaggataagttctctaaaagtttagtactaacacaagatgtatttaaatgagtctagtcagtaactcagtagtttgtccctcgtgtttaacattaacataagatgtatttaaataattgagcttaatcctaacgatgataaggtctttgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 872 - DNA, 581 bp, Unknown; identical to SEQ ID NO: 871
  Bacillus sp. multi

SEQ ID NO: 873 - DNA, 581 bp, Bacillus; identical to SEQ ID NO: 863

SEQ ID NO: 874 - DNA, 581 bp, Unknown; identical to SEQ ID NO: 863
  Bacillus sp. multi

SEQ ID NO: 875 - DNA, 656 bp, Bacillus thuringiensis
ggttatttttcgtatctgttaaagtatctatctttattttatcggggtttagtactaacataagatgtattaaatattctgaggtgttctgtgattaatttagacatgtatgttcagtactaacataagatgtatttaaatctttggccgttgaaccaattaaaaacccgattaaagtttagtactaacataagatgtatttaaattggggagagtgcgcaaagtgtttttgtagattaatttgtttaacactaacacaagatgtatttaaatactccttaaattcctttcgctacgctacgctctagtaaccacctaacttgtgagtgtttaacagtagcataagatgtatttaaattactaatggtaaaacaaaacatagctttaatgcatgatttgacactaacataagatgtatttaaatttttatgctcatcgcataattcaagatgaaaaggcggtttaataccaacataagatgtatttaaattcggtttggcatgagccatacagaagctgaaaagaatataagatgtatttaaatactagcctatcttaaagtattactaccctctatatcagtttaagactaacataagatatatttacatgtgtttacccaaagtattaaactaagttaagaatgtatactgatc

SEQ ID NO: 876 - DNA, 651 bp, Unknown
  Bacillus sp. multi
ggttatttttcgtatctgttaaagtatctatctttattttatcggggtttagtactaacataagatgtattaaatattctgaggtgttctgtgattaatttagacatgtatgttcagtactaacataagatgtatttaaatctttggccgttgaaccaattaaaaacccgattaaagtttagtactaacataagatgtatttaaattggggagagtgcgcaaagtgtttttgtagattaatttgtttaacactaacacaagatgtatttaaatactccttaaattcctttcgctacgctctagtaaccacctaacttgtgattgtttaacagtagcataagatgtatttaaattactaatggtaaaacaaaacatagctttaatgcatgatttgacactaacataagatgtatttaaatttttatgctcatcgcataattcaagatgaaaaggcggtttaataccaacataagatgtatttaaattcggtttggcatgagccatacagaagctgaaaagaatataagatgtatttaaatactagcctatcttaaagtattactaccctctatatcagtttaagactaacataagatatatttacatgtgtttacccaaagtattaaactaagttaagaatgtatactgatc

SEQ ID NO: 877 - DNA, 651 bp, Unknown; identical to SEQ ID NO: 876
  Bacillus sp. multi

SEQ ID NO: 878 - DNA, 651 bp, Unknown; identical to SEQ ID NO: 876
  Bacillus sp. multi

SEQ ID NO: 879 - DNA, 651 bp, Unknown; identical to SEQ ID NO: 876
  Bacillus sp. multi

SEQ ID NO: 880 - DNA, 651 bp, Unknown; identical to SEQ ID NO: 876
  Bacillus sp. multi

SEQ ID NO: 881 - DNA, 651 bp, Unknown; identical to SEQ ID NO: 876
  Bacillus sp. multi

SEQ ID NO: 882 - DNA, 651 bp, Unknown; identical to SEQ ID NO: 876
  Bacillus sp. multi

SEQ ID NO: 883 - DNA, 651 bp, Unknown; identical to SEQ ID NO: 876
  Bacillus sp. multi

SEQ ID NO: 884 - DNA, 651 bp, Unknown; identical to SEQ ID NO: 876
  Bacillus sp. multi

SEQ ID NO: 885 - DNA, 651 bp, Unknown; identical to SEQ ID NO: 876
  Bacillus sp. multi

SEQ ID NO: 886 - DNA, 656 bp, Unknown; identical to SEQ ID NO: 875
  Bacillus sp. multi

SEQ ID NO: 887 - DNA, 651 bp, Unknown; identical to SEQ ID NO: 876
  Bacillus sp. multi

SEQ ID NO: 888 - DNA, 651 bp, Unknown; identical to SEQ ID NO: 876
  Bacillus sp. multi

SEQ ID NO: 889 - DNA, 651 bp, Unknown
  Bacillus sp. multi
ggttatttttcgtatctgttaaagtatctatctttattttatcggggtttagtactaacataagatgtattaaatattctgaggtgttctgtgattaatttagacatgtatgttcagtactaacataagatgtatttaaatctttggccgttgaaccaattaaaaacccgattaaagtttagtactaacataagatgtatttaaattggggagagtgcgcaaagtgtttttgtagattaatttgtttaacactaacacaagatgtatttaaatactccttaaattcctttcgctacgctctagtaaccacctaacttgtgattgtttaacagtagcataagatgtatttaaattactaatggtaaaacaaaacatagctttaatgcatggtttgacactaacataagatgtatttaaatttttatgctcatcgcataattcaagatgaaaaggcggtttaataccaacataagatgtatttaaattcggtttggcatgagccatacagaagctgaaaagaatataagatgtatttaaatactagcctatcttaaagtattactaccctctatatcagtttaagactaacataagatatatttacatgtgtttacccaaagtattaaactaagttaagaatgtatactgatc

SEQ ID NO: 890 - DNA, 651 bp, Unknown; identical to SEQ ID NO: 876
  Bacillus sp. multi

SEQ ID NO: 891 - DNA, 656 bp, Unknown; identical to SEQ ID NO: 875
  Bacillus sp. multi

SEQ ID NO: 892 - DNA, 656 bp, Unknown; identical to SEQ ID NO: 875
  Bacillus sp. multi

SEQ ID NO: 893 - DNA, 651 bp, Unknown; identical to SEQ ID NO: 876
  Bacillus sp. multi

SEQ ID NO: 894 - DNA, 651 bp, Unknown; identical to SEQ ID NO: 876
  Bacillus sp. multi

SEQ ID NO: 895 - DNA, 520 bp, Unknown
  Bacillus sp. multi
ttttcgtatctgttaaagtatctatctttattttatcggggtttagtactaacataagatgtatttaaattggggagagtgcgcaaagtgtttttgtagattaatttgtttaacactaacacaagatgtatttaaatactccttaaattcctttcgctacgctctagtaaccacctaacttgtgattgtttaacagtagcataagatgtatttaaattactaatggtaaaacaaaacatagctttaatgcatgatttgacactaacataagatgtatttaaatttttatgctcatcgcataattcaagatgaaaaggcggtttaataccaacataagatgtatttaaattcggtttggcatgagccatacagaagctgaaaagaatataagatgtatttaaatactagcctatcttaaagtattactaccctctatatcagtttaagactaacataagatatatttacatgtgtttacccaaagtattaaactaagttaagaatgtatactgatcccctt

SEQ ID NO: 896 - DNA, 651 bp, Unknown; identical to SEQ ID NO: 876
  Bacillus sp. multi

SEQ ID NO: 897 - DNA, 651 bp, Unknown; identical to SEQ ID NO: 876
  Bacillus sp. multi

SEQ ID NO: 898 - DNA, 651 bp, Unknown; identical to SEQ ID NO: 876
  Bacillus sp. multi

SEQ ID NO: 899 - DNA, 651 bp, Unknown; identical to SEQ ID NO: 876
  Bacillus sp. multi

SEQ ID NO: 900 - DNA, 651 bp, Unknown; identical to SEQ ID NO: 876
  Bacillus sp. multi

SEQ ID NO: 901 - DNA, 651 bp, Unknown; identical to SEQ ID NO: 876
  Bacillus sp. multi

SEQ ID NO: 902 - DNA, 391 bp, Unknown
  Bacillus sp. multi
ttatcattatttttcgcatctgttaaagtatctatctttatttcatcggggtttagtatgaacataagatgtatttagatcatgcatattttaccacaataatacgaaattttgttgtttagtatgaacataagatgtatttagatgttgctatgatagaaccatgctttgaccatttacggtttagtattaacatgagatgtatttagatcctcgcttatcctttacaattaacagcataccaagtttagtatgaacataagatgtatttaaattatctacgtattcttgatatcttcctaaatttaaatatttaaccttaacataagatgtatttaaatcaagctgagataaaagaaaggattttcgcgcaatattttaacctgaggtg

SEQ ID NO: 903 - DNA, 385 bp, Unknown
  Bacillus sp. multi
tttttcgcatctgttaaagtatctatctttattttatcggggtttggtactaacataagatgtatttaaatggtgtcattttaccatttaaggataagttccctaaaagtttagtactaacacaagatgtatttaaatgagtctagtcagtaactcagtagtttgtccctcgtgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaata

SEQ ID NO: 904 - DNA, 416 bp, Unknown
  Bacillus sp. multi
ggttatttttcgtatctgttaaagtatctatctttattttatcggggtttagtactaacataagatgtattaaatattctgaggtgttctgtgattaatttagacatgtatgttcagtactaacataagatgtatttaaatctttggccgttgaaccaattaaaaacccgattaaagtttagtactaacataagatgtatttaaattggggagagtgcgcaaagtgtttttgtagattaatttgtttaacactaacacaagatgtatttaaatactccttaaattcctttcgctacgctctagtaaccacctaacttgtgattgtttaacagtagcataagatgtatttaaattactaatggtaaaacaaaacatagctttaatgcatgatttgacactaacataagatgtattta

SEQ ID NO: 905 - DNA, 453 bp, Unknown
  Bacillus sp. multi
agttttttcgcatctgttaaagtatctatctttattttatcggggtttggtactaacataagatgtatttaaattggtacaatagacctagacattaagtaaaataataagtttgtactaacataagatgtatttaaatgcaggggttcgctaacggtacacctgatatagaaggtttagtactaacataagatgtatttaaatggtgtcattttaccatttaaggataagttccctaaaagtttagtactaacacaagatgtatttaaatgagtctagtcagtaactcagtagtttgtccctcgtgtttaacattaacataagatgtatttaaatcgtttaatgtgtaatttttatatcaaagaaggactttgtttactataaacataaggggtatttaaataggtttataaaaatcattaaactaagctaagaaagtgaattttatcaata

SEQ ID NO: 906 - DNA, 326 bp, Unknown
  Bacillus sp. multi
aagggattttcgcaatatttattgttaatcatccatatattatcggggtttaaacataacaatagatgtattgaaatatgtattcatatctaggacttcctatagtaattattgtctaaacataacaatagatgtattgaaattgataccaaaaatatttatttttgattgcacgaagtgtttaaacataacaatagatgtattgaaatagcatgatgcagtacttatgtaaagttgacttcaggcgtttggaataaacagtagatgtgttgagagtttgagaacagccgactcataaaatcttgatgttagggtttaagtacatt

SEQ ID NO: 907 - DNA, 392 bp, Unknown
  Bacillus sp. multi
tacaagggatcgtcgcacattcattgttaatcatccatatattatcgggggttaaaacataacaatagatgtattgaaataggtacctcgaaattaataatctagtacgttcgttagttaaaacataacaatagatgtattgaaattcggctgatggtaatttttcttttccctgttccagttaaaacataacaatagatgtattgaaatttggcgcatatcatttatgaccaccatcaataatttttttaaaacataacaatagatgtattgaaatacttattaataagtcggtaagagccctctatttaggttttaacaaagtaatagatgtatttaaaaagataacaattcaataagaaaccctgggtgcaagagtgtgaattattaaa

SEQ ID NO: 908 - DNA, 392 bp, Unknown; identical to SEQ ID NO: 907
  Bacillus sp. multi

SEQ ID NO: 909 - DNA, 392 bp, Unknown; identical to SEQ ID NO: 907
  Bacillus sp. multi

SEQ ID NO: 910 - DNA, 392 bp, Unknown; identical to SEQ ID NO: 907
  Bacillus sp. multi

SEQ ID NO: 911 - DNA, 325 bp, Unknown
  Bacillus sp. multi
acaagggatcgtcgcacattcattgttaatcatccatatattatcgggggttaaaacataacaatagatgtattgaaattcggctgatggtaatttttcttttccctgttccagttaaaacataacaatagatgtattgaaatttggcgcatatcatttatgaccaccatcaataatttttttaaaacataacaatagatgtattgaaatacttattaataagtcggtaagagccctctatttaggttttaacaaagtaatagatgtatttaaaaagataacaattcaataagaaaccctgggtgcaagagtgtgaattattaaa

SEQ ID NO: 912 - DNA, 392 bp, Unknown; identical to SEQ ID NO: 907
  Bacillus sp. multi

SEQ ID NO: 913 - DNA, 392 bp, Unknown; identical to SEQ ID NO: 907
  Bacillus sp. multi

SEQ ID NO: 914 - DNA, 392 bp, Unknown; identical to SEQ ID NO: 907
  Bacillus sp. multi

SEQ ID NO: 915 - DNA, 392 bp, Unknown; identical to SEQ ID NO: 907
  Bacillus sp. multi

SEQ ID NO: 916 - DNA, 392 bp, Unknown; identical to SEQ ID NO: 907
  Bacillus sp. multi

SEQ ID NO: 917 - DNA, 392 bp, Unknown; identical to SEQ ID NO: 907
  Bacillus sp. multi

SEQ ID NO: 918 - DNA, 392 bp, Unknown; identical to SEQ ID NO: 907
  Bacillus sp. multi

SEQ ID NO: 919 - DNA, 392 bp, Bacillus; identical to SEQ ID NO: 907

SEQ ID NO: 920 - DNA, 392 bp, Bacillus; identical to SEQ ID NO: 907

SEQ ID NO: 921 - DNA, 392 bp, Bacillus; identical to SEQ ID NO: 907

SEQ ID NO: 922 - DNA, 392 bp, Unknown; identical to SEQ ID NO: 907
  Bacillus sp. multi

SEQ ID NO: 923 - DNA, 317 bp, Unknown
  Bacillus sp. multi
tgtcgcaatattcgttgttaatcatccatctattatcggggttaaaaaataacaatagatgtattgaaatgttagaagtcatactctagtcatatcataacaaatagtaaaaaaataacaatagatgtattgaaatgtttcgttataataacgttttgcatcgtctgttttagttaaagcaaaacaatagatgtattgaaatacttattaataagtcggttagagctctctatttagggtttaacaaactaatagaagtatttaaaaatataacaaattgataagaagccctgggggtaagagtgtgaatcattaaa

SEQ ID NO: 924 - DNA, 329 bp, Unknown
  Bacillus sp. multi
tacaagggatcgtcgtacaattcattgttcatcatccatatattatcgggggttaaaacaaaacaatagatgtattgaaatgttgaaatgtatgaagaaagcacccctaaactaaggttaaaacaaaacaatagatgtatttaaatattcgttgaataataaaatcaccaataagcacggtgagttaaaaacataacaatagatgtattgaaatctagtagttaatttgaactgggtatttgacagtgtgttgaaataaaacaatagatgtattgaaattgggggaatgatcggcacctcactaaatcattgcgaagtttaaacaacac

SEQ ID NO: 925 - DNA, 318 bp, Unknown
  Bacillus sp. multi
ggatcgtcgcacattcattgttaatcatccatatattatcgggggttaaaacataacaatagatgtattgaaattgcgaagcacttgccaggacgcgtaggatttgcaggttaagacataacaatagatgtattgaaattcaagtgggcggcctttctaaaacacttttattggttaaaacataacaatagatgtattgaaatacttattattaagtcggtaagagccctctatttaggttataacaaactaatagatgtatttaaaaagataacaaatcaataagaaaccctgggtgcaagagtgtgaattattaaa

SEQ ID NO: 926 - DNA, 382 bp, Unknown
  Bacillus sp. multi
gtcgtacaattcattgttcatcatccatatattatcgggggttaaaacaaaacaatagatgtattgaaattccttcatgaaccttttatctatccgatccatcagttaaaacaaaacaatagatgtattgaaatgttgaaatgtatgaagaaagcacccctaaactaaggttaaaacataaaaatagatgtattgaaatattcgttgaataataaaatcaccaataagcacggtgagttaaaaacataacaatagatgtattgaaatctagtagttaatttgaactgggtatttgacagtgtgttgaaataaaacaatagatgtattgaaattgggggaatgttcggcacttcactaaatcattgcgaagtttaaacaacac

SEQ ID NO: 927 - DNA, 329 bp, Unknown; identical to SEQ ID NO: 924
  Bacillus sp. multi

SEQ ID NO: 928 - DNA, 329 bp, Unknown; identical to SEQ ID NO: 924
  Bacillus sp. multi

SEQ ID NO: 929 - DNA, 456 bp, Unknown
  Bacillus sp. multi
acaagggatcgttgcacaattcattgttaatcttctatatattatggggggttaaaacataacaatagatgtattgaaattcgatataatccaagcaatcacctattgtcatatcgttaaaacataacaatagatgtattgaaattttatagtagccttggcctcaaatgcaacaaatcggttaaaacataacaatagatgtattgaaatctaaaaagattaagtggtgtaattgtaaacttcttagttaaaacataataatagatgtattgaaatgtttgagcagcagttgctttcatcacctgtttcttgttaaaacataacaatagatgtattgaaatatgcattctttatgtgcagcctggtattttcctgagttaaaacaaaacgatagatatttaggaatctcgttgggctttgattatatttgtatataaatagaggcaatgttatgat

SEQ ID NO: 930 - DNA, 456 bp, Unknown; identical to SEQ ID NO: 929
  Bacillus sp. multi

SEQ ID NO: 931 - DNA, 456 bp, Unknown; identical to SEQ ID NO: 929
  Bacillus sp. multi

SEQ ID NO: 932 - DNA, 456 bp, Unknown; identical to SEQ ID NO: 929
  Bacillus sp. multi

SEQ ID NO: 933 - DNA, 456 bp, Unknown
  Bacillus sp. multi
acaagggatcgttgcacaattcattgttaatcttctatatattatggggggttaaaacataacaatagatgtattgaaattcgatataatccaagcaatcacctattgtcatatcgttaaaacataacaatagatgtattgaaattttatagtagccttggcctcaaatgcaacaaatcggttaaaacataacaatagatgtattgaaatctaaaaagattaagcggtgtaattgtaaacttcttagttaaaacataataatagatgtattgaaatgtttgagcagcagttgctttcatcacctgtttcttgttaaaacataacaatagatgtattgaaatatgcattctttatgtgcagcctggtattttcctgagttaaaacaaaacgatagatatttaggaatctcgttgggctttgattatatttgtatataaatagaggcaatgttatgat

SEQ ID NO: 934 - DNA, 327 bp, Unknown
  Bacillus sp. multi
tatataagggattgtcgcaatatttattgttaatcatccatatattatcgagataaaacataacaatagatgtattgaaatgcggacagccaagtaaccatatgagtaggaatcttaggaaaaacataataatagatgtattgaaatgcgtcctctttttatataaaaggaggaacctggtaggtaaaacataataatagatgtattgaaatacttattaataagtcggttaggaccctctatttagggtttaacaaactaatagatgtatttaaaaagataacaaatcattaagaaaccctgggtgcaggagtgtgaattattaaa

SEQ ID NO: 935 - DNA, 327 bp, Unknown; identical to SEQ ID NO: 934
  Bacillus sp. multi

SEQ ID NO: 936 - DNA, 327 bp, Unknown; identical to SEQ ID NO: 934
  Bacillus sp. multi

SEQ ID NO: 937 - DNA, 327 bp, Unknown; identical to SEQ ID NO: 934
  Bacillus sp. multi

SEQ ID NO: 938 - DNA, 327 bp, Unknown; identical to SEQ ID NO: 934
  Bacillus sp. multi

SEQ ID NO: 939 - DNA, 327 bp, Unknown; identical to SEQ ID NO: 934
  Bacillus sp. multi

SEQ ID NO: 940 - DNA, 327 bp, Unknown; identical to SEQ ID NO: 934
  Bacillus sp. multi

SEQ ID NO: 941 - DNA, 327 bp, Unknown; identical to SEQ ID NO: 934
  Bacillus sp. multi

SEQ ID NO: 942 - DNA, 327 bp, Unknown; identical to SEQ ID NO: 934
  Bacillus sp. multi

SEQ ID NO: 943 - DNA, 327 bp, Unknown; identical to SEQ ID NO: 934
  Bacillus sp. multi

SEQ ID NO: 944 - DNA, 262 bp, Unknown
  Bacillus sp. multi
tacaagggattgtcgcaatattcgttattaatcatctatctattatcggggttaaaacataacaatagatgtattgaaattgaacttaaagattctataggggacgatcctaacgcgttaaaacataacaatagatgtattgaaatttccctgagagaaagaaataggtgtttatatgaaagttaaaacataacaatagatgtattgaaattggggaaatgctcggcacttcacaaaatcattgcgaagtttaaacaacctg

SEQ ID NO: 945 - DNA, 393 bp, Bacillus thuringiensis
tacaagggatcgtcgcacattcattgttaatcatccatatattatcgggggttaaaacataacaatagatgtattgaaattttaaagatttttgaacctttccaggagttaaacccagttaaaacataacaatagatgtattgaaatattatgaatggatacatacagcacgagcttccttcgttaaaacataacaatagatgtattgaaatttatcagcaaccattaaataaagggcgattgctgaagttaaaacataacaatagatgtattgaaatacttattaataagtcggtaagagccctctattcaggttttaacaaactaatagatgtatttaaaaagaaaacaaatcaataagaaaccctgggtgcaagagtgtgaattattaaa

SEQ ID NO: 946 - DNA, 391 bp, Unknown
  Bacillus sp. multi
atataagggatcgtcgcacattcattgttaatcatccatatattatcgggggttaaaacataacaatagatgtattgaaattgatgttccagcaaatcactggtctacgaaagcaatgttaaaacataacaatagatgtattgaaattgcgaagcacttgccaggacgcgtaggatttgcaggttaagacataacaatagatgtattgaaattcaagtgggcggcctttctaaaacacttttattggttaaaacataacaatagatgtattgaaatacttattattaagtcggtaagagccctctatttaggttataacaaactaatagatgtatttaaaaagataacaaatcaataagaaaccctgggtgcaagagtgtgaattattaaa

SEQ ID NO: 947 - DNA, 382 bp, Unknown
  Bacillus sp. multi
gtcgtacaattcattgttcatcatccatatattatcgggggttaaaacaaaacaatagatgtattgaaattccttcatgaaccttttatctatccgatccatcagttaaaacaaaacaatggatgtattgaaatgttgaaatgtatgaagaaagcacccctaaactaaggttaaaacataaaaatagatgtattgaaatattcgttgaataataaaatcaccaataagcacggtgagttaaaaacataacaatagatgtattgaaatctagtagttaatttgaactgggtatttgacagtgtgttgaaataaaacaatagatgtattgaaattgggggaatgctcggcacttcactaaatcattgcgaagtttaaacaacac

SEQ ID NO: 948 - DNA, 393 bp, Unknown
  Bacillus sp. multi
tacaagggatcgtcgcacattcattgttaatcatccatatattatcgggggttaaaacataacaatagatgtattgaaattttaaagatttttgaacctttccaggagttaaacccagttaaaacataacaatagatgtattgaaatattatgaatggatacatacagcacgagcttccttcgttaaaacataacaatagatgtattgaaatttatcagcaaccattaaataaagggcgattgctgaagttaaaacataacaatagatgtattgaaatacttattaataagtcggtaagagccctctattcaggttttaacaaactaatagatgtatttaaaaagaaaacaaatcaataagaaaccctgggtacaagagtgtgaattattaaa

SEQ ID NO: 949 - DNA, 393 bp, Unknown; identical to SEQ ID NO: 948
  Bacillus sp. multi

SEQ ID NO: 950 - DNA, 404 bp, Unknown
  Bacillus sp. multi
acaagggatcgtcgcacaattcattgttaatcatccatatattatcgggggttaaaacataacaatagatgtattgaaatacaataatgtcctggcactcctggtatggcgctagttaaaacataacaatagatgtattgaaatttgctcgaatagtgtcatccgtattctcgtcgtttgttaaaacataacaatagatgtattgaaatattgagtaataattgcaacaaatgattttctaagtggttaaaacataacaatggatgtattgaaatcttttttatccaagagatatttcataaattctgcttgttaaattcctgagttaaaacaaaacgatagatatttaggaatctcaaagggatttgattatatttgtttataaatagaagcaatgttatgat

SEQ ID NO: 951 - DNA, 327 bp, Unknown
  Bacillus sp. multi
tacaagggatcgtcgcacattcattgttaatcatccatatattatcgggggttaaaacataacaatagatgtattgaaattttaaagatttttgaacctttccaggagttaaacccagttaaaacataacaatagatgtattgaaatattatgaatggatacatacagcacgagcttccttcgttaaaacataacaatagatgtattgaaatacttattaataagtcggtaagagccctctattcaggttttaacaaactaatagatgtatttaaaaagaaaacaaatcaataagaaaccctgggtacaagagtgtgaattattaaa

SEQ ID NO: 952 - DNA, 404 bp, Unknown
  Bacillus sp. multi
acaagggatcgtcgcacaattcattgttaatcatccatatattatcgggggttaaaacataacaatagatgtattgaaattgctataattatattgtcgagatacaactaagcaagttaaaacataacaatagatgtattgaaatacaataatgtcctggcactcctggtatggcgctagttaaaacataacaatagatgtattgaaatattgagtaataattgcaacaaatgattttctaagtggttaaaacataacaatggatgtattgaaatcttttttatccaagagatatttcataaattctgcttgttaaattcctgagttaaaacaaaacgatagatatttaggaatctcaaagggatttgattatatttgtttataaatagaagcaatgttatgat

SEQ ID NO: 953 - DNA, 393 bp, Unknown; identical to SEQ ID NO: 948
  Bacillus sp. multi

SEQ ID NO: 954 - DNA, 404 bp, Unknown; identical to SEQ ID NO: 950
  Bacillus sp. multi

SEQ ID NO: 955 - DNA, 393 bp, Unknown; identical to SEQ ID NO: 948
  Bacillus sp. multi

SEQ ID NO: 956 - DNA, 404 bp, Unknown; identical to SEQ ID NO: 950
  Bacillus sp. multi

SEQ ID NO: 957 - DNA, 393 bp, Unknown; identical to SEQ ID NO: 945
  Bacillus sp. multi

SEQ ID NO: 958 - DNA, 469 bp, Unknown
  Bacillus sp. multi
acaagggatcgtcgcacaattcattgttaatcatccatatattatcgggggttaaaacataacaatagatgtattgaaattgctataattatattgtcgagatacaactaagcaagttaaaacataacaatagatgtattgaaatacaataatgtcctggcactcctggtatggcgctagttaaaacataacaatagatgtattgaaatttgttcgaatagtgtcatccgtattctcgtcgtttgttaaaacataacaatagatgtattgaaatattgagtaataattgcaacaaatgattttctaagtggttaaaacataacaatggatgtattgaaatattttttatccaagagatatttcataaattctgcttgttaaattcctgagttaaaacaaaacgatagatatttaggaatctcatagggatttgattatatttgtttataaatagaagcaatgttatgat

SEQ ID NO: 959 - DNA, 393 bp, Unknown; identical to SEQ ID NO: 945
  Bacillus sp. multi

SEQ ID NO: 960 - DNA, 404 bp, Unknown; identical to SEQ ID NO: 950
  Bacillus sp. multi

SEQ ID NO: 961 - DNA, 393 bp, Unknown; identical to SEQ ID NO: 945
  Bacillus sp. multi

SEQ ID NO: 962 - DNA, 327 bp, Unknown
  Bacillus sp. multi
tacaagggatcgtcgcacattcattgttaatcatccatatattatcgggggttaaaacataacaatagatgtattgaaattttaaagatttttgaacctttccaggagttaaacccagttaaaacataacaatagatgtattgaaatattatgaatggatacatacagcacgagcttccttcgttaaaacataacaatagatgtattgaaatacttattaataagtcggtaagagccctctattcaggttttaacaaactaatagatgtatttaaaaagaaaacaaatcaataagaaaccctgggtgcaagagtgtgaattattaaa

SEQ ID NO: 963 - DNA, 393 bp, Unknown; identical to SEQ ID NO: 945
  Bacillus sp. multi

SEQ ID NO: 964 - DNA, 327 bp, Unknown; identical to SEQ ID NO: 962
  Bacillus sp. multi

SEQ ID NO: 965 - DNA, 327 bp, Unknown; identical to SEQ ID NO: 962
  Bacillus sp. multi

SEQ ID NO: 966 - DNA, 256 bp, Unknown
  Bacillus sp. multi
tacaagggattgttgcaatattcgttattaatcatctatctattatcggggttaaaacataacaatagatgtattgaaattgaacttaaagattctataggggacgatcctaacgcgttaaaacataacaatagatgtattgaaatttccctgagagaaagaaataggtgtttatatgaaagttaaaacataacaatagatgtatttaaattggggaaatgctcggcacttcacaaaatcattgcgaagtttaaac

SEQ ID NO: 967 - DNA, 256 bp, Unknown; identical to SEQ ID NO: 966
  Bacillus sp. multi

SEQ ID NO: 968 - DNA, 256 bp, Unknown; identical to SEQ ID NO: 966
  Bacillus sp. multi

SEQ ID NO: 969 - DNA, 256 bp, Unknown; identical to SEQ ID NO: 966
  Bacillus sp. multi

SEQ ID NO: 970 - DNA, 212 bp, Bacillus cereus
tacaagggattgttgcaatattcgttattaatcatctatctattatcggggttaaaacataacaatagatgtattgaaattgaacttaaagattctataggggacgatcctaacgcgttaaaacataacaatagatgtattgaaatttccctgagagaaagaaataggtgtttatatgaaagttaaaacataacaatagatgtattgaaatt

SEQ ID NO: 971 - DNA, 256 bp, Unknown; identical to SEQ ID NO: 966
  Bacillus sp. multi

SEQ ID NO: 972 - DNA, 256 bp, Unknown; identical to SEQ ID NO: 966
  Bacillus sp. multi

SEQ ID NO: 973 - DNA, 256 bp, Unknown; identical to SEQ ID NO: 966
  Bacillus sp. multi

SEQ ID NO: 974 - DNA, 256 bp, Bacillus cereus; identical to SEQ ID NO: 966

SEQ ID NO: 975 - DNA, 256 bp, Unknown; identical to SEQ ID NO: 966
  Bacillus sp. multi

SEQ ID NO: 976 - DNA, 256 bp, Unknown; identical to SEQ ID NO: 966
  Bacillus sp. multi

SEQ ID NO: 977 - DNA, 256 bp, Unknown; identical to SEQ ID NO: 966
  Bacillus sp. multi

SEQ ID NO: 978 - DNA, 256 bp, Unknown; identical to SEQ ID NO: 966
  Bacillus sp. multi

SEQ ID NO: 979 - DNA, 256 bp, Unknown; identical to SEQ ID NO: 966
  Bacillus sp. multi

SEQ ID NO: 980 - DNA, 256 bp, Unknown; identical to SEQ ID NO: 966
  Bacillus sp. multi

SEQ ID NO: 981 - DNA, 256 bp, Bacillus thuringiensis; identical to SEQ ID NO: 966

SEQ ID NO: 982 - DNA, 256 bp, Unknown; identical to SEQ ID NO: 966
  Bacillus sp. multi

SEQ ID NO: 983 - DNA, 318 bp, Unknown
  Bacillus sp. multi
agggatcgtcgcacattcattgttaatcatccatatattatcgggttaagacataacaatagatgtattgaaatattacaaaagctagttctttttcctccgcgtatatgttaagacataacaatagatgtattgaaattcaagtgggcggcctttctaaaacacttttattggttaaaacataacaatagatgtattgaaatacttattaataagtcggtaagagccctttatttaggttataacaaactaatagatgtatttaaaaagataacaaatcaataagaaaccctgggtgcaagagtgtgaattattaaa

SEQ ID NO: 984 - DNA, 393 bp, Unknown
  Bacillus sp. multi
tacaagggatcgtcgcacattcattgttaatcatccatatattatcgggggttaaaacataacaatagatgtattgaaattttaaagatttttgaacctttccaggagttaaacccagttaaaacataacaatagatgtattgaaatattatgaatggatacatacagcacgagcttccttcgttaaaacataacaatagatgtattgaaatttatcagcaaccattaaataaagggtgattgctgaagttaaaacataacaatagatgtattgaaatacttattaataagtcggtaagagccctctattcaggttttaacaaactaatagatgtatttaaaaagaaaacaaatcaataagaaaccctgggtgcaagagtgtgaattattaaa

SEQ ID NO: 985 - DNA, 457 bp, Unknown
  Bacillus sp. multi
tacaagggatcgtcgcacattcattgttaatcatccaaatattatcgggggttaaatcataacaatagatgtattgaaatttgttgaataagggaacgatgactacaatacagcgttaaaacataacaatagatgtattgaaattttagcccagaatatacttttaaaaaaggtagagaagttaaaacataacaatagatgtattgaaattcttgtctcttactccaatcctgcagctccttgaaggttaaaacataacaatagatgtattgaaataatgtgtttgctaagccttctaacggtgctttaatcgttaaaacataacaatagatgtattgaaatacttattaataagtcggttagggcccacaattcagggtttaacaaactaatagatgtatttaaaaagataacaaatcaataagaaatcctgggtgcaggagtgtgaattattaaa

SEQ ID NO: 986 - DNA, 590 bp, Unknown
  Bacillus sp. multi
tacaagggattgtcgcaatattaattgttaatcattcatatattatcggggttaaaacctaacaatagatgtattgaaataattgcatccaatctaaatctagcaaaattaagtgagttaaaacctaacaatagatgtattgaaatctcctacttttgaggtagaggctggtcggggtgtgggttaaaacctaacaatagatgtattgaaatgctttagcatttaactcactaacatcactaacttgttaaaacctaacaatagatgtattgaaattgtggaaggtacactttaccgctaggcgtaactccagttaaaacctaacaatagatgtattgaaatgcgaatacagaccgtatatttgcaaatggcatgaaggttaaaacctaacaatagatgtattgaaataactatggattaaaggattcttatccaatgactcagttaaaacctaacaatagatgtattgaaattggggaaacgctcggtacttcacaaaatcattgcgaagtttaaacaaaacgatagatatttaggaatctcattgagccctgattatatttgtatataaatagagtaaatgttaatat

SEQ ID NO: 987 - DNA, 457 bp, Unknown; identical to SEQ ID NO: 985
  Bacillus sp. multi

SEQ ID NO: 988 - DNA, 590 bp, Unknown; identical to SEQ ID NO: 986
  Bacillus sp. multi

SEQ ID NO: 989 - DNA, 457 bp, Unknown; identical to SEQ ID NO: 985
  Bacillus sp. multi

SEQ ID NO: 990 - DNA, 524 bp, Unknown
  Bacillus sp. multi
tacaagggattgtcgcaatattaattgttaatcattcatatattatcggggttaaaacctaacaatagatgtattgaaataattgcatccaatctaaatctagcaaaattaagtgagttaaaacctaacaatagatgtattgaaatgctttagcatttaactcactaacatcactaacttgttaaaacctaacaatagatgtattgaaattgtggaaggtacactttaccgctaggcgtaactccagttaaaacctaacaatagatgtattgaaatgcgaatacagaccgtatatttgcaaatggcatgaaggttaaaacctaacaatagatgtattgaaataattatggattaaaggattcttatccaatgactcagttaaaacctaacaatagatgtattgaaattggggaaacgctcggtacttcacaaaatcattgcgaagtttaaacaaaacgatagatatttaggaatctcattgagccctgattatatttgtatataaatagagtaaatgttaatat

SEQ ID NO: 991 - DNA, 457 bp, Unknown; identical to SEQ ID NO: 985
  Bacillus sp. multi

SEQ ID NO: 992 - DNA, 590 bp, Unknown; identical to SEQ ID NO: 986
  Bacillus sp. multi

SEQ ID NO: 993 - DNA, 393 bp, Unknown
  Bacillus sp. multi
tacaagggatcgtcgcacattcattgttaatcatccatatattatcgggggttaaaacataacaatagatgtattgaaattttaaagatttttgaacctttccaggagttaaacccagttaaaacataacaatagatgtattgaaatttatcagcaaccattaaataaagggcgattgctgaagttaaaacataacaatagatgtattgaaatattatgaatggatacatacagcacgagcttccttcgttaaaacataacaatagatgtattgaaatacttattaataagtcggtaagagccctctattcaggttttaacaaactaatagatgtatttaaaaagaaaacaaatcaataagaaaccctgggtgcaagagtgtgaattattaaa

SEQ ID NO: 994 - DNA, 326 bp, Unknown
  Bacillus sp. multi
acaagggatcgtcgcacaattcattgttaatcttctatatattatcgggggttaaaacataacaatagatgtattgaaattcaacatgcatttgaatagctttcgatgtgttgttggttaaaacataacaatagatgtattgaaatgtttgagcagcagttgccttcatcacctgtttcttgttaaaacataacaatagatgtattgaaatatgcattctttatgtgcagcctggtattttcctgagttaaaacaaaacgatagatatttaggaatctcatagggatttgattatatttgtttataaatagaagcaatgttatgat

SEQ ID NO: 995 - DNA, 328 bp, Unknown
  Bacillus sp. multi
aatacaagggatcgtcgcacattcattgttaatcatccatatattatcgggttaaaacataacaatagatgtattgaaatccttctacacgaacccggtatacatctgaaccgtcagttaaaacataacaatagatgtattgaaattctaaagatttttgaacctttccaggagttagacccagttaaaacataacaatagatgtattgaaatacttattattaagtcggtaagagccctctattcagggtttaacaaactaattgatgtttttaaaagaattacaaatcaataagaaaccctgggtgcaagagtgtgaatcattaaa

SEQ ID NO: 996 - DNA, 318 bp, Unknown
  Bacillus sp. multi
gtcgtacaattcattgttcatcatccatatattatcgggggttaaaacaaaacaatagatgtattgaaatgttgaaatgtatgaagaaagcacccctaaactaaggttaaaacataacaatagatgtattgaaatattcgttgaataataaactcaccaataagcacggtgagttaaaaacataacaatagatgtattgaaatctagtagttaatttgaactgggtatttgacagtgtgttgaaataaaacaatagatgtattgaaattgggggaatgctcggcacctcactaaatcattgcgaagtttaaacaacac

SEQ ID NO: 997 - DNA, 251 bp, Unknown
  Bacillus sp. multi
agggatcgtcgcacaatgcattgttcatcatccatatattatcgggggttaaacataacaatagatgtattgaaataggtacctcgaaattaataatctagtacgttcgttggttaaacataacaatagatgtattgaaatatagttgaaacttttccttttaacaaactttcatggttaaaacataacaatagatgtatttaaaaagataataaatcaaaaagaaaccctgggtgcaagagtgtgaatta

SEQ ID NO: 998 - DNA, 251 bp, Unknown; identical to SEQ ID NO: 997
  Bacillus sp. multi

SEQ ID NO: 999 - DNA, 318 bp, Unknown
  Bacillus sp. multi
cgtcgtacaattcattgttcatcatccatatattatcggggttaaaacaaaacaatagatgtattgaaatgttgaaatgtatgaagaaagcacccctaaactaaggttaaaacataacaatagatgtattgaaatattcgttgaataataaaatcaccaataagcatggtgagttaaaaacataacaatagatgtattgaaatctagtagttaatttgaactgggtatttgacagtgtgttgaaataaaacaatagatgtattgaaattgttggaatgctcggcacttcactaaatcattgcgaagtttaaacaacac

SEQ ID NO: 1000 - DNA, 391 bp, Unknown
  Bacillus sp. multi
ataagggattgtcgcaatatttattgttaatcatccatatattatcgagataaaacataacaatagatgtattgaaatgcagacagccaagcaaccatatgaggaggaatcttaggtaaaacataacaatagatgtattgaaatgcgtcctctttttatataaaaggaggaacctggtaggtaaaacataataatagatgtattgaaatcataacggttggtttatagtctccaaaacgataacctgttaaaacataacaatagatgtattgaaatatctccgcctactcttattgatgaaatatatttaagttaaaacataacaatagaagcgctaatcccgaaacctcctaaacgttaaaacataacaatagatgtattgaaatactta

SEQ ID NO: 1001 - DNA, 458 bp, Unknown
  Bacillus sp. multi
ataagggattgtcgcaatatttattgttaatcatccatatattatcgagataaaacataacaatagatgtattgaaatgcagacagccaagcaaccatatgaggaggaatcttaggtaaaacataacaatagatgtattgaaatgcgtcctctttttatataaaaggaggaacctggtaggtaaaacataataatagatgtattgaaatcataacggttggtttatagtctccaaaacgataacccgttaaaacataacaatagatgtattgaaatcagcttgccggcacgaaagagcgttctctacactagttagaacaaaacaatagatgtattgaaatacttattaataagtcggtaagagagtcctctattcaggggttaacaaactaatagatgtttttaaaagaataacaaatcaataagaaaccctgggtgcaagagtgtgaattattaaa

SEQ ID NO: 1002 - DNA, 391 bp, Unknown; identical to SEQ ID NO: 1000
  Bacillus sp. multi

SEQ ID NO: 1003 - DNA, 318 bp, Unknown; identical to SEQ ID NO: 996
  Bacillus sp. multi

SEQ ID NO: 1004 - DNA, 318 bp, Unknown; identical to SEQ ID NO: 996
  Bacillus sp. multi

SEQ ID NO: 1005 - DNA, 318 bp, Unknown; identical to SEQ ID NO: 996
  Bacillus sp. multi

SEQ ID NO: 1006 - DNA, 326 bp, Unknown; identical to SEQ ID NO: 994
  Bacillus sp. multi

SEQ ID NO: 1007 - DNA, 326 bp, Unknown; identical to SEQ ID NO: 994
  Bacillus sp. multi

SEQ ID NO: 1008 - DNA, 318 bp, Unknown; identical to SEQ ID NO: 996
  Bacillus sp. multi

SEQ ID NO: 1009 - DNA, 318 bp, Unknown; identical to SEQ ID NO: 996
  Bacillus sp. multi

SEQ ID NO: 1010 - DNA, 318 bp, Unknown; identical to SEQ ID NO: 996
  Bacillus sp. multi

SEQ ID NO: 1011 - DNA, 318 bp, Unknown; identical to SEQ ID NO: 996
  Bacillus sp. multi

SEQ ID NO: 1012 - DNA, 318 bp, Unknown; identical to SEQ ID NO: 996
  Bacillus sp. multi

SEQ ID NO: 1013 - DNA, 318 bp, Unknown; identical to SEQ ID NO: 996
  Bacillus sp. multi

SEQ ID NO: 1014 - DNA, 318 bp, Unknown; identical to SEQ ID NO: 996
  Bacillus sp. multi

SEQ ID NO: 1015 - DNA, 318 bp, Unknown; identical to SEQ ID NO: 996
  Bacillus sp. multi

SEQ ID NO: 1016 - DNA, 318 bp, Bacillus weihenstephanensis; identical to SEQ ID NO: 996

SEQ ID NO: 1017 - DNA, 318 bp, Unknown; identical to SEQ ID NO: 996
  Bacillus sp. multi

SEQ ID NO: 1018 - DNA, 318 bp, Unknown; identical to SEQ ID NO: 996
  Bacillus sp. multi

SEQ ID NO: 1019 - DNA, 318 bp, Unknown; identical to SEQ ID NO: 996
  Bacillus sp. multi

SEQ ID NO: 1020 - DNA, 318 bp, Unknown; identical to SEQ ID NO: 996
  Bacillus sp. multi

SEQ ID NO: 1021 - DNA, 318 bp, Unknown; identical to SEQ ID NO: 996
  Bacillus sp. multi

SEQ ID NO: 1022 - DNA, 318 bp, Unknown; identical to SEQ ID NO: 996
  Bacillus sp. multi

SEQ ID NO: 1023 - DNA, 318 bp, Unknown; identical to SEQ ID NO: 996
  Bacillus sp. multi

SEQ ID NO: 1024 - DNA, 318 bp, Unknown; identical to SEQ ID NO: 996
  Bacillus sp. multi

SEQ ID NO: 1025 - DNA, 384 bp, Unknown
  Bacillus sp. multi
tatcgcaatattcattgttaatcatccatatattatcgaggtttaaacttaacaatagatgtattgaaatattaatttctctatcaccataatgtcattgtctgtgtttaaacttaacaatagatgtattgaaattcccaacaacaaatcgacccttgagccttagatactgtttaaacaaaacaatagatgtattgaaatcttgttataactgtctcttcatacatataaggcgaatgtttaaacaaaacaatagatgtattgaaatgaatatccaggaacctttttactaggcgggggataagttttaaaaaaacaatagatgtattgaaattcatcaatctttatattatttataggtttagaattcttattgagctacaa

SEQ ID NO: 1026 - DNA, 384 bp, Bacillus; identical to SEQ ID NO: 1025

SEQ ID NO: 1027 - DNA, 426 bp, Unknown
  Bacillus sp. multi
atataagggattgtcgcaatatttattgttaatcatccatatattatcgagataaaacataacaatagatgtattgaaatgcgtcctctttttatataaaaggaggaacctggtaggtaaaacataataatagatgtattgaaatcataacggttggtttatagtctccaaaacgataacctgttaaaacataacaatagatgtattgaaatatctccgcctactcttattgatgaaatatatttaagttaaaacataacaatagaagcgctaatcccgaaacctcctaaacgttaaaacataacaatagatgtattgaaatcagcttgccggcacgaaagagcgttctctacactagttagaacaaaacaatagatgtattgaaatacttattaataagtcggtaagagagtcctctattcaggg

SEQ ID NO: 1028 - DNA, 255 bp, Unknown
  Bacillus sp. multi
attggcgcaaaattcattgttaaacatccatatattatcggggttaaaacataacaatagatgtattgaaatgggtttattcttgtctttcttcgccctgatcacaatagtttaaatataacaatagatgtattgaaatgtcttataagtcctcgtaatacttaacgatctactggttaaaacagaacaataaatgttttgaaattggggaaacgcttggcacatcgcaaaatcatggcgaagtttaaacaaacc

SEQ ID NO: 1029 - DNA, 393 bp, Unknown
  Bacillus sp. multi
tacaagggatcgtcgcacattcattgttaatcatccatatattatcgggggttaaaatataacaatagatgtattgaaattttaaagatttttgaacctttccaggagttaaacccagttaaaacataacaatagatgtattgaaatattatgaatggatacatacagcacgagcttccttcgttaaaacataacaatagatgtattgaaatttatcagcaaccattaaataaagggcgattgctgaagttaaaacataacaatagatgtattgaaatacttattaataagtcggtaagagccctctattcaggttttaacaaactaatagatgtatttaaaaagaaaacaaatcaataagaaaccctgggtgcaagagtgtgaattattaaa

SEQ ID NO: 1030 - DNA, 326 bp, Unknown; identical to SEQ ID NO: 994
  Bacillus sp. multi

SEQ ID NO: 1031 - DNA, 393 bp, Unknown; identical to SEQ ID NO: 1029
  Bacillus sp. multi

SEQ ID NO: 1032 - DNA, 393 bp, Unknown; identical to SEQ ID NO: 1029
  Bacillus sp. multi

SEQ ID NO: 1033 - DNA, 326 bp, Unknown; identical to SEQ ID NO: 994
  Bacillus sp. multi

SEQ ID NO: 1034 - DNA, 393 bp, Unknown; identical to SEQ ID NO: 1029
  Bacillus sp. multi

SEQ ID NO: 1035 - DNA, 326 bp, Unknown; identical to SEQ ID NO: 994
  Bacillus sp. multi

SEQ ID NO: 1036 - DNA, 393 bp, Unknown; identical to SEQ ID NO: 1029
  Bacillus sp. multi

SEQ ID NO: 1037 - DNA, 326 bp, Unknown; identical to SEQ ID NO: 994
  Bacillus sp. multi

SEQ ID NO: 1038 - DNA, 393 bp, Unknown; identical to SEQ ID NO: 1029
  Bacillus sp. multi

SEQ ID NO: 1039 - DNA, 326 bp, Unknown; identical to SEQ ID NO: 994
  Bacillus sp. multi

SEQ ID NO: 1040 - DNA, 327 bp, Unknown; identical to SEQ ID NO: 934
  Bacillus sp. multi

SEQ ID NO: 1041 - DNA, 256 bp, Unknown
  Bacillus sp. multi
tacaagggattgtcgcaatattcgttattaatcatctatctattatcggggttaaaacataacaatagatgtattgaaattgaacttaaagattctataggggacgatcctaacgcgttaaaacataacaatagatgtattgaaatttccctgagagaaagaaataggtgtttatatgaaagttaaaacataacaatagatgtatttaaattggggaaatgctcggcacttcacaaaatcattgcgaagtttaaac

SEQ ID NO: 1042 - DNA, 393 bp, Unknown; identical to SEQ ID NO: 993
  Bacillus sp. multi

SEQ ID NO: 1043 - DNA, 393 bp, Unknown; identical to SEQ ID NO: 1029
  Bacillus sp. multi

SEQ ID NO: 1044 - DNA, 326 bp, Unknown
  Bacillus sp. multi
acaagggatcgtcgcacaattcattgtttatcttctatatattatcgggggttaaaacataacaatagatgtattgaaattcaacatgcatttgaatagctttcgatgtgttgttggttaaaacataacaatagatgtattgaaatgtttgagcagcagttgccttcatcacctgtttcttgttaaaacataacaatagatgtattgaaatatgcattctttatgtgcagcctggtattttcctgagttaaaacaaaacgatagatatttaggaatctcatagggatttgattatatttgtttataaatagaagcaatgttatgat

SEQ ID NO: 1045 - DNA, 393 bp, Unknown; identical to SEQ ID NO: 1029
  Bacillus sp. multi

SEQ ID NO: 1046 - DNA, 326 bp, Unknown; identical to SEQ ID NO: 1044
  Bacillus sp. multi

SEQ ID NO: 1047 - DNA, 393 bp, Unknown; identical to SEQ ID NO: 1029
  Bacillus sp. multi

SEQ ID NO: 1048 - DNA, 326 bp, Unknown; identical to SEQ ID NO: 1044
  Bacillus sp. multi

SEQ ID NO: 1049 - DNA, 393 bp, Unknown; identical to SEQ ID NO: 1029
  Bacillus sp. multi

SEQ ID NO: 1050 - DNA, 326 bp, Unknown; identical to SEQ ID NO: 1044
  Bacillus sp. multi

SEQ ID NO: 1051 - DNA, 393 bp, Unknown
  Bacillus sp. multi
tacaagggattgtcacaatattaattgttaatcatccatatattatcggggttaaaacctaacaatagatgtattgaaatacgccatctccctgattaggaggtgatgtttgtgttgttaaaacataacaatagatgtattgaaatataattgtctgataacaacacgactgaatattgggagttaaaacataacaatagatgtattgaaattgcaatccctcctacaggcctaattctgctgcaagttaaaacataacaataaatgtattgaaattggggaaacgctcggcacttcacaaaatcattgcgaagtttaaacaaaacgatagatatttaggaatctcattgagccttgattatatttgtatataaatagagtaaatgttaatat

SEQ ID NO: 1052 - DNA, 327 bp, Unknown
  Bacillus sp. multi
tacaagggatcgtcgcacattcattgttaatcatccatatattatcgggggttaaaacataacaatagatgtattgaaattttaaagatttttgaacctatccaggagttaaacacagttaaaacataacaatagatgtattgaaatattatgaatggatacatacagcacgagcttccttcgttaaaacataacaatagatgtattgaaatacttattaataagtcggtaagagccctctattcaggttttaacaaactaatagatgtatttaaaaagaaaacaaatcaataagaaaccctgggtgcaagagtgtgaattattaaa

SEQ ID NO: 1053 - DNA, 391 bp, Unknown
  Bacillus sp. multi
cacaagggatcgtcgcacaattcattgttaatcatccatatattatcgggggttaaaacataacaatagatgtattgaaattgctataattatattgtcgagatacaactaagcaagttaaaacataacaatagatgtattgaaatacaataatgccctggcactcctggtatggcgctagttaaaacataacaatagatgtattgaaattttaaagatttttgaacctatccaggagttaaacacagttaaaacataacaatagatgtattgaaatacaataatgccctggcactcctggtatggcgctagttaaaacataacaatagatgtattgaaatttgctcgaatagtgtcatccgtattctcgtcgtttgttaaaacataagat

SEQ ID NO: 1054 - DNA, 251 bp, Unknown
  Bacillus sp. multi
tatcgcaatattcattgttaatcatccatatattatcggggtttaaacaaaacaatagatgtattgaaatgttgtaggtttcatttcatctaaaatttcacgtaagtttaaacataacaatagatgtattgaaatgaatatccaggaacctttttactaggtgggggatacgtttaaacaaaacaatagatgtattgaaattcatcaatctttatattatttataggtttagaagtcttattgagctacaa

SEQ ID NO: 1055 - DNA, 329 bp, Unknown
  Bacillus sp. multi
acaagggatattcgcaatcttttttgttatatatcccaatgttcttgggagttcaaaccaaacaatagatgtattgaaatttagaaggtcttcttaatacctgatacgtcacatatcgttcaaaccaaacaatagatgtattgaaatttatgcaattctgcatattccttcatgattttgtaggttcaaaccaaacaatagatgtattgaaattcgcctgtaacaataataattttattacttaaatcgttcaaactaaacaatagatgtattgaaattggggagagtgcgcaaagggacatttaaactgataaaaaaactcggatgaa

SEQ ID NO: 1056 - DNA, 329 bp, Unknown; identical to SEQ ID NO: 1055
  Bacillus sp. multi

SEQ ID NO: 1057 - DNA, 717 bp, Bacillus megaterium
atttttagttaaaaccacatgtttttgtgttgttttggttaaaaatcgccgtcacaccctacatgggtgtaaggattgaaatatggcatcggatgtatttacacctagttcagtaatgtcacaccctacatgggtgtaaggattgaaattggatccgcccactcataaagatcttggcttatagtcacaccctacatgggtgtgaggattgaaattctccccctttttttcgtacagaaattggcgaaggggcacattctacatgaatgtaaggattgaaattaatacaacatttacttataacgacatcggcacagtcacatcttacatggatgtgaggattgaaattgttcgtggcttttggtacatcctacgagacttagtcacattctacatagatgtgaggattgaaattgttggtccatacttttcaagataagggattactgtcacaccctacatgggtgtgaggattgaaatcaccaataaaacataaatcataaccattacttacatcacatcctacatagatgtgaagattgaaataatatgtagatgaacctaattatgcggctatcttgtcacatcctacatgggtgtgtggattgaaattatctatttttgtccatatggcattttaatgcatggtcacatcctacaaggatgtgtggattgaaattctattagtcataactgatcgctccatataacatgatg

SEQ ID NO: 1058 - DNA, 323 bp, Unknown
  Bacillus sp. multi
gtgtatcaaaaggttgctattgcagctttttgaaacgaatttacataggatttgatatcaactatgtagaatgtaaattttctacaaaatgaaatttttataatcaatcttcatcatttgatatcaactatgtggaatgtaaattgaaacgaggattaagcgtattacagaaaaaagtttgtttaatatcaactatatggaatgtaaatcctaagggtttgtgttttctcttctcagattctatgtttgatatcaattatgtggaatgtaaataagtttgtattttcgttgaatttaatttgttggtaagtttaatatcaact

SEQ ID NO: 1059 - DNA, 323 bp, Unknown; identical to SEQ ID NO: 1058
  Bacillus sp. multi

SEQ ID NO: 1060 - DNA, 1234 bp, Unknown
  Bacillus sp. multi
ggtatgcaaaaaggttgttattgcagcttttttaaacacatttacatagggattgatattaactacatggagtgtaaaggctatggtatccagtacaatcgagaaatgctccgttgtttgatatcaactatatggaatataaatatggcttctatgcaattccaaaacttgcaacaataagtttgatatcaactacataaaatgtaaatagtagaaacataagcacttgcacatgattttggcaaggtttgatatcacctatatggaatgtaaattcgccccaacgctggatgatttccgcatcaactttgtttgatattaaatatatggaatgtaaatattaagataactaatttttgcattacatctacacctgattgggtatcaacaatatggaatgtaaatcctagctgatttgtttctttttacgaccacgtttgtttgatatcaactaaatggaatgtaaatgggttgtcattaccgtagccttctaacaaaattacgtgttggatatcaactatatgggctgtaaatacctctctatttagttattaaaatggtaagtcatcgtttgatatcgactataaggaatgtaaatgactaaacagcacaccaaaatgtaaggtcgaagttggtttgatatcacttatatgaaatgtaaatgtctcagcaccgaaaattcgttttttccttcgcctgaagtttgatatcaactaaatggaatgtaaatcttaaccgcttgagtaacttttatgtaacaaagtggtcgaatatcaacaatatgaaatgtaaatctcagaacgtaagcacttaaaaaataaaaatcaaggtttgatatcaactatacggaatgtaaatattatgtgtgttggctgaaggtaagtttaacaagaagtttaataccaatgatatggaatgtaaatcctaagggtttgtgattttcttttctcaggttctatgtttgatattaactatgtggaatataaatttgattatggggatggcattaggttatggaacgattgtttgatatcgactatgtggaatgtgaatttcagcttagaggatgaaattaattcgcggtatatcagtttaatatcagctatatggaatgtaaatctagtttgctgtatccatttataaccggggaacaacgtttgatatcaactatatgagaaggagttcttatcagcagacttcctattttagtgaagtgataaatatattttgaaaa

SEQ ID NO: 1061 - DNA, 1234 bp, Unknown
  Bacillus sp. multi
ggtatgcaaaaaggttgttattgcagcttttttaaacacatttacatagggattgatattaactacatggagtgtaaaggctatggtatccagtacaatcgagaaattctccgttgtttgatatcaactatatggaatataaatatggcttctatgcaattccaaaacttgcaacaataagtttgatatcaactacataaaatgtaaatagtagaaacataagcacttgcacatgattttggcaaggtttgatatcacctatatggaatgtaaattcgccccaacgctggatgatttccgcatcaactttgtttgatattaaatatatggaatgtaaatattaagataactaatttttgcattacatctacacctggttgggtatcaacaatatggaatgtaaatcctagctgatttgtttctttttacgaccacgtttgtttgatatcaactaaatggaatgtaaatgggttgtcattaccgtagccttctaacaaaattacgtgttggatatcaactatatgggctgtaaatacctctctatttagtttttaaaatggtaagtcatcgtttgatatcgactataaggaatgtaaatgactaaacagcacaccaaaatgtaaggtcgaagttggtttgatatcacttatatgaaatgtaaatgtctcagcaccgaaaattcgttttttccttcgcctgaagtttgatatcaactaaatggaatgtaaatcttaaccgcttgagtaacttttatgtaacaaagtggtcgaatatcaacaatatgaaatgtaaatctcagaacgtaagcacttaaaaaataaaaatcaaggtttgatatcaactatacggaatgtaaatattatgtgtgttggctgaaggtaagtttaacaagaagtttaataccaatgatatggaatgtaaatcctaagggtttgtgattttcttttctcaggttctatgtttgatattaactatgtggaatataaatttgattatggggatggcattaggttatggaacgattgtttgatatcgactatgtggaatgtgaatttcagcttagaggatgaaattaattcgcggtatatcagtttaatatcagctatatggaatgtaaatctagtttgctgtatccatttataaccggggaacaacgtttgatatcaactatatgagaaggagttcttatcagcagacttcctattttagtgaagtgataaatatattttgaaaa

SEQ ID NO: 1062 - DNA, 1603 bp, Unknown
  Paenibacillus thiaminolyticus (multi)
ccacgcatccgcgtaggatgcgacgtttccgttttttcttcccatccactatgacggatttcaatccacgcatccgcgtaggatgcgaccataataacattgcgagccataaccctacttatttaatttcaatccacgcatccgcgtaggatgcgacattgagccgacgccggccgatccaactgtcggcgtagatttcaatccacgcatccgcgtaggatgcgactcatagaccgtcatagttgttccgtccttcagtgtatttcaatccacgcatccgcgtaggatgcgaccgtcggtaacatagacctcttccagcggctccaacatttcaatccacgcatccgcgtaggatgcgacagtccccatatacgacgacgtatgcacgcttacatttcaatccacgcatccgcgtaggatgcgacgtatacagaaagtgcgctgcagctcgcacctcctatttcaatccacgcatccgcgtaggatgcgacgtgagaatgtctataccgggacaggtcaagataatttcaatccacgcatccgcgtaggatgcgaccgccacctgaatcagacttttttggcgttaacgaatttcaatccacgcatccgcgtaggatgcgacggtatacagggataactaagacctttagagatatttcaatccacgcatccgcgtaggatgcgacaatcataaagacttgcaaatcacacttccaattgatttcaatccacgcatccgcgtaggatgcgaccaagttgaattaagacaagggacaatactgaataatttcaatccacgcatccgcgtaggatgcgactaattcctcgcctaaagtgcctttcattgcagataatttcaatccacgcatccgcgtaggatgcgacttgtatggttctgatgaatattggccttctccgtatttcaatccacgcatccgcgtaggatgcgactttccgaacactgacgacgtcaccattctggtaggtatttcaatccacgcatccgcgtaggatgcgacgaaaggccctaagtcctcccgcgcgataaattccaaatttcaatccacgcatccgcgtaggatgcgacgggctcgccttgacggccgtgcagttggaccgcgcgacatttcaatccacgcatccgcgtaggatgcgaccagagcggcaatatgttcgctcggcacagggaaacatttcaatccacgcatccgcgtaggatgcgacgcatacgacaggacagccgtattgcgacactgacatttcaatccacgcatccgcgtaggatgcgaccgggcatgacgggcggtctgctatacttcgcgcaatttcaatccacgcatccgcgtaggatgcgactataagctggagacgaaagatccaatgtacatcggatttcaatccacgcatccgcgtaggatgcgactcgatcttcttcttctcttcttcggtgtatctcatttcaatccacgcatccgcgtaggatgcgacgacggtgtaggaatgacaataaaaatctataacatttcaatccacgcatccgcgtaggatgcgacagcgaaaaataacataaaatataacaatgcaatcagttttttgctaaaat

SEQ ID NO: 1063 - DNA, 798 bp, Unknown
  Paenibacillus thiaminolyticus (multi)
ggaaccgctttgaaggaacagcaaggctccagatccgttacatttgaagcttatgtatctacgcatccgcgtaggatgcgacaaggtacccaaatcatcagattccatgttgtacataaatttcaatccacgcatccgcgtaggatgcgacttataaataacatatcacatcttccgattgacataatttcaatccacgcatccgcgtaggatgcgacgcgcggttgaacgcaaaaaacgaagaactccgacgatttcaatccacgcatccgcgtaggatgcgactataagcggtgaagttttagagagcagtatttcaatttcgatccacgcatccgcgtaggatgcgacgaccattgctcaacgatcagatctacctcaataaatttcaatccacgcatccgcgtaggatgcgacagcccgtaattaattctatttttatttatcaaagatttcaatccacgcatccgcgtaggatgcgacttcgactatatctccctcccaagcaactttaacaatttcaatccacgcatccgcgtaggatgcgacagccggatactgccgagatggtctgagtttgagaatttcaatccacgcatccgcgtaggatgcgaccgccgtacagccgagatgaatattacagggcttatatttcaatccacgcatccgcgtaggatgcgactcggtcgcactgtagagatcatttatgaggatcgatttcaatccacgcatccgcgtaggatgcgacagcgaaaaataacataaaatataacaattcaatcagtttcttgctaaaat

SEQ ID NO: 1064 - DNA, 1604 bp, Unknown
  Paenibacillus sp. multi
tccacgcatccgcgtaggatgcgacacaagtttgcagagaaggtgttgggccggcagttatttcaatccacgcatccgcgtaggatgcgaccagtagtaatggttccgcgttagctcgggtgtacatttcaatccacgcatccgcgtaggatgcgacgaaaactcgacggtgatctcacgacgggagccgttatttcaatccacgcatccgcgtaggatgcgacctattcgatggggatttcttcgagttcgcgttgggatttcaatccacgcatccgcgtaggatgcgacattccgcgcaatacaccgtgtaaccgccgtccaggatttcaatccacgcatccgcgtaggatgcgacatccggttatacatcgaatattcattaccattcatttcaatccacgcatccgcgtaggatgcgacataactgcccggtaaacccgtgacttaaagtccatttcaatccacgcatccgcgtaggatgcgaccaaatgatagaaaagggtatgaatgatttgactatttcaatccacgcatccgcgtaggatgcgacatcgctgcattgttttgatacgtaaaacgtagtcacatttcaatccacgcatccgcgtaggatgcgacacggtacaaggtctcatcgaccgactaagtaggatcatttcaatccacgcatccgcgtaggatgcgactgaaaaatgcctaattagaccaaaagcaaataaaatttcaatccacgcatccgcgtaggatgcgacattagtaagggcggaggcggtgagcagcctaccgatttcaatccacgcatccgcgtaggatgcgaccgtattccttatcatctactagtgactcatccagcggaatttcaatccacgcatccgcgtaggatgcgacgaaaatcgtttgagtcaaacccgtcatcatttcccatttcaatccacgcatccgcgtaggatgcgaccataggtttcatatagtcgtcacctcaatatgaaatttcaatccacgcatccgcgtaggatgcgacgactatcatggggtactaaccgatcaagtggtagatatttcaatccacgcatccgcgtaggatgcgaccggatatggaataaggaaataccgctcacgtctatttcaatccacgcatccgcgtaggatgcgaccaatctgatccaacactttaagcgaaccggtggaatttcaatccacgcatccgcgtaggatgcgacattgggcgcgaaggttcccttttcgatgtgcgattatttcaatccacgcatccgcgtaggatgcgacggcggatggacaactggacttgtttgattacatgatttcaatccacgcatccgcgtaggatgcgacgatcacgccgtagcacctacctttctactacgttatttcaatccacgcatccgcgtaggatgcgactcctcgttatcgcccattgcgcccattggcatgccatttcaatccacgcatccgcgtaggatgcgacggcaggtgtcagcggtacattcccgtttaagacatttcaatccacgcatccgcgtaggatgcgacagcgaaaaataacataaaatataacaatataatcagtttcttgctaaaat

SEQ ID NO: 1065 - DNA, 538 bp, Unknown
  Paenibacillus sp. multi
agcagtgaagcgagaggcttcctgctctttgttgtggtctcgatgtgtctgtttcaatccaagcatccgcgtaggatgcgacgagcgcattacacatacaagataatttgtcattgcctatttcaatccacgcatccgcataggatgcgacatgtttactatgttcctcgaaaagagctactctatcttatttcaatccacgcatccgcataggatgcgactggcttcgtgggtcgggcccgcgaatcttcatctgcaatttcaatccacgcatccgcataggatgcgactctgcaatgtctaccccgaagccggagatttcaaatttcaatccacgcatccgcataggatgcgaccattctcggttaggcgttccgcgcgtttcgatgtatttcaatccacgcatccgcataggatgcgactcatatcgtgtaatacaggctcgggcgataactcatttcaatccacgcatccgcataggatgcgacagcgaaaaatgacacaatatataataattaatcagtttttaccttaaaat

SEQ ID NO: 1066 - DNA, 2654 bp, Unknown
  Paenibacillus lentimorbus (multi)
gcatcgctttgaaggaacagcaaggctccagatccggttactgttgaagcttatgtatctacgtatccgcgtaggatgcgactttacgaatatgtgattgaaacacacatttattacatttcaatccacgcatccgcgtaggatgcgactggcaagaaaaatagggagggattgggcgttagaatttcaatccacgcatccgcgtaggatgcgactggtagattaccaagtcttttcttgcatgtctgatttcaatccacgcatccgcgtaggatgcgactcgtgattctttatcttatagtcaaacctaagcgatttcaatccacgcatccgcgtaggatgcgacctagggcagtcccagccttcggtaagtagcatcatttcaatccacgcatccgcgtaggatgcgactatgtaaaattcactccatcctttagttctgaaagatttcaatccacgcatccgcgtaggatgcgacgccatacgcgtgatgagacaatccgaacgcatagggtatttcaatccacgcatccgcgtaggatgcgacgaatataaacaacggactaaagatcgtcaaactatttcaatccacgcatccgcgtaggatgcgacaatccactcgctcgccgctgtaaaattcgatgatcggatttcaatccacgcatccgcgtaggatgcgaccatcgcgagtatatattacaaacgtccgtatcacatttcaatccacgcatccgcgtaggatgcgaccttctccattgctcttccgcgcatcgattacatacatttcaatccacgcatccgcgtaggatgcgacttccggaacctcttcggctggcttgcttatatatatttcaatccacgcatccgcgtaggatgcgacgttcgcggtcacgtaccctttgtcgtttctggtcatttcaatccacgcatccgcgtaggatgcgacgccgataatcgttgcgcatcaaagagtgcaagtatttcaatccacgcatctgcgtaggatgcgacttgatatcgcgtctttttcatcgggaacgagaatttcaatccacgcatccgcgtaggatgcgactattggtgtatgaacatacatcggaggtgtcacaatatttcaatccacgcatccgcgtaggatgcgacaataaatgatatcgacaatgaaagggacatattatttcaatccacgcatccgcgtaggatgcgacgagtgccctttttgcaactttttcttcgatctctttatttcaatccacgcatccgcgtaggatgcgactgaaaccatcagtttctatgcaacaaattcaggcatttcaatccacgcatccgcgtaggatgcgaccctaacctaattataacattacctgtaaacaagaatttcaatccacgcatccgcgtaggatgcgacaatgtcagtcacacaaggcgaggcagaggtttttgtatttcaatccacgcatccgcgtaggatgcgacttctcgccgacctattttttcacccaacactggatttcaatccacgcatccgcgtaggatgcgacgatcacagacacgcaggtatattcattcgtttttatttcaatccacgcatccgcgtaggatgcgacgaagcattaacgagcagcaagcgggatgattgggatttcaatccacgcatccgcgtaggatgcgacgtgcctatggaaaggtcgctttccggcctcaagaaatttcaatccacgcatccgcgtaggatgcgaccgaatattcattttggcatgttcccaaattttaaaatttcaatccacgcatccgcgtaggatgcgacagattggggatcacgaggccacaatgtggtatctatttcaatccacgcatccgcgtaggatgcgacattagccatgatggagcagtcaggaggtacagggatttcaatccacgcatccgcgtaggatgcgacgttctttcgatcgcttgattgactcgatggcgaaatttcaatccacgcatccgcgtaggatgcgacctcactgatatcctttagcaagtattgcttaggcaatttcaatccacgcatccgcgtaggatgcgacgtcaactgccttgccgtggaattggtggttatgaatttcaatccacgcatccgcgtaggatgcgacttctttgagtccgtccggacctactgccgattcgaatttcaatccacgcatccgcgtaggatgcgactttagggatagccctccaacgctcccgccaaaatatttcaatccacgcatccgcgtaggatgcgacaacaatcacgttatttcctcgcgctatatgatcgcatttcaatccacgcatccgcgtaggatgcgacgggatgaaaaacggaaaaaagccaacgcgtcgccaatttcaatccacgcatccgcgtaggatgcgacggacatctcaatcttttcccattccttatccgtatttcaatccacgcatccgcgtaggatgcgacgacacggtcgtatctctctcgccaatcatcgatatgatttcaatccacgcatccgcgtaggatgcgaccgtatctcctgcgccttgaaatccgcagatacgaatttcaatccacgcatccgcgtaggatgcgacagcgaaaaataacataaaatataacaatgcaatcagtttcttgctaaaat

SEQ ID NO: 1067 - DNA, 1861 bp, Unknown
  Paenibacillus lentimorbus (multi)
agaggcttcctgctctttgttgtggtcccgatgtgtctgagacgttggcgattccaatacacgcatccgtgtaggatgcgacttttgaaatttttatgaggtgattttatggatactatttcagtccacgcatccgcgtaggatgcgacggtggtcggcatgaaacgattcacgaccgactgatttcaatccacgcatccgcgtaggatgcgactcactctcgtaacgatctcctgctgatgttctgccatttcaatccacgcatccgcgtaggatgcgacccgtgaccgtcacgccggtgccgtcggtcattttcaatttcaatccacgcatccgcgtaggatgcgacctcgtatatcccatccccggtcccgtttgcggttggatttcaatccacgcatccgcgtaggatgcgacttatgaagtccattgacacggcgagccaggccatatttcaatccacgcatccgcgtaggatgcgactccgtagtgccgttgaaatcggcaagcggctgaatatttcaatccacgcatccgcgtaggatgcgacaagctgaggcgaatgcaaaatcatatgttgacgaatttcaatccacgcatccgcgtaggatgcgactgtacatgcggctgctgaacatttcatagatccgcaatttcaatccacgcatccgcgtaggatgcgacaagctccgcgaggttgatgagaagttaaccgggctatttcaatccacgcatccgcgtaggatgcgacgggtgcttgttctcttgggctggaggtgagcacatatttcaatccacgcatccgcgtaggatgcgaccggatgctcgtccgctgcaccatcgtcggatgtcatttcaatccacgcatccgcgtaggatgcgaccggcgccgggaacacctgtccatgtgaccttgggatttcaatccacgcatccgcgtaggatgcgaccccctgccttagtgggctcgtaggttggatgtgatttcaatccacgcatccgcgtaggatgcgactgtgtcacacaaccgttcgtgttatacttaaatatttcaatccacgcatccgcgtaggatgcgaccaaggccgtatccatattgattcattgggaccgatttcaatccacgcatccgcgtaggatgcgaccagatccaggttcctatgacctcgatgtcaatcgatttcaatccacgcatccgcgtaggatgcgacgtggaataggaggaagagtccggccgagtggatgatttcaatccacgcatccgcgtaggatgcgacgtcactcaatacagagtgacgtatttatgaattatttcaatccacgcatccgcgtaggatgcgacgccgctctgctccagtgtgtacggactgtgcgaatatttcaatccacgcatccgcgtaggatgcgaccttgctgctcattttgttgctcatcgtcatcatcaatttcaatccacgcatccgcgtaggatgcgacttctgactttaataacattgacagtattgatactttatttcaatccacgcatccgcgtaggatgcgaccataaatagaaattgactacaaagagagggtgaatttcaatccacgcatccgcgtaggatgcgactatcttagtcgcagaggcaaaggcttctaccttacatttcaatccacgcatccgcgtaggatgcgacgccttcttcttgtgctgctgcggttccatcttgtcatttcaatccacgcatccgcgtaggatgcgacaagatcgtaaccgtgacgtctaaacatcgcgatatcatttcaatccacgcatccgcgtaggatgcgacagcgaaaaacaacacaagatataacaattcaatcagtttttcactgaaaa

SEQ ID NO: 1068 - DNA, 534 bp, Unknown
  Paenibacillus thiaminolyticus (multi)
ggcgcatcggaaacgttttcgactttgccgcaaggccgtaggccggtttcgtttcaatccaggcatctgcataggatgcgacaatacgaaaagaacgttgtagcaacgtttactaaatttcaatccacgtatccgcgtaggatgcgacactcgtattctcttgtcttgtacctttaattttcataatttcaatccacgcatccgcgtaggatgcgactgacaacgccagaatccgagtcaatgccgattattatttcaatccacgcatccgcgtaggatgcgacgatatacgacaagattttaacgtttgaagtaaatatttcaatccacgcatccgcgtaggatgcgaccattcatgagggtttcaagctcgcccatcgcctgcgatttcaatccacgcatccgcgtaggatgcgacatagtcctttgtttgcggtctatacgtgagttccatttcaatccacgcatccgcgtaggatgcgacagcgaaaaataacataaaatacaacaatgaaatcagttttttctaaaata

SEQ ID NO: 1069 - DNA, 534 bp, Unknown; identical to SEQ ID NO: 1068
  Paenibacillus thiaminolyticus (multi)

SEQ ID NO: 1070 - DNA, 1124 bp, Unknown
  Paenibacillus thiaminolyticus (multi)
ggcgcatcggaaacgttttcgactttgccgcaaggccgaaggccggtttcgtttcaatccaggcatctgcgtaggatgcgaccagtcccgcccagaaccagctccacggcgaaaagatttcaatccacgcatccgcgtaggatgcgaccacctccgatatacttgttaataccattttaccacaatttcaatccacgcatccgcgtaggatgcgacatgagatgcgaggacagatacggaccctcgttccgatttcaatccacgcatccgcgtaggatgcgacgaacacgctgcccaatcatgtcaatgtctactacatttcaatccacgcatccgcgtaggatgcgacgcgcaagatgttgttcagcgtccggtcgagtaagcgatttcaatccacgcatccgcgtaggatgcgactaagcccgtctgtggatgcggagctaaaggaacatttcaatccacgcatccgcgtaggatgcgaccgcggaatcgcgagtagatgccagccggatgcatttcaatccacgcatccgcgtaggatgcgataagttgcgttatacttaccttataaggtgaggtatttcaatccacgcatccgcgtaggatgcgacgcttatatcagactcaggctttcgccgtcaccgatttcaatccacgcatccgcgtaggatgcgaccctaaaaaatccgagaaacaaagctccaataaactatttcaatccacgcatccgcgtaggatgcgacgaggtgatcggcaatgagtcaattaacagcacaaatttcaatccacgcatccgcgtaggatgcgacttttgtagccatcattagcacctcactacttgaaatttcaatccacgcatccgcgtaggatgcgactacccattcggtatcgaatggctcaccatcctgatttcaatccacgcatccgcgtaggatgcgactccaatgtccccagctccttctccaccaatttgatatttcaatccacgcatccgcgtaggatgcgacccccaacgatcctttatttctcggtgcagttgtcgatttcaatccacgcatccgcgtaggatgcgacagcgaaaaataacataaaatacaacaatgaaatcagttttttctaaaata

SEQ ID NO: 1071 - DNA, 1124 bp, Unknown
  Paenibacillus thiaminolyticus (multi)
catcggaaacgttttcaactttgccgcaaggccgaaggccggtttcgggaacttcaatccaggcatcagcgtaggatgcgacctggcagccggttagggggcgcacggcgtgagcaaatttcaatccacgcatccgcgtaggatgcgacgccgtgagcattcctgttcaagagttagagagcatatttcaatccacgcatccgcgtaggatgcgacggaacgaggccggtgtcatcgtccggacgagcgaatttcaatccacgcatccgcgtaggatgcgacgtcgggatcctgcgcaaaaatgccgatttcccgatttcaatccacgcatccgcgtaggatgcgaccactcggagatccacaaatggctatgtcatttagcatttcaatccacgcatccgcgtaggatgcgacgaaaagcagatcgttgagtatttcaatgatgttctatttcaatccacgcatccgcgtaggatgcgaccaatgactgaactggaaaggcaccttaccaacgtatttcaatccacgcatccgcgtaggatgcgaccgtatgacaatttgcatgaggtgtaggccacaatatttcaatccacgcatccgcgtaggatgcgacggattggatagctccaaaaagcattttagaatctatttcaatccacgcatccgcgtaggatgcgacttttatatcagctcccacccataggagattggagatttcaatccacgcatccgcgtaggatgcgactacaaaaaaattcttaacggggtgattgaaaatatttcaatccacgcatccgcgtaggatgcgacttattgaattttcaggcttgggtagcccttttgatttcaatccacgcatccgcgtaggatgcgacgacccttcgtgcgggtcttatggagagaggggtatatttcaatccacgcatccgcgtaggatgcgacatatagagcagtttggatatgaggatgccttagaatttcaatccacgcatccgcgtaggatgcgacgtcgtgatgatagtggtcgtttatgctatatcacatttcaatccacgcatccgcgtaggatgcgacagcgaaaaataacataaaatacaacaatgaaatcagttttttctaaaata

SEQ ID NO: 1072 - DNA, 1257 bp, Unknown
  Paenibacillus thiaminolyticus (multi)
gtggaaccgctgttgaataaatcgtaaggcgcctgatccggttactgttgaactgtatccgggcatccgcgtagggtgcgacattgccacactggtgacatcatcgcaatcggtcgatttcaatccacgcatccgcgtaggatgcgactagtctggtgctccatttctttctgccaaatatatttcaatccacgcatccgcgtaggatgcgacgttcaatggtggattgtccatcaaagatcgcatatatttcaatccacgcatccgcgtaggatgcgacagtaaatgatggtatgctaataaaatgacaggagatttcaatccacgcatccgcgtaggatgcgacatgacgctgacccatgattgtccaagtatggaaaaatttcaatccacgcatccgcgtaggatgcgactggtgacgatggagaagttgcttctggggtattatttcaatccacgcatccgcgtaggatgcgacaacaagggctgtggaattggcagccccatggaagatttcaatccacgcatccgcgtaggatgcgaccgttcatgcgaaaggggaagagtatacatgagccgatttcaatccacgcatccgcgtaggatgcgacatggagcgccggcaccgactaaaccggaggataaaatttcaatccacgcatccgcgtaggatgcgaccaagtcttcacctcttcctcggtcggtactctgatttcaatccacgcatccgcgtaggatgcgacactgtattcgcgcgtgggcaaggctccgcgttgggtatttcaatccacgcatccgcgtaggatgcgacggagtcgtcgccgagcaaattgtcggccagcttggatttcaatccacgcatccgcgtaggatgcgaccatgccgccgctaaaatgcaaaggttgcatttgggatttcaatccacgcatccgcgtaggatgcgactattccagacttgtaagctgcccatgtaggattatttcaatccacgcatccgcgtaggatgcgacccggagctcctgcaggacatcctggactttctgatttcaatccacgcatccgcgtaggatgcgacaggtcgccaagtggcttgagggctcgatggtgaaatttcaatccacgcatccgcgtaggatgcgacgtaatgaggggacgccagacccacgcgagcagacatttcaatccacgcatccgcgtaggatgcgacagcgaaaaataacataaaaaataacaatgcaatcagtttcatcctaaaaa

SEQ ID NO: 1073 - DNA, 593 bp, Unknown
  Paenibacillus thiaminolyticus (multi)
aaagagcagtgaagcgagagacttcctgctcttttttgtggtccgtgtctatttcaatccacacatccacgtaggatgcgactctttgacaatatccagttgatccattgtgctatttcaatccacgcatccgcgtaggatgcgacgcgagcggtgggagtttgtccgtggaatgtaagatttcaatccacggatccacgtaggatgcgacatgagtggttatccagatggtacttttgggatatttcaatccacgcatccacgtaggatgcgactgtaagccgagcgccatgccgtcaattgctccagaatttcaatccacgcatccacgtaggatgcgacgcggatacccggcaccaagacagtccacccgaccgaatttcaatccacgcatccacgtaggatgcgacttgtggactcagttggccgatgttcacgcctccttatttcaatccacgcatccacgtaggatgcgactttccggttcggtcactttgtcctggatgccttcatttcaatccacgcatccacgtaggatgcgacagcgaaaaacaatgcaatatataacaattcaatcaatttttcactgaaaa

SEQ ID NO: 1074 - DNA, 725 bp, Unknown
  Paenibacillus thiaminolyticus (multi)
gtggaaccgctgttgaataaatcgtaaggcgcctgatccggttactgttgaaatgtatccgggcatccgcgtaggatgcgaccgtcgcctggacgaacccgcatcactcaaatcacatttcaatccacgcatccgtgtaggatgcgacgatgtgtgccgcgttgaaccggcccacatagacatttcaatccacgcatccgcgtaggatgcgacatggtcaacctcgataaagcgtactcatcaagaatttcaatccacgcatccgtgtaggatgcgacgctaacactcggagggcgttgcattccggtgttgaatttcaatccacgcatccgcgtaggatgcgacatttcgaggccgacgcggatgcctccgtaattaaatttcaatccacgcatccgcgtaggatgcgacttccggaacctcttcggctggcttgcgtatatatatttcaatccacgcatccgcgtaggatgcgactgttggatacgggagattccggtgtccgacagtaatttcaatccacgcatccgcgtaagatgcgacaaacgctcggcatactcttcgacaaagacatacggatttcaatccacgcatccgcgtaagatgcgacgctttgcttcggtcagttgggctgcaggcgttgatttcaatccacgcatccgcgtaagatgcgacagcgaaaaataacataaaaaataacaatgcaatcagtttcatcctaaaat

SEQ ID NO: 1075 - DNA, 266 bp, Unknown
  Paenibacillus thiaminolyticus (multi)
aaagagcagtgaagcgtgatgcttcctgctctttgttgtggtccgtgtctatttcaatccacgcatccacgtaggatgcgacaaatgagagatataactatgtggtgtcctcgatgcatttcaatccacgcatccacgtaggatgcgacgcgaggacatcgtactcatcgagaatggcgtgagtatttcaatccacgcatccacgtaggatgcgacagcgaaaaacaacacaagatataacaattcaatcagtttttcatgaaaat

SEQ ID NO: 1076 - DNA, 1314 bp, Paenibacillus terrae
gtggaaccgctgttgaataaatcgtaaggcgcctgatccggttactgttgaaatgtatccgggcatccgcgtaggatgcgacgggcccttcgtttacagcgcggataatttttcatatttcaatccacgcatccgcgtaggatgcgactgaggatttcgataatcgttcgctccgtgcgttgatttcaatccacgcatccgcgtaggatgcgactgcccctcgataatatctgttcctggctcttcgatttcaatccacgcatccgcgtaggatgcgacaggcagccccggactcccttactctggccaagaatttcaatccacgcatccgcgtaggatgcgacacttctcagacacacgctggcagctcatcatccgatttcaatccacgcatccgcgtaggatgcgacgtttgtcttgcttgatttagatattatcagaataatttcaatccacgcatccgcgtaggatgcgactctacttccttcagatttcaatccgcgaatatcaaaatttcaatccacgcatccgcgtaggatgcgactggtttgtgacgaatgggctgccgatccttaccatttcaatccacgcatccgcgtaggatgcgacgcagccatacacagggcgatggatatctctatcaatttcaatccacgcatccgcgtaggatgcgacttgaagagattcgaatgcgtgaggctgctcgtgaatttcaatccacgcatccgcgtaggatgcgacggaacagagaaattccccttcgtttttgatggaatttcaatccacgcatccgcgtaggatgcgacggacaggtagccaaagaatagagtggatacgcaaatttcaatccacgcatccgcgtaggatgcgactggcgatcttgcatgtgcccgtgcactattcctatttcaatccacgcatccgcgtaggatgcgacgggaatattggttgcaactcgcgtttaatctattatttcaatccacgcatccgcgtaggatgcgacacacaaacgagcgtatagcccgcgtgacaggaaatttcaatccacgcatccgcgtaggatgcgacggttttagaatctgcatgtatgtccgcgtatgaatttcaatccacgcatccgcgtaggatgcgaccgttattgcgtttttacggacaatgcgccagatatttcaatccacgcatccgcgtaggatgcgacgataccggcctgcttcggaacagctggagtatcgatttcaatccacgcatccgcgtaggatgcgacagcgaaaaataacataaaaaataacaatgcaatcagtttcatcctaaaat

SEQ ID NO: 1077 - DNA, 663 bp, Unknown
  Paenibacillus thiaminolyticus (multi)
ttgagtacctcgttccctattcgacttgcacacatcacctctatatctcaacctcaatccacgcatccgcgtaggatgcgactatcgacttgccgcggcctttccacttcttcgagcgatttcaatccacgcatccgcgtagggcgcgacgcatttcactcatacacggagacgattccatgagtgatttcaatccacgcatccgcgtaggatgcgacaaaagatcgttattgtcgcgggcggaggtaaggcatttcaatccacgcatccgcgtaggatgcgactaaagggacgtcagacaagtcaaaaagtcagacaatttcaatccacgcatccgcgtaggatgcgacgcatcaccggatccggtgtgataggggagtcctatttcaatccacgcatccgcgtaggatgcgaccttcccactaaagggggatcttgaacctcttgcatttcaatccacgcatccgcgtaggatgcgacgcgtcatgccctctaaaatcaattggatcatcttcatttcaatccacgcatccgcgtaggatgcgacttcaattatcaggcggaacttgtcctccagcttaatttcaatccacgcatccgcgtaggatgcgacagcgaaaaataacacaaaaaataacaatgcaatcagtttcatcctaaaaa

SEQ ID NO: 1078 - DNA, 990 bp, Unknown
  Paenibacillus thiaminolyticus (multi)
tcacttaggacgtgacatttaccccttgacggtgctccgccagcgtttaaagatcaatccacgcatccgcataggatgcgacacgctacgggcgagccggtgccgccgacagatgatatttcaatccacgcatccgcataggatgcgactcttcgaggttgaaatggatgggaagccctaccgatttcaatccacgcatccgcataggatgcgacttccaagtaataacgcggcagaaggtattaggaatttcaatccacgcatccgcataggatgcgaccacggcagcgtgggggctattttaattgaggggatttcaatccacgcatccgcataggatgcgaccatagtacgacattaaactggagggatatgagttatttcaatccacgcatccgcataggatgcgacatttaaatatgtcgcccccttgggggcgtggactatttcaatccacgcatccgcataggatgcgactcgttatgcaacggaataatccaccaaaagtattatttcaatccacgcatccgcataggatgcgacgagtaggacaacattgcatgtttccgagatgcgaatttcaatccacgcatccgcataggatgcgacgccacggtagcattgcaagacgtgctgcacgtcatttcaatccacgcatccgcataggatgcgacgatttggttacggccggaaccgcgctagttgacaatttcaatccacgcatccgcataggatgcgacttggcatgtcactctttgcgcagcactataggcaatttcaatccacgcatccgcataggatgcgactccaaggcttatcataatcggatcaacttgagttgatttcaatccacgcatccgcataggatgcgacttgccgatccaatctcgaaaaacgttttaaacacgatttcaatccacgcatccgcataggatgcgacagcgaaaaataacacaaaacatacaaaaaaagctgttttatggttaaaaa

SEQ ID NO: 1079 - DNA, 218 bp, Unknown
  Paenibacillus thiaminolyticus (multi)
tcataaggatacgacacgggacgagcatggtgtggttgtggggttgagcgaatttcaatccacgcatccacataggatgcgacaagcatgtgagaatggggtagccaatcagcttaaatttcaatccacgcatccacataggatgcgacgcctttccaactaatcgtaagtgggttcccatccaatttcaatccacgcatccacataggatgcgacac

SEQ ID NO: 1080 - DNA, 251 bp, Unknown
  Bacillus sp. multi
aataagtattggtataaatgggttctttggaaggatatataatcgggttttataaacactatgtagaatgtaaattatcacatgattctagccctttttcaatgtaatcttgttttataaacactatgtagaatgtgaatgttagcacttgtaatttagttctaaaacggctgcaagttctataaacactatgtagaatgtgaatgatgctcttgatattgaattaggagataaacattgtgaaccacgcc

SEQ ID NO: 1081 - DNA, 251 bp, Unknown; identical to SEQ ID NO: 1080
  Bacillus sp. multi

SEQ ID NO: 1082 - DNA, 388 bp, Unknown
  Bacillus sp. multi
aagtatataaatagtgctataatcatgttctttgaaaacatgtaaatggggttttaaatgaactatgtagaatgtgaataatatagctgaattcttgtgcataactcgaaattatgttttaaatgaactatgtagaatgtgaattttggtgaaaacatcaatgaaatagaattagagcgtgttttaaatgaactatgcagaatgtgaatcactgagccaataaccaagcatttgagacttgcaacgttttaaatgaactatgtagaatgtgaatgttcttgtttgcgttcatcttcatcaagttttcgcgttttaaatgaactatgtagaatatgaatttatgttcaatgagcttaagtaacaagtttaaaatggttataggatacat

SEQ ID NO: 1083 - DNA, 306 bp, Unknown
  Streptomyces sp. multi
gtgcttcaaaacgccattccgcccgtctaaagcggcaggtcagcaagctggctccccgcgcacgcggggatgaccccttggcattgactcagggggtggggctcaagaatggctccccgcgcacgcggggatgaccccgactcctcgtccatgtcggccgtcacgccgagctgctccccgcgcacgcggggatgaaccctgcgggactggggtagcccaggtgccgggtcactgctccccgcgcggggatgaccccacctccggcctgactgatctatatgcgcgctatccgccgtttccgtattc

SEQ ID NO: 1084 - DNA, 580 bp, Unknown
  Bacillus sp. multi
ttttgaaggtaatgtgtttttacaaatattttgtgtcgatccttaaacatctatagtccccgaagaaccaacattatgatatggtaacaagaagaatatgagtacaatcattacgctatagttccaaaagaaccatcgttatgatatggtcacatccgacttcgaatggaatgcaatgtggctatagttccaaaagaaccatcgctatgatatggtgtaacagcaagtgcaatatctgcatgggaggctatagttccaaaagaaccatcgctatgatatggtgtcaagcagcaaaaaagtaacagcctctgaactatagttccaaaagaaataatgctatgctatgattcataattttttaagtggtgttagtaattcgctatagttccatagaaacatcgttatgatatggtctgattcctagtcagaaaaccgagtctcctactatagttccaaaagaaccatcgctatggtatggtctattcttttgtcctttgatatacaccgaggctatagttccataaaaatatcgctatggtagatgtcaaaaaaaccttgtcactagaggggtagacaaggt

SEQ ID NO: 1085 - DNA, 982 bp, Unknown
  Bacillus sp. multi
atgggaataatagtaatataaatttattgtgtgaaactttatttctgttctctatgattcctaagaaaagtcgttatacttatgcaatgtttgagaaaaatgtaatgtctttgacaaacttacgctataactccaaagaaaacatcgtatgctatgataatcaagtttcctatgctgttgtttcatgctgctatagttccataagaaatatcgctatgctaggatctttactacttaatgcagttagtaagtttggctatagttccataaaaaatatcgctatgctatgattgtatctagactcttattacaaggtcgttggctatagttccataagaaatattaatgctatgattataatcatttttgcgtatattgtgtcgtcagctatagttccataagaaacatcgctatgctatgattatacctcttgaaaagtatgatctcgtgttactatagttccataaaaaatatcgctatgctatgatctgataatcccagcatgtagtcaacagatagctatagttccctaagaaccatcgctatgctatgattagtaaatcaacaattagtcgtgtatgtcagctatagttccaaaagaaacattgctatgctatgatcacgccattatgttctgtgaaggtcagcgagctatagttccataagaaagattgctatgctatgatccttatcccaatctgttacacgtggtatttgctatagttccataaggaaaatcgctatgctatgatttaaaaggtttttagaaaaataatgaagggctatagttccaaaagaaacattgctatgctatgatcgaacgattgacaatttggcggctgatatcgctatagttccaagagaaaaattgctatgctatgattgcttgatgattataaagacacattgaatggctatagttccaaaagaaccatcgcaatgctatgatggatgcattaaaaaccttgttattatagcttta

SEQ ID NO: 1086 - DNA, 580 bp, Unknown
  Bacillus sp. multi
ttttgaaggtaatgtgtttttacaaatattttgtgtcgatccttaaacatctatagtccccgaagaaccaacattatgatatggtaacaagaagaatatgagtacaatcattacgctatagttccaaaagaaccatcgttatgatatggtcacatccgacttcgaatggaatgcaatgtggctatagttccaaaagaaccatcgctatgatatggtgtaacagcaagtgcaatatctgcatgggaggctatagttccaaaagaaccatcgctatgatatggtgtcaagcagcaaaaaagtaacagcctctgaactatagttccaaaagaaataatgctatgctatgattcataattttttaagtggtgttagtaattcgctatagttccatagaaacatcgttatgatatggtctgattcctagtcagaaaaccgagtctcctactatagttccaaaagaaacatcgctatggtatggtctattcttttgtcctttgatatacaccgaggctatagttccataaaaatatcgctatggtagatgtcaaaaaaaccttgtcactagaggggtagacaaggt

SEQ ID NO: 1087 - DNA, 982 bp, Unknown; identical to SEQ ID NO: 1085
  Bacillus sp. multi

SEQ ID NO: 1088 - DNA, 585 bp, Unknown
  Bacillus sp. multi
tttggttgccataccccttcttaacttagtttaatactttgggtaaacacatgtaaatatatcttatgttagtcttaaactgatatagagggtagtaatactttaagataggctagtatttaaatacatcttatattcttttcagcttctgtatggctcatgccaaaccgaatttaaatacatcttatgttggtattaaaccgccttttcatcttgaattatgcgatgagcataaaaatttaaatacatcttatgttagtgtcaaatcatgcattaaagctatgttttgttttaccattagtaatttaaatacatcttatgctactgttaaacaatcacaagttaggtggttactagagcgtagcgaaaggaatttaaggagtatttaaatacatcttgtgttagtgttaaacaaattaatctacaaaaacactttgcgcactctccccaatttaaatacatcttatgttagtactgaacatacatgtctaaattaatcacagaacacctcagaatatttaatacatcttatattaggcctcacgataccatttcgggaaaattgtacgtttagacacaatttgg

SEQ ID NO: 1089 - DNA, 315 bp, Unknown
  Bacillus sp. multi
aagtaaaagcacggatatatcaatgattatttatgaaaaaagaatagggattttaaatacaatatgtattgttagaattcgcttctgctaataattgattcacttcaaatgttcgttttaaatacaatatgtattgctagaatggctgccaaacgaggctatcatggaaaaacgctcgtattttaaatacaatatgtattgttagaatagatataatgacacgttttcttataaatgaaaaatgtcacaaatacactgtgtattatcgtaagtagcgttaccagtatcattcttacactactgttttaaacacac

SEQ ID NO: 1090 - DNA, 315 bp, Unknown
  Bacillus sp. multi
aagtaaaagcacggatatatcaatgattatttatgaaaaaagaatagggattttaaatacaatatgtattgttagaattcgcttctgctaataattgattcacttcaaatgttcgttttaaatacaatatgtattgctagaatggctgccaaacgaggctatcatgggaaaacgctcgtattttaaatacaatatgtattgttagaatagatataatgacacgttttcttataaatgaaaaatgtcacaaatacactgtgtattatcgtaagtagcgttaccagtatcattcttacactactgttttaaacacac

SEQ ID NO: 1091 - DNA, 467 bp, Unknown
  Bacillus sp. multi
gcagaaagactccttatatatcaatggtttttcaacaactaaatataggattttaaatctaatatgtatggttagaatttccccttttctacaaaatggttgttaatatcgttcgttttaaatctaatatgtatcgttagaatactctttaatattgaaacaaatcaaacgattattaagttttaaatctaatatgtatcgttagaattccataaaatctttgatgcttattttctcagttgcgttttagatctaacatgtatcgttagaatttccaataaacgtaagggtcaatttattatttcatcgtgttttagatctaatatgtatggttagagtataatagtcgaaaagatttttaaaatgtaatttatatgtttgatccagtataaaatttatttaaaatcaacttaatttaaaaagacgtggaaaacccacgtctttctgtgcttatattaattattatg

SEQ ID NO: 1092 - DNA, 242 bp, Unknown
  Lysinibacillus sp. multi
aaaatcttattgctattctataataaatctaaatggaaagacgtaactccaggttacaactttattattctttttgaatctcacattcaggaaaaaattgtaattctaggttacaactttattattaataaagctagcgtgtaacctatataatgcgcttttttggggtattcaggttacaactttattatttgtttacaacattgtaactttaaaagaaagtttgaacgctcgtaagtaaa

SEQ ID NO: 1093 - DNA, 367 bp, Unknown
  Streptomyces sp. multi
ggcatcggccactctgacgtcctgcacgccctggtctccgccctcgccgtgaccgcagcgcctgcgggaaggaccgcgtcagcggccgggttactcgactgatcaccgtggatacccgcgcctgcgggacggatatgaacctcgcccccgcaccgtaccggacccgccgtagatacccgcgtctgcgggacggaccaggcctcgtccaccttcttgagggcgtcccgccgtcgatacccgcgcatgcgggatgaacaccttcccgctcgaccgacggccgcggcggatccgtagatacccgcgcctgcgggacggactcggccagcagacgcacggtccgggccttagacgccacccgtcgcatcac

SEQ ID NO: 1094 - DNA, 318 bp, Unknown; identical to SEQ ID NO: 996
  Bacillus sp. multi

SEQ ID NO: 1095 - DNA, 318 bp, Unknown; identical to SEQ ID NO: 996
  Bacillus sp. multi

SEQ ID NO: 1096 - DNA, 318 bp, Unknown; identical to SEQ ID NO: 996
  Bacillus sp. multi

SEQ ID NO: 1097 - DNA, 318 bp, Bacillus cereus; identical to SEQ ID NO: 996

SEQ ID NO: 1098 - DNA, 318 bp, Unknown; identical to SEQ ID NO: 996
  Bacillus sp. multi

SEQ ID NO: 1099 - DNA, 318 bp, Unknown; identical to SEQ ID NO: 996
  Bacillus sp. multi

SEQ ID NO: 1100 - DNA, 318 bp, Unknown; identical to SEQ ID NO: 996
  Bacillus sp. multi

SEQ ID NO: 1101 - DNA, 319 bp, Unknown
  Bacillus sp. multi
tgtcacaatattcgttattaatcatctatctattatcggggttaaaacataacaatagatgtattgaaattgatccacctctacaatgtgataacggccattatccgttaaaacataacaatagatgtattgaaatttaagtcattatatgacaccgtatgctatgtggattgttaaaacagaacaatagatgtattgaaatcaaacaagattacaactattgaacaatgtcgtcaatcgttaaaacagaacaatagatgtatttaaaaagataacaaatcattaagaaaccctggttgcaagagtgtaaattattaaa

SEQ ID NO: 1102 - DNA, 591 bp, Unknown
  Bacillus sp. multi
acaagggatcgtcgcacaattcattgttaatcttctatatattatcgggggttaaaacataacaatagatgtattgaaattccataaaaggagataaagcttttaacgtttttgttgttaaaacataacaatagatgtattgaaatgtgcaaatatgagacactctatactaaatatcatttgttaaaacataacaatagatgtattgaaattttaattgttgcaaagcttggaattccttctttaatgttaaaacataacaatagatgtattgaaattttatagtagccttggcctcaaatgcaacaaatcgtttaaaacataacaatagatgtattgaaatctaaaaagattaagcggtgtaattgtaaacttcttagttaaaacataataatagatgtattgaaatgtttgagcagcagttgctttcatcacctgtttcttgttaaaacataacaatagatgtattgaaatatgcattctttatgtgcagcctggtattttcctgagttaaaacaaaacgatagatatttaggaatctcgttgggctttgattatatttgtatataaatagaggcaatgttatgatat

SEQ ID NO: 1103 - DNA, 395 bp, Unknown
  Bacillus sp. multi
aatacaagggatcgtcgcacattcattgttaatcatccatatattatcgggttaaaacataacaatagatgtattgaaatccttctacacgaacccggtttacatctgaaccgtcagttaaaacataacaatagatgtattgaaatcttataaggtatctgtatgtatagaccctgttcactgttaaaacataacaatagaggtattgaaatgtcttataagtcctcgtattatttaacgatctgctggttaaaacataacaataaatgttttgaaattggggaaacgcttggcacatcgcaaaatcatggcgaagtttaaacgaaccaatagatatttagaagtatcattgaacaatgattctatttgtatataaatagagggaatgttatcat

SEQ ID NO: 1104 - DNA, 395 bp, Unknown; identical to SEQ ID NO: 1103
  Bacillus sp. multi

SEQ ID NO: 1105 - DNA, 395 bp, Unknown; identical to SEQ ID NO: 1103
  Bacillus sp. multi

SEQ ID NO: 1106 - DNA, 395 bp, Unknown; identical to SEQ ID NO: 1103
  Bacillus sp. multi

SEQ ID NO: 1107 - DNA, 395 bp, Unknown; identical to SEQ ID NO: 1103
  Bacillus sp. multi

SEQ ID NO: 1108 - DNA, 395 bp, Bacillus thuringiensis; identical to SEQ ID NO: 1103

SEQ ID NO: 1109 - DNA, 395 bp, Unknown; identical to SEQ ID NO: 1103
  Bacillus sp. multi

SEQ ID NO: 1110 - DNA, 456 bp, Unknown; identical to SEQ ID NO: 929
  Bacillus sp. multi

SEQ ID NO: 1111 - DNA, 318 bp, Unknown
  Bacillus sp. multi
gtcgtacaattcattgttcatcatccatatattatcgggggttaaaacaaaacaatagatgtattgaaatgttgaaatgtatgaagaaagcacccctaaactaaggttaaaacataaaaatagatgtattgaaatattcgttgaataataaaatcaccaataagcacggtgagttaaaaacataacaatagatgtattgaaatctagtagttaatttgaactgggtatttgacagtgtgttgaaataaaacaatagatgtattgaaattgggggaatgctcggcacttcactaaatcattgcgaagtttaaacaacac

SEQ ID NO: 1112 - DNA, 1198 bp, Unknown
  Paenibacillus thiaminolyticus (multi)
gtatgactcgtcggctgggtgtatacgacgatgctcattagcagtgaggtctttcaatccacgcatccgtgtaggatgcgacagggatgggcagaccgttttctatacatcgatggtatttcaatccacgcatccgcgtaggatgcgacggcgaagctgcagctcgcgctcctggttgttcttccgatttcaatccacgcatccgcgtaggatgcgacgatgcagcgatccgtagcttgccagccccgatcgaaatttcaatccacgcatccgcgtaggatgcgaccgggacccgctgaatttcttagctgcccgcatattatttcaatccacgcatccgcgtaggatgcgacggaacgagtgtgtaaggctgccctttagggtggaatttcaatccacgcatccgcgtaggatgcgactccgaaccaatacggacacgatgacacgcacgcttatttcaatccacgcatccgcgtaggatgcgacggtacaggacttatccgagatggacttaggggattatttcaatccacggatccgcgtaggatgcgacaaagaggcccaatcgatacaagagtatcagtcatatttcaatccacgcatccgcgtaggatgcgacgtatgtcgccaaggtgtgccggcaattcggatgatttcaatccacgcatccgcgtaggatgcgacataagttcgtaaattcattgaacttatacttttcgatttcaatccacgcatccgcgtaggatgcgacaaatgaggagggattgaatgtgaagcaattacgatttcaatccacgcatccgcgtaggatgcgaccctagctttatccctgaccggactggtccttgagccaatttcaatccacgcatccgcgtaggatgcgacacgaactcgattttgtccgagatggatatttccgatttcaatccacgcatccgcgtaggatgcgacatggctgttctggcgaaccatacggcggattcatatttcaatccacgcatccgcgtaggatgcgacttcggcgtagtcggattgctcgtacgatatagtatttcaatccacgcatccgcgtaggatgcgacatatcgtgagggagcaggtcgaaagcccctacttatttcaatccacgcatccgcataggatgcgacaacgagaattgactgaatgtatcaagaatccattcaattatgattgaata

SEQ ID NO: 1113 - DNA, 926 bp, Unknown
  Paenibacillus lentimorbus (multi)
ccgcgggaggatgccgcggctctaaggccttatacagcccctgtttgggcatttcaatccacgcatccgtgtaggatgcgacggagggtgttgtcctatacgctacttccaatgcaatttcaatccacgcacccgcgtaggatgcgacgttaactgataaggaatttttatcacttaattcatttcaatccacgcatccgcgtaggatgcgacgcttgcgccgtcttttcatatccggcctcttttcgatttcaatccacgcatccgcgtaggatgcgacgagatgaaacgcactaattccccgcaaattttacgtatttcaatccacacatccgcgtaggatgcgacgcagcaacacgctctcgatggtatcatgagcgtaatttcaatccacgcatccgcgtaggatgcgacctcgatatggattaggattgcgcgcatctttcgatttcaatccacgcatccgcgtaggatgcgacatgaactccctacgttttcaattgctgaaagaggatttcaatccacgcatccgcgtaggatgcgactccaatatgacttcacaaatctcactttgcatgtatttcaatccacgcatccgcgtaggatgcgactattcgtgggatccggacagtatagcgcttttcttatttcaatccacgcatccgcgtaggatgcgaccagcccccggaaccgccttccagcgtagcaataaatttcaatccacgcatccgcgtaggatgcgacctccgtctctggcatcaattccgcaccgtatcagatttcaatccacgcatccgcgtaggatgcgacagcattgacgtatgtacgacatggtgctattattatttcaatccacgcatccgcgtaggatgcgacagcgaaaattgactgaatgtgtcaagaatccgttaaattatgattgaata

SEQ ID NO: 1114 - DNA, 921 bp, Unknown
  Paenibacillus thiaminolyticus (multi)
gtgtgatgacggttgaataaaaacagccgcttaccgtttcctgtgcgtatatttcaatccaccatccgcgtaggatgcgaccgccgcctcttcgccttcggggggctccttaagatttcaatccacgcatccgcgtaggatgcgacgcgctgtgccggccaacgcaatcatcgattatgatttcaatccacgcatccgtgtaggatgcgacatgctcaagataatccagcatcatgctcattgcaaaatttcaatccacgcatccgcgtaggatgcgacgtattcatcccggtttgggacataataggccttgtatatttcaatccacacatacgcgtaggatgcgacgaagctatacgaccatcagcgaggcgatgaatatttcaatccacgcatccgcgtaggatgcgacatatagccggacgctctatgaaaaatggaaacatttcaatccacgcatccgcgtaggatgcgaccatccgctgttactcgagctatacccggactggaatttcaatccacgcatccgcgtaggatgcgacggcaaacaaacacataaccgtttgcccatttatcatttcaatccacgcatccgcgtaggatgcgaccaaagctcgccgacatctcccactgagccgtgacatttcaatccacgcatccgcgtaggatgcgacatttcgcgctgaagtttaccgaccgtcagattaaatttcaatccacgcatccgcgtaggatgcgacatgggtctacggctggtcagacggtctatttcgatttcaatccacgcatccgcgtaggatgcaacccccttggtctaactgggacaagatgggactggaatttcaatccacgcatccgcgtaggatgcgacagcgaaaattgactgaatgtgtcaaatgtatattcaagtatgattgaata

SEQ ID NO: 1115 - DNA, 508 bp, Unknown
  Stenotrophomonas sp. multi
gttgctggcgcgcgaaccggacgatcagcggggcgccgggtaatctccgcatccacgcatggcgtggatctactgaatcgcgcggggttggggaacgtcccgtccacgcatggcgtggatctgctggcgtgtgcggggcgcggccctatccacgcatggcgtggatctactggattgtgcggggtggctggtcgtatccacgcatggcgtggatctacttgcgtgtgcgggacggggccctatccacgcatggcgtggatctactggattgtgcggggtggctggtcgtatccacgcatggcgtggatctacttgcgtgtgcgggacggggccctatccacgcatggcgtggatctactggattgtgcggggtggctggtcgtatccacgcatggcgtggatctccggggacgtgtcgggcgggggagcagtagatccacgccatgcgtggatgggctttcccatgaacactggccggtgtcgcggcttttcccgactggccgcaggg

SEQ ID NO: 1116 - DNA, 30 bp, Unknown
  Bacillus sp. multi
gtttaacattaacataagatgtatttaaat

SEQ ID NO: 1117 - DNA, 30 bp, Unknown; identical to SEQ ID NO: 1116
  Bacillus sp. multi

SEQ ID NO: 1118 - DNA, 32 bp, Unknown
  Bacillus sp. multi
gtttaacattaacataagatgtatttaaatat

SEQ ID NO: 1119 - DNA, 30 bp, Unknown
  Bacillus sp. multi
gtttagtactaacacaagatgtatttaaat

SEQ ID NO: 1120 - DNA, 30 bp, Unknown; identical to SEQ ID NO: 1119
  Bacillus sp. multi

SEQ ID NO: 1121 - DNA, 30 bp, Unknown; identical to SEQ ID NO: 1119
  Bacillus sp. multi

SEQ ID NO: 1122 - DNA, 30 bp, Unknown
  Bacillus sp. multi
gtttaccagtaacataagatgtatttaaat

SEQ ID NO: 1123 - DNA, 30 bp, Unknown; identical to SEQ ID NO: 1119
  Bacillus sp. multi

SEQ ID NO: 1124 - DNA, 30 bp, Unknown
  Bacillus sp. multi
gtttaacactaacataagatgtatttaaat

SEQ ID NO: 1125 - DNA, 30 bp, Unknown
  Bacillus sp. multi
gtttaacattaatataagatgtatttaaat

SEQ ID NO: 1126 - DNA, 30 bp, Unknown; identical to SEQ ID NO: 1116
  Bacillus sp. multi

SEQ ID NO: 1127 - DNA, 30 bp, Bacillus thuringiensis
gtttaacatcaacataagatgtatttaaat

SEQ ID NO: 1128 - DNA, 30 bp, Unknown
  Bacillus sp. multi
gtttaccattagcataagatgtatttaaat

SEQ ID NO: 1129 - DNA, 30 bp, Unknown
  Bacillus sp. multi
gtttagtactaacataagatgtatttaaat

SEQ ID NO: 1130 - DNA, 30 bp, Unknown; identical to SEQ ID NO: 1119
  Bacillus sp. multi

SEQ ID NO: 1131 - DNA, 30 bp, Unknown; identical to SEQ ID NO: 1125
  Bacillus sp. multi

SEQ ID NO: 1132 - DNA, 30 bp, Unknown; identical to SEQ ID NO: 1125
  Bacillus sp. multi

SEQ ID NO: 1133 - DNA, 30 bp, Unknown; identical to SEQ ID NO: 1124
  Bacillus sp. multi

SEQ ID NO: 1134 - DNA, 30 bp, Unknown; identical to SEQ ID NO: 1124
  Bacillus sp. multi

SEQ ID NO: 1135 - DNA, 30 bp, Unknown; identical to SEQ ID NO: 1127
  Bacillus sp. multi

SEQ ID NO: 1136 - DNA, 30 bp, Unknown; identical to SEQ ID NO: 1119
  Bacillus sp. multi

SEQ ID NO: 1137 - DNA, 30 bp, Unknown; identical to SEQ ID NO: 1124
  Bacillus sp. multi

SEQ ID NO: 1138 - DNA, 30 bp, Unknown; identical to SEQ ID NO: 1129
  Bacillus sp. multi

SEQ ID NO: 1139 - DNA, 30 bp, Unknown; identical to SEQ ID NO: 1129
  Bacillus sp. multi

SEQ ID NO: 1140 - DNA, 30 bp, Unknown
  Bacillus sp. multi
gtttagtactaatataagatgtatttaaat

SEQ ID NO: 1141 - DNA, 30 bp, Unknown; identical to SEQ ID NO: 1124
  Bacillus sp. multi

SEQ ID NO: 1142 - DNA, 30 bp, Unknown; identical to SEQ ID NO: 1124
  Bacillus sp. multi

SEQ ID NO: 1143 - DNA, 30 bp, Unknown
  Bacillus sp. multi
gtttaacactaacacaagatgtatttaaat

SEQ ID NO: 1144 - DNA, 30 bp, Unknown; identical to SEQ ID NO: 1116
  Bacillus sp. multi

SEQ ID NO: 1145 - DNA, 30 bp, Unknown
  Bacillus sp. multi
gtttaacactgacataagatgtatttaaat

SEQ ID NO: 1146 - DNA, 30 bp, Unknown
  Bacillus sp. multi
gtttatcattaacataagatgtatttaaat

SEQ ID NO: 1147 - DNA, 30 bp, Unknown
  Bacillus sp. multi
gtttaacactaacataggatgtatttaaat

SEQ ID NO: 1148 - DNA, 30 bp, Unknown
  Bacillus sp. multi
gtttagcactaacataagatgtatttaaat

SEQ ID NO: 1149 - DNA, 30 bp, Unknown; identical to SEQ ID NO: 1124
  Bacillus sp. multi

SEQ ID NO: 1150 - DNA, 30 bp, Unknown
  Bacillus sp. multi
gtttagtattaacataagatgtatttaaat

SEQ ID NO: 1151 - DNA, 30 bp, Unknown; identical to SEQ ID NO: 1124
  Bacillus sp. multi

SEQ ID NO: 1152 - DNA, 30 bp, Unknown; identical to SEQ ID NO: 1127
  Bacillus sp. multi

SEQ ID NO: 1153 - DNA, 30 bp, Unknown; identical to SEQ ID NO: 1129
  Bacillus sp. multi

SEQ ID NO: 1154 - DNA, 30 bp, Unknown; identical to SEQ ID NO: 1124
  Bacillus sp. multi

SEQ ID NO: 1155 - DNA, 30 bp, Unknown; identical to SEQ ID NO: 1119
  Bacillus sp. multi

SEQ ID NO: 1156 - DNA, 30 bp, Unknown; identical to SEQ ID NO: 1124
  Bacillus sp. multi

SEQ ID NO: 1157 - DNA, 30 bp, Unknown; identical to SEQ ID NO: 1124
  Bacillus sp. multi

SEQ ID NO: 1158 - DNA, 31 bp, Unknown
  Bacillus sp. multi
gtttaacactaacataagatgtatttaaatc

SEQ ID NO: 1159 - DNA, 30 bp, Unknown; identical to SEQ ID NO: 1150
  Bacillus sp. multi

SEQ ID NO: 1160 - DNA, 30 bp, Unknown; identical to SEQ ID NO: 1124
  Bacillus sp. multi

SEQ ID NO: 1161 - DNA, 30 bp, Unknown; identical to SEQ ID NO: 1119
  Bacillus sp. multi

SEQ ID NO: 1162 - DNA, 30 bp, Unknown; identical to SEQ ID NO: 1147
  Bacillus sp. multi

SEQ ID NO: 1163 - DNA, 30 bp, Unknown; identical to SEQ ID NO: 1129
  Bacillus sp. multi

SEQ ID NO: 1164 - DNA, 30 bp, Unknown; identical to SEQ ID NO: 1119
  Bacillus sp. multi

SEQ ID NO: 1165 - DNA, 30 bp, Unknown; identical to SEQ ID NO: 1148
  Bacillus sp. multi

SEQ ID NO: 1166 - DNA, 30 bp, Unknown; identical to SEQ ID NO: 1129
  Bacillus sp. multi

SEQ ID NO: 1167 - DNA, 30 bp, Unknown; identical to SEQ ID NO: 1148
  Bacillus sp. multi

SEQ ID NO: 1168 - DNA, 30 bp, Unknown; identical to SEQ ID NO: 1129
  Bacillus sp. multi

SEQ ID NO: 1169 - DNA, 30 bp, Paenibacillus sp. novel; identical to SEQ ID NO: 1129

SEQ ID NO: 1170 - DNA, 30 bp, Bacillus thuringiensis; identical to SEQ ID NO: 1129

SEQ ID NO: 1171 - DNA, 30 bp, Unknown; identical to SEQ ID NO: 1129
  Bacillus sp. multi

SEQ ID NO: 1172 - DNA, 30 bp, Unknown; identical to SEQ ID NO: 1129
  Bacillus sp. multi

SEQ ID NO: 1173 - DNA, 30 bp, Unknown; identical to SEQ ID NO: 1129
  Bacillus sp. multi

SEQ ID NO: 1174 - DNA, 30 bp, Unknown
  Bacillus sp. multi
gtttagtatgaacataagatgtatttagat

SEQ ID NO: 1175 - DNA, 30 bp, Unknown; identical to SEQ ID NO: 1119
  Bacillus sp. multi

SEQ ID NO: 1176 - DNA, 30 bp, Unknown; identical to SEQ ID NO: 1129
  Bacillus sp. multi

SEQ ID NO: 1177 - DNA, 30 bp, Unknown; identical to SEQ ID NO: 1129
  Bacillus sp. multi

SEQ ID NO: 1178 - DNA, 30 bp, Unknown
  Bacillus sp. multi
gtttaaacataacaatagatgtattgaaat

SEQ ID NO: 1179 - DNA, 38 bp, Unknown
  Bacillus sp. multi
gttcgttagttaaaacataacaatagatgtattgaaat

SEQ ID NO: 1180 - DNA, 30 bp, Unknown
  Bacillus sp. multi
gttaaaacataacaatagatgtattgaaat

SEQ ID NO: 1181 - DNA, 30 bp, Unknown; identical to SEQ ID NO: 1180
  Bacillus sp. multi

SEQ ID NO: 1182 - DNA, 30 bp, Unknown
  Bacillus sp. multi
gtaaaaaaataacaatagatgtattgaaat

SEQ ID NO: 1183 - DNA, 31 bp, Unknown
  Bacillus sp. multi
ggttaaaacaaaacaatagatgtattgaaat

SEQ ID NO: 1184 - DNA, 31 bp, Unknown
  Bacillus sp. multi
ggttaagacataacaatagatgtattgaaat

SEQ ID NO: 1185 - DNA, 30 bp, Unknown
  Bacillus sp. multi
gttaaaacaaaacaatagatgtattgaaat

SEQ ID NO: 1186 - DNA, 31 bp, Unknown; identical to SEQ ID NO: 1183
  Bacillus sp. multi

SEQ ID NO: 1187 - DNA, 30 bp, Unknown; identical to SEQ ID NO: 1180
  Bacillus sp. multi

SEQ ID NO: 1188 - DNA, 31 bp, Unknown
  Bacillus sp. multi
aggtaaaacataataatagatgtattgaaat

SEQ ID NO: 1189 - DNA, 30 bp, Bacillus thuringiensis; identical to SEQ ID NO: 1180

SEQ ID NO: 1190 - DNA, 31 bp, Unknown
  Bacillus sp. multi
ggttaaaacataacaatagatgtattgaaat

SEQ ID NO: 1191 - DNA, 30 bp, Unknown
  Bacillus sp. multi
gttaaaacataaaaatagatgtattgaaat

SEQ ID NO: 1192 - DNA, 30 bp, Unknown; identical to SEQ ID NO: 1180
  Bacillus sp. multi

SEQ ID NO: 1193 - DNA, 30 bp, Unknown; identical to SEQ ID NO: 1180
  Bacillus sp. multi

SEQ ID NO: 1194 - DNA, 31 bp, Unknown
  Bacillus sp. multi
gttaaaacataacaatagatgtattgaaatt

SEQ ID NO: 1195 - DNA, 30 bp, Unknown
  Bacillus sp. multi
gttaagacataacaatagatgtattgaaat

SEQ ID NO: 1196 - DNA, 30 bp, Unknown; identical to SEQ ID NO: 1180
  Bacillus sp. multi

SEQ ID NO: 1197 - DNA, 30 bp, Unknown; identical to SEQ ID NO: 1180
  Bacillus sp. multi

SEQ ID NO: 1198 - DNA, 30 bp, Unknown
  Bacillus sp. multi
gttaaaacctaacaatagatgtattgaaat

SEQ ID NO: 1199 - DNA, 30 bp, Unknown; identical to SEQ ID NO: 1180
  Bacillus sp. multi

SEQ ID NO: 1200 - DNA, 30 bp, Unknown; identical to SEQ ID NO: 1180
  Bacillus sp. multi

SEQ ID NO: 1201 - DNA, 30 bp, Unknown; identical to SEQ ID NO: 1180
  Bacillus sp. multi

SEQ ID NO: 1202 - DNA, 30 bp, Unknown; identical to SEQ ID NO: 1180
  Bacillus sp. multi

SEQ ID NO: 1203 - DNA, 32 bp, Unknown
  Bacillus sp. multi
gttcgttggttaaacataacaatagatgtatt

SEQ ID NO: 1204 - DNA, 30 bp, Unknown; identical to SEQ ID NO: 1180
  Bacillus sp. multi

SEQ ID NO: 1205 - DNA, 29 bp, Unknown
  Bacillus sp. multi
gtaaaacataataatagatgtattgaaat

SEQ ID NO: 1206 - DNA, 30 bp, Unknown
  Bacillus sp. multi
ggtaaaacataataatagatgtattgaaat

SEQ ID NO: 1207 - DNA, 30 bp, Unknown; identical to SEQ ID NO: 1206
  Bacillus sp. multi

SEQ ID NO: 1208 - DNA, 30 bp, Unknown; identical to SEQ ID NO: 1180
  Bacillus sp. multi

SEQ ID NO: 1209 - DNA, 30 bp, Unknown
  Bacillus sp. multi
gtttaaacaaaacaatagatgtattgaaat

SEQ ID NO: 1210 - DNA, 30 bp, Unknown; identical to SEQ ID NO: 1180
  Bacillus sp. multi

SEQ ID NO: 1211 - DNA, 30 bp, Unknown
  Bacillus sp. multi
gtttaaatataacaatagatgtattgaaat

SEQ ID NO: 1212 - DNA, 30 bp, Unknown; identical to SEQ ID NO: 1180
  Bacillus sp. multi

SEQ ID NO: 1213 - DNA, 30 bp, Unknown; identical to SEQ ID NO: 1180
  Bacillus sp. multi

SEQ ID NO: 1214 - DNA, 31 bp, Unknown; identical to SEQ ID NO: 1188
  Bacillus sp. multi

SEQ ID NO: 1215 - DNA, 30 bp, Unknown; identical to SEQ ID NO: 1180
  Bacillus sp. multi

SEQ ID NO: 1216 - DNA, 30 bp, Unknown; identical to SEQ ID NO: 1180
  Bacillus sp. multi

SEQ ID NO: 1217 - DNA, 30 bp, Unknown; identical to SEQ ID NO: 1180
  Bacillus sp. multi

SEQ ID NO: 1218 - DNA, 30 bp, Unknown; identical to SEQ ID NO: 1180
  Bacillus sp. multi

SEQ ID NO: 1219 - DNA, 30 bp, Unknown; identical to SEQ ID NO: 1180
  Bacillus sp. multi

SEQ ID NO: 1220 - DNA, 31 bp, Unknown
  Bacillus sp. multi
agttaaaacataacaatagatgtattgaaat

SEQ ID NO: 1221 - DNA, 30 bp, Unknown; identical to SEQ ID NO: 1178
  Bacillus sp. multi

SEQ ID NO: 1222 - DNA, 31 bp, Unknown
  Bacillus sp. multi
gttcaaaccaaacaatagatgtattgaaatt

SEQ ID NO: 1223 - DNA, 33 bp, Bacillus megaterium
gtcacaccctacatgggtgtaaggattgaaatt

SEQ ID NO: 1224 - DNA, 29 bp, Unknown
  Bacillus sp. multi
atttgatatcaactatgtggaatgtaaat

SEQ ID NO: 1225 - DNA, 29 bp, Unknown
  Bacillus sp. multi
gtttgatatcacctatatggaatgtaaat

SEQ ID NO: 1226 - DNA, 29 bp, Unknown
  Bacillus sp. multi
gtttgatatcacctatatggaatgtaaat

SEQ ID NO: 1227 - DNA, 32 bp, Unknown
  Paenibacillus thiaminolyticus (multi)
atttcaatccacgcatccgcgtaggatgcgac

SEQ ID NO: 1228 - DNA, 32 bp, Unknown; identical to SEQ ID NO: 1227
  Paenibacillus thiaminolyticus (multi)

SEQ ID NO: 1229 - DNA, 32 bp, Unknown; identical to SEQ ID NO: 1227
  Paenibacillus sp. multi

SEQ ID NO: 1230 - DNA, 32 bp, Unknown
  Paenibacillus sp. multi
atttcaatccacgcatccgcataggatgcgac

SEQ ID NO: 1231 - DNA, 32 bp, Unknown; identical to SEQ ID NO: 1227
  Paenibacillus lentimorbus (multi)

SEQ ID NO: 1232 - DNA, 32 bp, Unknown
  Paenibacillus lentimorbus (multi)
atttcagtccacgcatccgcgtaggatgcgac

SEQ ID NO: 1233 - DNA, 32 bp, Unknown; identical to SEQ ID NO: 1227
  Paenibacillus thiaminolyticus (multi)

SEQ ID NO: 1234 - DNA, 32 bp, Unknown; identical to SEQ ID NO: 1227
  Paenibacillus thiaminolyticus (multi)

SEQ ID NO: 1235 - DNA, 32 bp, Unknown; identical to SEQ ID NO: 1227
  Paenibacillus thiaminolyticus (multi)

SEQ ID NO: 1236 - DNA, 32 bp, Unknown
  Paenibacillus thiaminolyticus (multi)
atttcaatccacgcatccgtgtaggatgcgac

SEQ ID NO: 1237 - DNA, 32 bp, Unknown
  Paenibacillus thiaminolyticus (multi)
atttcaatccacgcatccacgtaggatgcgac

SEQ ID NO: 1238 - DNA, 32 bp, Paenibacillus terrae; identical to SEQ ID NO: 1227

SEQ ID NO: 1239 - DNA, 32 bp, Unknown; identical to SEQ ID NO: 1227
  Paenibacillus thiaminolyticus (multi)

SEQ ID NO: 1240 - DNA, 32 bp, Unknown; identical to SEQ ID NO: 1230
  Paenibacillus thiaminolyticus (multi)

SEQ ID NO: 1241 - DNA, 33 bp, Unknown
  Paenibacillus thiaminolyticus (multi)
aatttcaatccacgcatccacataggatgcgac

SEQ ID NO: 1242 - DNA, 25 bp, Unknown
  Bacillus sp. multi
gttttataaacactatgtagaatgt

SEQ ID NO: 1243 - DNA, 29 bp, Unknown
  Bacillus sp. multi
gttttaaatgaactatgtagaatgtgaat

SEQ ID NO: 1244 - DNA, 27 bp, Unknown
  Streptomyces sp. multi
gctccccgcgcacgcggggatgacccc

SEQ ID NO: 1245 - DNA, 35 bp, Unknown
  Bacillus sp. multi
ctatagttccaaaagaaccatcgttatgatatggt

SEQ ID NO: 1246 - DNA, 37 bp, Unknown
  Bacillus sp. multi
gctatagttccataagaaatatcgctatgctaggatc

SEQ ID NO: 1247 - DNA, 20 bp, Unknown
  Bacillus sp. multi
atttaaatacatcttatgtt

SEQ ID NO: 1248 - DNA, 28 bp, Unknown
  Bacillus sp. multi
ttttaaatacaatatgtattgttagaat

SEQ ID NO: 1249 - DNA, 28 bp, Unknown
  Bacillus sp. multi
ttttaaatacaatatgtattgttagaat

SEQ ID NO: 1250 - DNA, 28 bp, Unknown
  Bacillus sp. multi
ttttaaatctaatatgtatggttagaat

SEQ ID NO: 1251 - DNA, 19 bp, Unknown
  Lysinibacillus sp. multi
aggttacaactttattatt

SEQ ID NO: 1252 - DNA, 24 bp, Unknown
  Streptomyces sp. multi
gatacccgcgcctgcgggacggat

SEQ ID NO: 1253 - DNA, 30 bp, Unknown; identical to SEQ ID NO: 1180
  Bacillus sp. multi

SEQ ID NO: 1254 - DNA, 30 bp, Unknown; identical to SEQ ID NO: 1180
  Bacillus sp. multi

SEQ ID NO: 1255 - DNA, 30 bp, Unknown; identical to SEQ ID NO: 1180
  Bacillus sp. multi

SEQ ID NO: 1256 - DNA, 32 bp, Unknown
  Bacillus sp. multi
gttaaaacataacaatagatgtattgaaattc

SEQ ID NO: 1257 - DNA, 30 bp, Unknown; identical to SEQ ID NO: 1180
  Bacillus sp. multi

SEQ ID NO: 1258 - DNA, 30 bp, Unknown; identical to SEQ ID NO: 1180
  Bacillus sp. multi

SEQ ID NO: 1259 - DNA, 30 bp, Unknown; identical to SEQ ID NO: 1191
  Bacillus sp. multi

SEQ ID NO: 1260 - DNA, 32 bp, Unknown; identical to SEQ ID NO: 1227
  Paenibacillus thiaminolyticus (multi)

SEQ ID NO: 1261 - DNA, 32 bp, Unknown; identical to SEQ ID NO: 1236
  Paenibacillus lentimorbus (multi)

SEQ ID NO: 1262 - DNA, 32 bp, Unknown; identical to SEQ ID NO: 1227
  Paenibacillus thiaminolyticus (multi)

SEQ ID NO: 1263 - DNA, 24 bp, Unknown
  Stenotrophomonas sp. multi
atccacgcatggcgtggatctact

SEQ ID NO: 1264 - DNA, 36 bp, Unknown
  Bacillus sp. multi
tatctacgtattcttgatatcttcctaaattaaaac

SEQ ID NO: 1265 - DNA, 36 bp, Unknown; identical to SEQ ID NO: 1264
  Bacillus sp. multi

SEQ ID NO: 1266 - DNA, 34 bp, Unknown
  Bacillus sp. multi
ttcaacggtgttatcatcaatttctctttcttca

SEQ ID NO: 1267 - DNA, 35 bp, Unknown
  Bacillus sp. multi
gagtctagtcagtaactcagtagtttgtccctcgt

SEQ ID NO: 1268 - DNA, 35 bp, Unknown; identical to SEQ ID NO: 1267
  Bacillus sp. multi

SEQ ID NO: 1269 - DNA, 35 bp, Unknown; identical to SEQ ID NO: 1267
  Bacillus sp. multi

SEQ ID NO: 1270 - DNA, 35 bp, Unknown
  Bacillus sp. multi
tcgtgtatgtaatcaccatcaatatcccgatattc

SEQ ID NO: 1271 - DNA, 35 bp, Unknown; identical to SEQ ID NO: 1267
  Bacillus sp. multi

SEQ ID NO: 1272 - DNA, 35 bp, Unknown
  Bacillus sp. multi
attcgttgaataataaaatcattaacaagcacggt

SEQ ID NO: 1273 - DNA, 34 bp, Unknown
  Bacillus sp. multi
cctcaaaagaatcttattttaaaaaatccatagc

SEQ ID NO: 1274 - DNA, 34 bp, Unknown
  Bacillus sp. multi
aattgagcttaatcctaacgatgataaggtcttt

SEQ ID NO: 1275 - DNA, 35 bp, Bacillus thuringiensis; identical to SEQ ID NO: 1270

SEQ ID NO: 1276 - DNA, 37 bp, Unknown
  Bacillus sp. multi
cgtttaatgtgtaatttctatatcaaagaaggacttt

SEQ ID NO: 1277 - DNA, 37 bp, Unknown
  Bacillus sp. multi
ggtgtcattttaccatttaaggataagtttcctaaaa

SEQ ID NO: 1278 - DNA, 35 bp, Unknown; identical to SEQ ID NO: 1267
  Bacillus sp. multi

SEQ ID NO: 1279 - DNA, 34 bp, Unknown; identical to SEQ ID NO: 1273
  Bacillus sp. multi

SEQ ID NO: 1280 - DNA, 34 bp, Unknown; identical to SEQ ID NO: 1273
  Bacillus sp. multi

SEQ ID NO: 1281 - DNA, 35 bp, Unknown
  Bacillus sp. multi
gggacacttttccataattccaatattccatgaaa

SEQ ID NO: 1282 - DNA, 35 bp, Unknown; identical to SEQ ID NO: 1281
  Bacillus sp. multi

SEQ ID NO: 1283 - DNA, 34 bp, Unknown
  Bacillus sp. multi
ccttcctagttaatgatgtaggagaaaaagtcct

SEQ ID NO: 1284 - DNA, 35 bp, Unknown; identical to SEQ ID NO: 1267
  Bacillus sp. multi

SEQ ID NO: 1285 - DNA, 35 bp, Unknown; identical to SEQ ID NO: 1281
  Bacillus sp. multi

SEQ ID NO: 1286 - DNA, 37 bp, Unknown
  Bacillus sp. multi
ggtgtcattttaccatttaaggataagttccctaaaa

SEQ ID NO: 1287 - DNA, 36 bp, Unknown
  Bacillus sp. multi
atttcaacggtgttatcatcaatttccctttcttca

SEQ ID NO: 1288 - DNA, 35 bp, Unknown
  Bacillus sp. multi
tcttgatcttcggtgatttggtctagtacttttca

SEQ ID NO: 1289 - DNA, 35 bp, Unknown; identical to SEQ ID NO: 1281
  Bacillus sp. multi

SEQ ID NO: 1290 - DNA, 35 bp, Unknown
  Bacillus sp. multi
acatgattatagcatgaatttaactcatgcaaagg

SEQ ID NO: 1291 - DNA, 36 bp, Unknown
  Bacillus sp. multi
tactaatggtaaaacaaaacatagctttaatgcatg

SEQ ID NO: 1292 - DNA, 34 bp, Unknown; identical to SEQ ID NO: 1274
  Bacillus sp. multi

SEQ ID NO: 1293 - DNA, 35 bp, Unknown
  Bacillus sp. multi
tttagcatggacggactatatttgttttttaatgt

SEQ ID NO: 1294 - DNA, 36 bp, Unknown
  Bacillus sp. multi
atagctgctaatacattatcttttgctaaatcgccc

SEQ ID NO: 1295 - DNA, 36 bp, Unknown
  Bacillus sp. multi
tggtacaatggagacagacattaagtaaaatattaa

SEQ ID NO: 1296 - DNA, 35 bp, Unknown
  Bacillus sp. multi
aatatgttgccttctaaatgctgaattatttcaaa

SEQ ID NO: 1297 - DNA, 35 bp, Unknown; identical to SEQ ID NO: 1267
  Bacillus sp. multi

SEQ ID NO: 1298 - DNA, 35 bp, Unknown
  Bacillus sp. multi
ttgtatctctagctattattgtatctaaggtacca

SEQ ID NO: 1299 - DNA, 35 bp, Unknown
  Bacillus sp. multi
atataagcgcgtatatattccatagctaccttatc

SEQ ID NO: 1300 - DNA, 34 bp, Unknown; identical to SEQ ID NO: 1283
  Bacillus sp. multi

SEQ ID NO: 1301 - DNA, 37 bp, Unknown
  Bacillus sp. multi
tggggagagtgcgcaaaatgtttttgtagattaattt

SEQ ID NO: 1302 - DNA, 34 bp, Unknown
  Bacillus sp. multi
ctagcagaataaacaatttcgtccgtcataacgt

SEQ ID NO: 1303 - DNA, 35 bp, Unknown; identical to SEQ ID NO: 1267
  Bacillus sp. multi

SEQ ID NO: 1304 - DNA, 34 bp, Unknown
  Bacillus sp. multi
agcgctacatattttgtatagatttcagtaattt

SEQ ID NO: 1305 - DNA, 34 bp, Unknown; identical to SEQ ID NO: 1304
  Bacillus sp. multi

SEQ ID NO: 1306 - DNA, 33 bp, Unknown
  Bacillus sp. multi
tagcagaataaacaatttcgtccgtcataacgt

SEQ ID NO: 1307 - DNA, 35 bp, Unknown; identical to SEQ ID NO: 1298
  Bacillus sp. multi

SEQ ID NO: 1308 - DNA, 34 bp, Unknown; identical to SEQ ID NO: 1302
  Bacillus sp. multi

SEQ ID NO: 1309 - DNA, 34 bp, Unknown; identical to SEQ ID NO: 1274
  Bacillus sp. multi

SEQ ID NO: 1310 - DNA, 36 bp, Unknown; identical to SEQ ID NO: 1295
  Bacillus sp. multi

SEQ ID NO: 1311 - DNA, 37 bp, Unknown; identical to SEQ ID NO: 1286
  Bacillus sp. multi

SEQ ID NO: 1312 - DNA, 35 bp, Unknown; identical to SEQ ID NO: 1267
  Bacillus sp. multi

SEQ ID NO: 1313 - DNA, 35 bp, Unknown; identical to SEQ ID NO: 1296
  Bacillus sp. multi

SEQ ID NO: 1314 - DNA, 37 bp, Unknown; identical to SEQ ID NO: 1286
  Bacillus sp. multi

SEQ ID NO: 1315 - DNA, 35 bp, Unknown; identical to SEQ ID NO: 1296
  Bacillus sp. multi

SEQ ID NO: 1316 - DNA, 37 bp, Unknown; identical to SEQ ID NO: 1286
  Bacillus sp. multi

SEQ ID NO: 1317 - DNA, 37 bp, Paenibacillus sp. novel; identical to SEQ ID NO: 1286

SEQ ID NO: 1318 - DNA, 37 bp, Bacillus thuringiensis
tggggagagtgcgcaaagtgtttttgtagattaattt

SEQ ID NO: 1319 - DNA, 37 bp, Unknown; identical to SEQ ID NO: 1318
  Bacillus sp. multi

SEQ ID NO: 1320 - DNA, 37 bp, Unknown; identical to SEQ ID NO: 1318
  Bacillus sp. multi

SEQ ID NO: 1321 - DNA, 37 bp, Unknown; identical to SEQ ID NO: 1318
  Bacillus sp. multi

SEQ ID NO: 1322 - DNA, 36 bp, Unknown
  Bacillus sp. multi
catgcatattttaccacaataatacgaaattttgtt

SEQ ID NO: 1323 - DNA, 35 bp, Unknown; identical to SEQ ID NO: 1267
  Bacillus sp. multi

SEQ ID NO: 1324 - DNA, 37 bp, Unknown; identical to SEQ ID NO: 1318
  Bacillus sp. multi

SEQ ID NO: 1325 - DNA, 37 bp, Unknown; identical to SEQ ID NO: 1286
  Bacillus sp. multi

SEQ ID NO: 1326 - DNA, 37 bp, Unknown
  Bacillus sp. multi
agcatgatgcagtacttatgtaaagttgacttcaggc

SEQ ID NO: 1327 - DNA, 28 bp, Unknown
  Bacillus sp. multi
tcggctgatggtaatttttcttttccct

SEQ ID NO: 1328 - DNA, 36 bp, Unknown
  Bacillus sp. multi
aggtacctcgaaattaataatctagtacgttcgtta

SEQ ID NO: 1329 - DNA, 36 bp, Unknown; identical to SEQ ID NO: 1328
  Bacillus sp. multi

SEQ ID NO: 1330 - DNA, 36 bp, Unknown
  Bacillus sp. multi
gtttcgttataataacgttttgcatcgtctgtttta

SEQ ID NO: 1331 - DNA, 34 bp, Unknown
  Bacillus sp. multi
gttgaaatgtatgaagaaagcacccctaaactaa

SEQ ID NO: 1332 - DNA, 33 bp, Unknown
  Bacillus sp. multi
tcaagtgggcggcctttctaaaacacttttatt

SEQ ID NO: 1333 - DNA, 35 bp, Unknown
  Bacillus sp. multi
gttgaaatgtatgaagaaagcacccctaaactaag

SEQ ID NO: 1334 - DNA, 34 bp, Unknown; identical to SEQ ID NO: 1331
  Bacillus sp. multi

SEQ ID NO: 1335 - DNA, 35 bp, Unknown
  Bacillus sp. multi
tcgatataatccaagcaatcacctattgtcatatc

SEQ ID NO: 1336 - DNA, 34 bp, Unknown
  Bacillus sp. multi
acttattaataagtcggttaggaccctctattta

SEQ ID NO: 1337 - DNA, 37 bp, Bacillus thuringiensis
tttaaagatttttgaacctttccaggagttaaaccca

SEQ ID NO: 1338 - DNA, 35 bp, Unknown
  Bacillus sp. multi
tgatgttccagcaaatcactggtctacgaaagcaa

SEQ ID NO: 1339 - DNA, 37 bp, Unknown
  Bacillus sp. multi
attcgttgaataataaaatcaccaataagcacggtga

SEQ ID NO: 1340 - DNA, 37 bp, Unknown; identical to SEQ ID NO: 1337
  Bacillus sp. multi

SEQ ID NO: 1341 - DNA, 34 bp, Unknown
  Bacillus sp. multi
acaataatgtcctggcactcctggtatggcgcta

SEQ ID NO: 1342 - DNA, 35 bp, Unknown
  Bacillus sp. multi
gaacttaaagattctataggggacgatcctaacgc

SEQ ID NO: 1343 - DNA, 34 bp, Unknown
  Bacillus sp. multi
tcaagtgggcggcctttctaaaacacttttattg

SEQ ID NO: 1344 - DNA, 37 bp, Unknown; identical to SEQ ID NO: 1337
  Bacillus sp. multi

SEQ ID NO: 1345 - DNA, 36 bp, Unknown
  Bacillus sp. multi
tttagcccagaatatacttttaaaaaaggtagagaa

SEQ ID NO: 1346 - DNA, 36 bp, Unknown
  Bacillus sp. multi
aattgcatccaatctaaatctagcaaaattaagtga

SEQ ID NO: 1347 - DNA, 37 bp, Unknown; identical to SEQ ID NO: 1337
  Bacillus sp. multi

SEQ ID NO: 1348 - DNA, 36 bp, Unknown
  Bacillus sp. multi
tcaacatgcatttgaatagctttcgatgtgttgttg

SEQ ID NO: 1349 - DNA, 36 bp, Unknown
  Bacillus sp. multi
ccttctacacgaacccggtatacatctgaaccgtca

SEQ ID NO: 1350 - DNA, 37 bp, Unknown
  Bacillus sp. multi
attcgttgaataataaactcaccaataagcacggtga

SEQ ID NO: 1351 - DNA, 33 bp, Unknown
  Bacillus sp. multi
gaaatatagttgaaacttttccttttaacaaac

SEQ ID NO: 1352 - DNA, 37 bp, Unknown
  Bacillus sp. multi
attcgttgaataataaaatcaccaataagcatggtga

SEQ ID NO: 1353 - DNA, 37 bp, Unknown
  Bacillus sp. multi
cataacggttggtttatagtctccaaaacgataacct

SEQ ID NO: 1354 - DNA, 37 bp, Unknown
  Bacillus sp. multi
cataacggttggtttatagtctccaaaacgataaccc

SEQ ID NO: 1355 - DNA, 37 bp, Unknown; identical to SEQ ID NO: 1353
  Bacillus sp. multi

SEQ ID NO: 1356 - DNA, 37 bp, Unknown; identical to SEQ ID NO: 1350
  Bacillus sp. multi

SEQ ID NO: 1357 - DNA, 37 bp, Unknown
  Bacillus sp. multi
cttgttataactgtctcttcatacatataaggcgaat

SEQ ID NO: 1358 - DNA, 35 bp, Unknown
  Bacillus sp. multi
atctccgcctactcttattgatgaaatatatttaa

SEQ ID NO: 1359 - DNA, 36 bp, Unknown
  Bacillus sp. multi
gtcttataagtcctcgtaatacttaacgatctactg

SEQ ID NO: 1360 - DNA, 35 bp, Unknown
  Bacillus sp. multi
attatgaatggatacatacagcacgagcttccttc

SEQ ID NO: 1361 - DNA, 36 bp, Unknown; identical to SEQ ID NO: 1348
  Bacillus sp. multi

SEQ ID NO: 1362 - DNA, 34 bp, Unknown; identical to SEQ ID NO: 1336
  Bacillus sp. multi

SEQ ID NO: 1363 - DNA, 36 bp, Unknown
  Bacillus sp. multi
tgaacttaaagattctataggggacgatcctaacgc

SEQ ID NO: 1364 - DNA, 37 bp, Unknown; identical to SEQ ID NO: 1337
  Bacillus sp. multi

SEQ ID NO: 1365 - DNA, 35 bp, Unknown; identical to SEQ ID NO: 1360
  Bacillus sp. multi

SEQ ID NO: 1366 - DNA, 36 bp, Unknown
  Bacillus sp. multi
ataattgtctgataacaacacgactgaatattggga

SEQ ID NO: 1367 - DNA, 37 bp, Unknown
  Bacillus sp. multi
tttaaagatttttgaacctatccaggagttaaacaca

SEQ ID NO: 1368 - DNA, 33 bp, Unknown
  Bacillus sp. multi
acaataatgccctggcactcctggtatggcgct

SEQ ID NO: 1369 - DNA, 36 bp, Unknown
  Bacillus sp. multi
gaatatccaggaacctttttactaggtgggggatac

SEQ ID NO: 1370 - DNA, 36 bp, Unknown
  Bacillus sp. multi
tagaaggtcttcttaatacctgatacgtcacatatc

SEQ ID NO: 1371 - DNA, 34 bp, Bacillus megaterium
ggatccgcccactcataaagatcttggcttatag

SEQ ID NO: 1372 - DNA, 36 bp, Unknown
  Bacillus sp. multi
tgaaacgaggattaagcgtattacagaaaaaagttt

SEQ ID NO: 1373 - DNA, 35 bp, Unknown
  Bacillus sp. multi
tcgccccaacgctggatgatttccgcatcaacttt

SEQ ID NO: 1374 - DNA, 35 bp, Unknown; identical to SEQ ID NO: 1373
  Bacillus sp. multi

SEQ ID NO: 1375 - DNA, 35 bp, Unknown
  Paenibacillus thiaminolyticus (multi)
tcatagaccgtcatagttgttccgtccttcagtgt

SEQ ID NO: 1376 - DNA, 35 bp, Unknown
  Paenibacillus thiaminolyticus (multi)
ttataaataacatatcacatcttccgattgacata

SEQ ID NO: 1377 - DNA, 34 bp, Unknown
  Paenibacillus sp. multi
cagtagtaatggttccgcgttagctcgggtgtac

SEQ ID NO: 1378 - DNA, 38 bp, Unknown
  Paenibacillus sp. multi
atgtttactatgttcctcgaaaagagctactctatctt

SEQ ID NO: 1379 - DNA, 34 bp, Unknown
  Paenibacillus lentimorbus (multi)
tggcaagaaaaatagggagggattgggcgttaga

SEQ ID NO: 1380 - DNA, 33 bp, Unknown
  Paenibacillus lentimorbus (multi)
ggtggtcggcatgaaacgattcacgaccgactg

SEQ ID NO: 1381 - DNA, 36 bp, Unknown
  Paenibacillus thiaminolyticus (multi)
cacctccgatatacttgttaataccattttaccaca

SEQ ID NO: 1382 - DNA, 33 bp, Unknown
  Paenibacillus thiaminolyticus (multi)
tagtctggtgctccatttctttctgccaaatat

SEQ ID NO: 1383 - DNA, 33 bp, Unknown
  Paenibacillus thiaminolyticus (multi)
gcgagcggtgggagtttgtccgtggaatgtaag

SEQ ID NO: 1384 - DNA, 33 bp, Unknown
  Paenibacillus thiaminolyticus (multi)
gatgtgtgccgcgttgaaccggcccacatagac

SEQ ID NO: 1385 - DNA, 35 bp, Unknown
  Paenibacillus thiaminolyticus (multi)
aaatgagagatataactatgtggtgtcctcgatgc

SEQ ID NO: 1386 - DNA, 34 bp, Paenibacillus terrae
tgaggatttcgataatcgttcgctccgtgcgttg

SEQ ID NO: 1387 - DNA, 34 bp, Unknown
  Paenibacillus thiaminolyticus (multi)
aaaagatcgttattgtcgcgggcggaggtaaggc

SEQ ID NO: 1388 - DNA, 34 bp, Unknown
  Paenibacillus thiaminolyticus (multi)
tcttcgaggttgaaatggatgggaagccctaccg

SEQ ID NO: 1389 - DNA, 33 bp, Unknown
  Paenibacillus thiaminolyticus (multi)
aagcatgtgagaatggggtagccaatcagctta

SEQ ID NO: 1390 - DNA, 40 bp, Unknown
  Bacillus sp. multi
gaatgttagcacttgtaatttagttctaaaacggctgcaa

SEQ ID NO: 1391 - DNA, 36 bp, Unknown
  Bacillus sp. multi
aatatagctgaattcttgtgcataactcgaaattat

SEQ ID NO: 1392 - DNA, 34 bp, Unknown
  Streptomyces sp. multi
ttggcattgactcagggggtggggctcaagaatg

SEQ ID NO: 1393 - DNA, 31 bp, Unknown
  Bacillus sp. multi
cacatccgacttcgaatggaatgcaatgtgg

SEQ ID NO: 1394 - DNA, 29 bp, Unknown
  Bacillus sp. multi
tttactacttaatgcagttagtaagtttg

SEQ ID NO: 1395 - DNA, 46 bp, Unknown
  Bacillus sp. multi
ggtattaaaccgccttttcatcttgaattatgcgatgagcataaaa

SEQ ID NO: 1396 - DNA, 37 bp, Unknown
  Bacillus sp. multi
tcgcttctgctaataattgattcacttcaaatgttcg

SEQ ID NO: 1397 - DNA, 37 bp, Unknown; identical to SEQ ID NO: 1396
  Bacillus sp. multi

SEQ ID NO: 1398 - DNA, 37 bp, Unknown
  Bacillus sp. multi
ttccccttttctacaaaatggttgttaatatcgttcg

SEQ ID NO: 1399 - DNA, 38 bp, Unknown
  Lysinibacillus sp. multi
ctttttgaatctcacattcaggaaaaaattgtaattct

SEQ ID NO: 1400 - DNA, 37 bp, Unknown
  Streptomyces sp. multi
atgaacctcgcccccgcaccgtaccggacccgccgta

SEQ ID NO: 1401 - DNA, 37 bp, Unknown; identical to SEQ ID NO: 1350
  Bacillus sp. multi

SEQ ID NO: 1402 - DNA, 37 bp, Unknown; identical to SEQ ID NO: 1350
  Bacillus sp. multi

SEQ ID NO: 1403 - DNA, 36 bp, Unknown
  Bacillus sp. multi
ttaagtcattatatgacaccgtatgctatgtggatt

SEQ ID NO: 1404 - DNA, 34 bp, Unknown
  Bacillus sp. multi
cataaaaggagataaagcttttaacgtttttgtt

SEQ ID NO: 1405 - DNA, 36 bp, Unknown
  Bacillus sp. multi
ccttctacacgaacccggtttacatctgaaccgtca

SEQ ID NO: 1406 - DNA, 35 bp, Unknown; identical to SEQ ID NO: 1335
  Bacillus sp. multi

SEQ ID NO: 1407 - DNA, 37 bp, Unknown; identical to SEQ ID NO: 1339
  Bacillus sp. multi

SEQ ID NO: 1408 - DNA, 37 bp, Unknown
  Paenibacillus thiaminolyticus (multi)
ggcgaagctgcagctcgcgctcctggttgttcttccg

SEQ ID NO: 1409 - DNA, 34 bp, Unknown
  Paenibacillus lentimorbus (multi)
ggagggtgttgtcctatacgctacttccaatgca

SEQ ID NO: 1410 - DNA, 33 bp, Unknown
  Paenibacillus thiaminolyticus (multi)
gcgctgtgccggccaacgcaatcatcgattatg

SEQ ID NO: 1411 - DNA, 24 bp, Unknown
  Stenotrophomonas sp. multi
ggattgtgcggggtggctggtcgt

SEQ ID NO: 1412 - DNA, 66 bp, Unknown
  Bacillus sp. multi
gtttaacattaacataagatgtatttaaattatctacgtattcttgatatcttcctaaattaaaac

SEQ ID NO: 1413 - DNA, 66 bp, Unknown; identical to SEQ ID NO: 1412
  Bacillus sp. multi

SEQ ID NO: 1414 - DNA, 66 bp, Unknown
  Bacillus sp. multi
gtttaacattaacataagatgtatttaaatatttcaacggtgttatcatcaatttctctttcttca

SEQ ID NO: 1415 - DNA, 65 bp, Unknown
  Bacillus sp. multi
gtttagtactaacacaagatgtatttaaatgagtctagtcagtaactcagtagtttgtccctcgt

SEQ ID NO: 1416 - DNA, 65 bp, Unknown; identical to SEQ ID NO: 1415
  Bacillus sp. multi

SEQ ID NO: 1417 - DNA, 65 bp, Unknown; identical to SEQ ID NO: 1415
  Bacillus sp. multi

SEQ ID NO: 1418 - DNA, 65 bp, Unknown
  Bacillus sp. multi
gtttaccagtaacataagatgtatttaaattcgtgtatgtaatcaccatcaatatcccgatattc

SEQ ID NO: 1419 - DNA, 65 bp, Unknown; identical to SEQ ID NO: 1415
  Bacillus sp. multi

SEQ ID NO: 1420 - DNA, 65 bp, Unknown
  Bacillus sp. multi
gtttaacactaacataagatgtatttaaatattcgttgaataataaaatcattaacaagcacggt

SEQ ID NO: 1421 - DNA, 64 bp, Unknown
  Bacillus sp. multi
gtttaacattaatataagatgtatttaaatcctcaaaagaatcttattttaaaaaatccatagc

SEQ ID NO: 1422 - DNA, 64 bp, Unknown
  Bacillus sp. multi
gtttaacattaacataagatgtatttaaataattgagcttaatcctaacgatgataaggtcttt

SEQ ID NO: 1423 - DNA, 65 bp, Bacillus thuringiensis
gtttaacatcaacataagatgtatttaaattcgtgtatgtaatcaccatcaatatcccgatattc

SEQ ID NO: 1424 - DNA, 67 bp, Unknown
  Bacillus sp. multi
gtttaccattagcataagatgtatttaaatcgtttaatgtgtaatttctatatcaaagaaggacttt

SEQ ID NO: 1425 - DNA, 67 bp, Unknown
  Bacillus sp. multi
gtttagtactaacataagatgtatttaaatggtgtcattttaccatttaaggataagtttcctaaaa

SEQ ID NO: 1426 - DNA, 65 bp, Unknown; identical to SEQ ID NO: 1415
  Bacillus sp. multi

SEQ ID NO: 1427 - DNA, 64 bp, Unknown; identical to SEQ ID NO: 1421
  Bacillus sp. multi

SEQ ID NO: 1428 - DNA, 64 bp, Unknown; identical to SEQ ID NO: 1421
  Bacillus sp. multi

SEQ ID NO: 1429 - DNA, 65 bp, Unknown
  Bacillus sp. multi
gtttaacactaacataagatgtatttaaatgggacacttttccataattccaatattccatgaaa

SEQ ID NO: 1430 - DNA, 65 bp, Unknown; identical to SEQ ID NO: 1429
  Bacillus sp. multi

SEQ ID NO: 1431 - DNA, 64 bp, Unknown
  Bacillus sp. multi
gtttaacatcaacataagatgtatttaaatccttcctagttaatgatgtaggagaaaaagtcct

SEQ ID NO: 1432 - DNA, 65 bp, Unknown; identical to SEQ ID NO: 1415
  Bacillus sp. multi

SEQ ID NO: 1433 - DNA, 65 bp, Unknown; identical to SEQ ID NO: 1429
  Bacillus sp. multi

SEQ ID NO: 1434 - DNA, 67 bp, Unknown
  Bacillus sp. multi
gtttagtactaacataagatgtatttaaatggtgtcattttaccatttaaggataagttccctaaaa

SEQ ID NO: 1435 - DNA, 66 bp, Unknown
  Bacillus sp. multi
gtttagtactaacataagatgtatttaaatatttcaacggtgttatcatcaatttccctttcttca

SEQ ID NO: 1436 - DNA, 65 bp, Unknown
  Bacillus sp. multi
gtttagtactaatataagatgtatttaaattcttgatcttcggtgatttggtctagtacttttca

SEQ ID NO: 1437 - DNA, 65 bp, Unknown; identical to SEQ ID NO: 1429
  Bacillus sp. multi

SEQ ID NO: 1438 - DNA, 65 bp, Unknown
  Bacillus sp. multi
gtttaacactaacataagatgtatttaaatacatgattatagcatgaatttaactcatgcaaagg

SEQ ID NO: 1439 - DNA, 66 bp, Unknown
  Bacillus sp. multi
gtttaacactaacacaagatgtatttaaattactaatggtaaaacaaaacatagctttaatgcatg

SEQ ID NO: 1440 - DNA, 64 bp, Unknown; identical to SEQ ID NO: 1422
  Bacillus sp. multi

SEQ ID NO: 1441 - DNA, 65 bp, Unknown
  Bacillus sp. multi
gtttaacactgacataagatgtatttaaattttagcatggacggactatatttgttttttaatgt

SEQ ID NO: 1442 - DNA, 66 bp, Unknown
  Bacillus sp. multi
gtttatcattaacataagatgtatttaaatatagctgctaatacattatcttttgctaaatcgccc

SEQ ID NO: 1443 - DNA, 66 bp, Unknown
  Bacillus sp. multi
gtttaacactaacataggatgtatttaaattggtacaatggagacagacattaagtaaaatattaa

SEQ ID NO: 1444 - DNA, 65 bp, Unknown
  Bacillus sp. multi
gtttagcactaacataagatgtatttaaataatatgttgccttctaaatgctgaattatttcaaa

SEQ ID NO: 1445 - DNA, 65 bp, Unknown
  Bacillus sp. multi
gtttaacactaacataagatgtatttaaatgagtctagtcagtaactcagtagtttgtccctcgt

SEQ ID NO: 1446 - DNA, 65 bp, Unknown
  Bacillus sp. multi
gtttagtattaacataagatgtatttaaatttgtatctctagctattattgtatctaaggtacca

SEQ ID NO: 1447 - DNA, 65 bp, Unknown
  Bacillus sp. multi
gtttaacactaacataagatgtatttaaatatataagcgcgtatatattccatagctaccttatc

SEQ ID NO: 1448 - DNA, 64 bp, Unknown; identical to SEQ ID NO: 1431
  Bacillus sp. multi

SEQ ID NO: 1449 - DNA, 67 bp, Unknown
  Bacillus sp. multi
gtttagtactaacataagatgtatttaaattggggagagtgcgcaaaatgtttttgtagattaattt

SEQ ID NO: 1450 - DNA, 64 bp, Unknown
  Bacillus sp. multi
gtttaacactaacataagatgtatttaaatctagcagaataaacaatttcgtccgtcataacgt

SEQ ID NO: 1451 - DNA, 65 bp, Unknown; identical to SEQ ID NO: 1415
  Bacillus sp. multi

SEQ ID NO: 1452 - DNA, 64 bp, Unknown
  Bacillus sp. multi
gtttaacactaacataagatgtatttaaatagcgctacatattttgtatagatttcagtaattt

SEQ ID NO: 1453 - DNA, 64 bp, Unknown; identical to SEQ ID NO: 1452
  Bacillus sp. multi

SEQ ID NO: 1454 - DNA, 64 bp, Unknown; identical to SEQ ID NO: 1450
  Bacillus sp. multi

SEQ ID NO: 1455 - DNA, 65 bp, Unknown; identical to SEQ ID NO: 1446
  Bacillus sp. multi

SEQ ID NO: 1456 - DNA, 64 bp, Unknown; identical to SEQ ID NO: 1450
  Bacillus sp. multi

SEQ ID NO: 1457 - DNA, 64 bp, Unknown
  Bacillus sp. multi
gtttagtactaacacaagatgtatttaaataattgagcttaatcctaacgatgataaggtcttt

SEQ ID NO: 1458 - DNA, 66 bp, Unknown; identical to SEQ ID NO: 1443
  Bacillus sp. multi

SEQ ID NO: 1459 - DNA, 67 bp, Unknown; identical to SEQ ID NO: 1434
  Bacillus sp. multi

SEQ ID NO: 1460 - DNA, 65 bp, Unknown; identical to SEQ ID NO: 1415
  Bacillus sp. multi

SEQ ID NO: 1461 - DNA, 65 bp, Unknown; identical to SEQ ID NO: 1444
  Bacillus sp. multi

SEQ ID NO: 1462 - DNA, 67 bp, Unknown; identical to SEQ ID NO: 1434
  Bacillus sp. multi

SEQ ID NO: 1463 - DNA, 65 bp, Unknown; identical to SEQ ID NO: 1444
  Bacillus sp. multi

SEQ ID NO: 1464 - DNA, 67 bp, Unknown; identical to SEQ ID NO: 1434
  Bacillus sp. multi

SEQ ID NO: 1465 - DNA, 67 bp, Paenibacillus sp. novel; identical to SEQ ID NO: 1434

SEQ ID NO: 1466 - DNA, 67 bp, Bacillus thuringiensis
gtttagtactaacataagatgtatttaaattggggagagtgcgcaaagtgtttttgtagattaattt

SEQ ID NO: 1467 - DNA, 67 bp, Unknown; identical to SEQ ID NO: 1466
  Bacillus sp. multi

SEQ ID NO: 1468 - DNA, 67 bp, Unknown; identical to SEQ ID NO: 1466
  Bacillus sp. multi

SEQ ID NO: 1469 - DNA, 67 bp, Unknown; identical to SEQ ID NO: 1466
  Bacillus sp. multi

SEQ ID NO: 1470 - DNA, 66 bp, Unknown
  Bacillus sp. multi
gtttagtatgaacataagatgtatttagatcatgcatattttaccacaataatacgaaattttgtt

SEQ ID NO: 1471 - DNA, 65 bp, Unknown; identical to SEQ ID NO: 1415
  Bacillus sp. multi

SEQ ID NO: 1472 - DNA, 67 bp, Unknown; identical to SEQ ID NO: 1466
  Bacillus sp. multi

SEQ ID NO: 1473 - DNA, 67 bp, Unknown; identical to SEQ ID NO: 1434
  Bacillus sp. multi

SEQ ID NO: 1474 - DNA, 67 bp, Unknown
  Bacillus sp. multi
gtttaaacataacaatagatgtattgaaatagcatgatgcagtacttatgtaaagttgacttcaggc

SEQ ID NO: 1475 - DNA, 66 bp, Unknown
  Bacillus sp. multi
gttcgttagttaaaacataacaatagatgtattgaaattcggctgatggtaatttttcttttccct

SEQ ID NO: 1476 - DNA, 66 bp, Unknown
  Bacillus sp. multi
gttaaaacataacaatagatgtattgaaataggtacctcgaaattaataatctagtacgttcgtta

SEQ ID NO: 1477 - DNA, 66 bp, Unknown; identical to SEQ ID NO: 1476
  Bacillus sp. multi

SEQ ID NO: 1478 - DNA, 66 bp, Unknown
  Bacillus sp. multi
gtaaaaaaataacaatagatgtattgaaatgtttcgttataataacgttttgcatcgtctgtttta

SEQ ID NO: 1479 - DNA, 65 bp, Unknown
  Bacillus sp. multi
ggttaaaacaaaacaatagatgtattgaaatgttgaaatgtatgaagaaagcacccctaaactaa

SEQ ID NO: 1480 - DNA, 64 bp, Unknown
  Bacillus sp. multi
ggttaagacataacaatagatgtattgaaattcaagtgggcggcctttctaaaacacttttatt

SEQ ID NO: 1481 - DNA, 65 bp, Unknown
  Bacillus sp. multi
gttaaaacaaaacaatagatgtattgaaatgttgaaatgtatgaagaaagcacccctaaactaag

SEQ ID NO: 1482 - DNA, 65 bp, Unknown; identical to SEQ ID NO: 1479
  Bacillus sp. multi

SEQ ID NO: 1483 - DNA, 65 bp, Unknown
  Bacillus sp. multi
gttaaaacataacaatagatgtattgaaattcgatataatccaagcaatcacctattgtcatatc

SEQ ID NO: 1484 - DNA, 65 bp, Unknown
  Bacillus sp. multi
aggtaaaacataataatagatgtattgaaatacttattaataagtcggttaggaccctctattta

SEQ ID NO: 1485 - DNA, 67 bp, Bacillus thuringiensis
gttaaaacataacaatagatgtattgaaattttaaagatttttgaacctttccaggagttaaaccca

SEQ ID NO: 1486 - DNA, 66 bp, Unknown
  Bacillus sp. multi
ggttaaaacataacaatagatgtattgaaattgatgttccagcaaatcactggtctacgaaagcaa

SEQ ID NO: 1487 - DNA, 67 bp, Unknown
  Bacillus sp. multi
gttaaaacataaaaatagatgtattgaaatattcgttgaataataaaatcaccaataagcacggtga

SEQ ID NO: 1488 - DNA, 67 bp, Unknown; identical to SEQ ID NO: 1485
  Bacillus sp. multi

SEQ ID NO: 1489 - DNA, 64 bp, Unknown
  Bacillus sp. multi
gttaaaacataacaatagatgtattgaaatacaataatgtcctggcactcctggtatggcgcta

SEQ ID NO: 1490 - DNA, 66 bp, Unknown
  Bacillus sp. multi
gttaaaacataacaatagatgtattgaaattgaacttaaagattctataggggacgatcctaacgc

SEQ ID NO: 1491 - DNA, 64 bp, Unknown
  Bacillus sp. multi
gttaagacataacaatagatgtattgaaattcaagtgggcggcctttctaaaacacttttattg

SEQ ID NO: 1492 - DNA, 67 bp, Unknown; identical to SEQ ID NO: 1485
  Bacillus sp. multi

SEQ ID NO: 1493 - DNA, 66 bp, Unknown
  Bacillus sp. multi
gttaaaacataacaatagatgtattgaaattttagcccagaatatacttttaaaaaaggtagagaa

SEQ ID NO: 1494 - DNA, 66 bp, Unknown
  Bacillus sp. multi
gttaaaacctaacaatagatgtattgaaataattgcatccaatctaaatctagcaaaattaagtga

SEQ ID NO: 1495 - DNA, 67 bp, Unknown; identical to SEQ ID NO: 1485
  Bacillus sp. multi

SEQ ID NO: 1496 - DNA, 66 bp, Unknown
  Bacillus sp. multi
gttaaaacataacaatagatgtattgaaattcaacatgcatttgaatagctttcgatgtgttgttg

SEQ ID NO: 1497 - DNA, 66 bp, Unknown
  Bacillus sp. multi
gttaaaacataacaatagatgtattgaaatccttctacacgaacccggtatacatctgaaccgtca

SEQ ID NO: 1498 - DNA, 67 bp, Unknown
  Bacillus sp. multi
gttaaaacataacaatagatgtattgaaatattcgttgaataataaactcaccaataagcacggtga

SEQ ID NO: 1499 - DNA, 65 bp, Unknown
  Bacillus sp. multi
gttcgttggttaaacataacaatagatgtattgaaatatagttgaaacttttccttttaacaaac

SEQ ID NO: 1500 - DNA, 67 bp, Unknown
  Bacillus sp. multi
gttaaaacataacaatagatgtattgaaatattcgttgaataataaaatcaccaataagcatggtga

SEQ ID NO: 1501 - DNA, 66 bp, Unknown
  Bacillus sp. multi
gtaaaacataataatagatgtattgaaatcataacggttggtttatagtctccaaaacgataacct

SEQ ID NO: 1502 - DNA, 67 bp, Unknown
  Bacillus sp. multi
ggtaaaacataataatagatgtattgaaatcataacggttggtttatagtctccaaaacgataaccc

SEQ ID NO: 1503 - DNA, 67 bp, Unknown
  Bacillus sp. multi
ggtaaaacataataatagatgtattgaaatcataacggttggtttatagtctccaaaacgataacct

SEQ ID NO: 1504 - DNA, 67 bp, Unknown; identical to SEQ ID NO: 1498
  Bacillus sp. multi

SEQ ID NO: 1505 - DNA, 67 bp, Unknown
  Bacillus sp. multi
gtttaaacaaaacaatagatgtattgaaatcttgttataactgtctcttcatacatataaggcgaat

SEQ ID NO: 1506 - DNA, 65 bp, Unknown
  Bacillus sp. multi
gttaaaacataacaatagatgtattgaaatatctccgcctactcttattgatgaaatatatttaa

SEQ ID NO: 1507 - DNA, 66 bp, Unknown
  Bacillus sp. multi
gtttaaatataacaatagatgtattgaaatgtcttataagtcctcgtaatacttaacgatctactg

SEQ ID NO: 1508 - DNA, 65 bp, Unknown
  Bacillus sp. multi
gttaaaacataacaatagatgtattgaaatattatgaatggatacatacagcacgagcttccttc

SEQ ID NO: 1509 - DNA, 66 bp, Unknown; identical to SEQ ID NO: 1496
  Bacillus sp. multi

SEQ ID NO: 1510 - DNA, 65 bp, Unknown; identical to SEQ ID NO: 1484
  Bacillus sp. multi

SEQ ID NO: 1511 - DNA, 66 bp, Unknown; identical to SEQ ID NO: 1490
  Bacillus sp. multi

SEQ ID NO: 1512 - DNA, 67 bp, Unknown; identical to SEQ ID NO: 1485
  Bacillus sp. multi

SEQ ID NO: 1513 - DNA, 65 bp, Unknown; identical to SEQ ID NO: 1508
  Bacillus sp. multi

SEQ ID NO: 1514 - DNA, 66 bp, Unknown
  Bacillus sp. multi
gttaaaacataacaatagatgtattgaaatataattgtctgataacaacacgactgaatattggga

SEQ ID NO: 1515 - DNA, 67 bp, Unknown
  Bacillus sp. multi
gttaaaacataacaatagatgtattgaaattttaaagatttttgaacctatccaggagttaaacaca

SEQ ID NO: 1516 - DNA, 64 bp, Unknown
  Bacillus sp. multi
agttaaaacataacaatagatgtattgaaatacaataatgccctggcactcctggtatggcgct

SEQ ID NO: 1517 - DNA, 66 bp, Unknown
  Bacillus sp. multi
gtttaaacataacaatagatgtattgaaatgaatatccaggaacctttttactaggtgggggatac

SEQ ID NO: 1518 - DNA, 67 bp, Unknown
  Bacillus sp. multi
gttcaaaccaaacaatagatgtattgaaatttagaaggtcttcttaatacctgatacgtcacatatc

SEQ ID NO: 1519 - DNA, 67 bp, Bacillus megaterium
gtcacaccctacatgggtgtaaggattgaaattggatccgcccactcataaagatcttggcttatag

SEQ ID NO: 1520 - DNA, 65 bp, Unknown
  Bacillus sp. multi
atttgatatcaactatgtggaatgtaaattgaaacgaggattaagcgtattacagaaaaaagttt

SEQ ID NO: 1521 - DNA, 64 bp, Unknown
  Bacillus sp. multi
gtttgatatcacctatatggaatgtaaattcgccccaacgctggatgatttccgcatcaacttt

SEQ ID NO: 1522 - DNA, 64 bp, Unknown; identical to SEQ ID NO: 1521
  Bacillus sp. multi

SEQ ID NO: 1523 - DNA, 67 bp, Unknown
  Paenibacillus thiaminolyticus (multi)
atttcaatccacgcatccgcgtaggatgcgactcatagaccgtcatagttgttccgtccttcagtgt

SEQ ID NO: 1524 - DNA, 67 bp, Unknown
  Paenibacillus thiaminolyticus (multi)
atttcaatccacgcatccgcgtaggatgcgacttataaataacatatcacatcttccgattgacata

SEQ ID NO: 1525 - DNA, 66 bp, Unknown
  Paenibacillus sp. multi
atttcaatccacgcatccgcgtaggatgcgaccagtagtaatggttccgcgttagctcgggtgtac

SEQ ID NO: 1526 - DNA, 70 bp, Unknown
  Paenibacillus sp. multi
atttcaatccacgcatccgcataggatgcgacatgtttactatgttcctcgaaaagagctactctatctt

SEQ ID NO: 1527 - DNA, 66 bp, Unknown
  Paenibacillus lentimorbus (multi)
atttcaatccacgcatccgcgtaggatgcgactggcaagaaaaatagggagggattgggcgttaga

SEQ ID NO: 1528 - DNA, 65 bp, Unknown
  Paenibacillus lentimorbus (multi)
atttcagtccacgcatccgcgtaggatgcgacggtggtcggcatgaaacgattcacgaccgactg

SEQ ID NO: 1529 - DNA, 68 bp, Unknown
  Paenibacillus thiaminolyticus (multi)
atttcaatccacgcatccgcgtaggatgcgaccacctccgatatacttgttaataccattttaccaca

SEQ ID NO: 1530 - DNA, 65 bp, Unknown
  Paenibacillus thiaminolyticus (multi)
atttcaatccacgcatccgcgtaggatgcgactagtctggtgctccatttctttctgccaaatat

SEQ ID NO: 1531 - DNA, 65 bp, Unknown
  Paenibacillus thiaminolyticus (multi)
atttcaatccacgcatccgcgtaggatgcgacgcgagcggtgggagtttgtccgtggaatgtaag

SEQ ID NO: 1532 - DNA, 65 bp, Unknown
  Paenibacillus thiaminolyticus (multi)
atttcaatccacgcatccgtgtaggatgcgacgatgtgtgccgcgttgaaccggcccacatagac

SEQ ID NO: 1533 - DNA, 67 bp, Unknown
  Paenibacillus thiaminolyticus (multi)
atttcaatccacgcatccacgtaggatgcgacaaatgagagatataactatgtggtgtcctcgatgc

SEQ ID NO: 1534 - DNA, 66 bp, Paenibacillus terrae
atttcaatccacgcatccgcgtaggatgcgactgaggatttcgataatcgttcgctccgtgcgttg

SEQ ID NO: 1535 - DNA, 66 bp, Unknown
  Paenibacillus thiaminolyticus (multi)
atttcaatccacgcatccgcgtaggatgcgacaaaagatcgttattgtcgcgggcggaggtaaggc

SEQ ID NO: 1536 - DNA, 66 bp, Unknown
  Paenibacillus thiaminolyticus (multi)
atttcaatccacgcatccgcataggatgcgactcttcgaggttgaaatggatgggaagccctaccg

SEQ ID NO: 1537 - DNA, 66 bp, Unknown
  Paenibacillus thiaminolyticus (multi)
aatttcaatccacgcatccacataggatgcgacaagcatgtgagaatggggtagccaatcagctta

SEQ ID NO: 1538 - DNA, 65 bp, Unknown
  Bacillus sp. multi
gttttataaacactatgtagaatgtgaatgttagcacttgtaatttagttctaaaacggctgcaa

SEQ ID NO: 1539 - DNA, 65 bp, Unknown
  Bacillus sp. multi
gttttaaatgaactatgtagaatgtgaataatatagctgaattcttgtgcataactcgaaattat

SEQ ID NO: 1540 - DNA, 61 bp, Unknown
  Streptomyces sp. multi
gctccccgcgcacgcggggatgaccccttggcattgactcagggggtggggctcaagaatg

SEQ ID NO: 1541 - DNA, 66 bp, Unknown
  Bacillus sp. multi
ctatagttccaaaagaaccatcgttatgatatggtcacatccgacttcgaatggaatgcaatgtgg

SEQ ID NO: 1542 - DNA, 66 bp, Unknown
  Bacillus sp. multi
gctatagttccataagaaatatcgctatgctaggatctttactacttaatgcagttagtaagtttg

SEQ ID NO: 1543 - DNA, 66 bp, Unknown
  Bacillus sp. multi
atttaaatacatcttatgttggtattaaaccgccttttcatcttgaattatgcgatgagcataaaa

SEQ ID NO: 1544 - DNA, 65 bp, Unknown
  Bacillus sp. multi
ttttaaatacaatatgtattgttagaattcgcttctgctaataattgattcacttcaaatgttcg

SEQ ID NO: 1545 - DNA, 65 bp, Unknown; identical to SEQ ID NO: 1544
  Bacillus sp. multi

SEQ ID NO: 1546 - DNA, 65 bp, Unknown
  Bacillus sp. multi
ttttaaatctaatatgtatggttagaatttccccttttctacaaaatggttgttaatatcgttcg

SEQ ID NO: 1547 - DNA, 57 bp, Unknown
  Lysinibacillus sp. multi
aggttacaactttattattctttttgaatctcacattcaggaaaaaattgtaattct

SEQ ID NO: 1548 - DNA, 61 bp, Unknown
  Streptomyces sp. multi
gatacccgcgcctgcgggacggatatgaacctcgcccccgcaccgtaccggacccgccgta

SEQ ID NO: 1549 - DNA, 67 bp, Unknown; identical to SEQ ID NO: 1498
  Bacillus sp. multi

SEQ ID NO: 1550 - DNA, 67 bp, Unknown; identical to SEQ ID NO: 1498
  Bacillus sp. multi

SEQ ID NO: 1551 - DNA, 66 bp, Unknown
  Bacillus sp. multi
gttaaaacataacaatagatgtattgaaatttaagtcattatatgacaccgtatgctatgtggatt

SEQ ID NO: 1552 - DNA, 66 bp, Unknown
  Bacillus sp. multi
gttaaaacataacaatagatgtattgaaattccataaaaggagataaagcttttaacgtttttgtt

SEQ ID NO: 1553 - DNA, 66 bp, Unknown
  Bacillus sp. multi
gttaaaacataacaatagatgtattgaaatccttctacacgaacccggtttacatctgaaccgtca

SEQ ID NO: 1554 - DNA, 65 bp, Unknown; identical to SEQ ID NO: 1483
  Bacillus sp. multi

SEQ ID NO: 1555 - DNA, 67 bp, Unknown; identical to SEQ ID NO: 1487
  Bacillus sp. multi

SEQ ID NO: 1556 - DNA, 69 bp, Unknown
  Paenibacillus thiaminolyticus (multi)
atttcaatccacgcatccgcgtaggatgcgacggcgaagctgcagctcgcgctcctggttgttcttccg

SEQ ID NO: 1557 - DNA, 66 bp, Unknown
  Paenibacillus lentimorbus (multi)
atttcaatccacgcatccgtgtaggatgcgacggagggtgttgtcctatacgctacttccaatgca

SEQ ID NO: 1558 - DNA, 65 bp, Unknown
  Paenibacillus thiaminolyticus (multi)
atttcaatccacgcatccgcgtaggatgcgacgcgctgtgccggccaacgcaatcatcgattatg

SEQ ID NO: 1559 - DNA, 48 bp, Unknown
  Stenotrophomonas sp. multi
atccacgcatggcgtggatctactggattgtgcggggtggctggtcgt

SEQ ID NO: 1560 - DNA, 66 bp, Unknown
  Bacillus sp. multi
gttttaatttaggaagatatcaagaatacgtagataatttaaatacatcttatgttaatgttaaac

SEQ ID NO: 1561 - DNA, 66 bp, Unknown; identical to SEQ ID NO: 1560
  Bacillus sp. multi

SEQ ID NO: 1562 - DNA, 66 bp, Unknown
  Bacillus sp. multi
tgaagaaagagaaattgatgataacaccgttgaaatatttaaatacatcttatgttaatgttaaac

SEQ ID NO: 1563 - DNA, 65 bp, Unknown
  Bacillus sp. multi
acgagggacaaactactgagttactgactagactcatttaaatacatcttgtgttagtactaaac

SEQ ID NO: 1564 - DNA, 65 bp, Unknown; identical to SEQ ID NO: 1563
  Bacillus sp. multi

SEQ ID NO: 1565 - DNA, 65 bp, Unknown; identical to SEQ ID NO: 1563
  Bacillus sp. multi

SEQ ID NO: 1566 - DNA, 65 bp, Unknown
  Bacillus sp. multi
gaatatcgggatattgatggtgattacatacacgaatttaaatacatcttatgttactggtaaac

SEQ ID NO: 1567 - DNA, 65 bp, Unknown; identical to SEQ ID NO: 1563
  Bacillus sp. multi

SEQ ID NO: 1568 - DNA, 65 bp, Unknown
  Bacillus sp. multi
accgtgcttgttaatgattttattattcaacgaatatttaaatacatcttatgttagtgttaaac

SEQ ID NO: 1569 - DNA, 64 bp, Unknown
  Bacillus sp. multi
gctatggattttttaaaataagattcttttgaggatttaaatacatcttatattaatgttaaac

SEQ ID NO: 1570 - DNA, 64 bp, Unknown
  Bacillus sp. multi
aaagaccttatcatcgttaggattaagctcaattatttaaatacatcttatgttaatgttaaac

SEQ ID NO: 1571 - DNA, 65 bp, Bacillus thuringiensis
gaatatcgggatattgatggtgattacatacacgaatttaaatacatcttatgttgatgttaaac

SEQ ID NO: 1572 - DNA, 67 bp, Unknown
  Bacillus sp. multi
aaagtccttctttgatatagaaattacacattaaacgatttaaatacatcttatgctaatggtaaac

SEQ ID NO: 1573 - DNA, 67 bp, Unknown
  Bacillus sp. multi
ttttaggaaacttatccttaaatggtaaaatgacaccatttaaatacatcttatgttagtactaaac

SEQ ID NO: 1574 - DNA, 65 bp, Unknown; identical to SEQ ID NO: 1563
  Bacillus sp. multi

SEQ ID NO: 1575 - DNA, 64 bp, Unknown; identical to SEQ ID NO: 1569
  Bacillus sp. multi

SEQ ID NO: 1576 - DNA, 64 bp, Unknown; identical to SEQ ID NO: 1569
  Bacillus sp. multi

SEQ ID NO: 1577 - DNA, 65 bp, Unknown
  Bacillus sp. multi
tttcatggaatattggaattatggaaaagtgtcccatttaaatacatcttatgttagtgttaaac

SEQ ID NO: 1578 - DNA, 65 bp, Unknown; identical to SEQ ID NO: 1577
  Bacillus sp. multi

SEQ ID NO: 1579 - DNA, 64 bp, Unknown
  Bacillus sp. multi
aggactttttctcctacatcattaactaggaaggatttaaatacatcttatgttgatgttaaac

SEQ ID NO: 1580 - DNA, 65 bp, Unknown; identical to SEQ ID NO: 1563
  Bacillus sp. multi

SEQ ID NO: 1581 - DNA, 65 bp, Unknown; identical to SEQ ID NO: 1577
  Bacillus sp. multi

SEQ ID NO: 1582 - DNA, 67 bp, Unknown
  Bacillus sp. multi
ttttagggaacttatccttaaatggtaaaatgacaccatttaaatacatcttatgttagtactaaac

SEQ ID NO: 1583 - DNA, 66 bp, Unknown
  Bacillus sp. multi
tgaagaaagggaaattgatgataacaccgttgaaatatttaaatacatcttatgttagtactaaac

SEQ ID NO: 1584 - DNA, 65 bp, Unknown
  Bacillus sp. multi
tgaaaagtactagaccaaatcaccgaagatcaagaatttaaatacatcttatattagtactaaac

SEQ ID NO: 1585 - DNA, 65 bp, Unknown; identical to SEQ ID NO: 1577
  Bacillus sp. multi

SEQ ID NO: 1586 - DNA, 65 bp, Unknown
  Bacillus sp. multi
cctttgcatgagttaaattcatgctataatcatgtatttaaatacatcttatgttagtgttaaac

SEQ ID NO: 1587 - DNA, 66 bp, Unknown
  Bacillus sp. multi
catgcattaaagctatgttttgttttaccattagtaatttaaatacatcttgtgttagtgttaaac

SEQ ID NO: 1588 - DNA, 64 bp, Unknown; identical to SEQ ID NO: 1570
  Bacillus sp. multi

SEQ ID NO: 1589 - DNA, 65 bp, Unknown
  Bacillus sp. multi
acattaaaaaacaaatatagtccgtccatgctaaaatttaaatacatcttatgtcagtgttaaac

SEQ ID NO: 1590 - DNA, 66 bp, Unknown
  Bacillus sp. multi
gggcgatttagcaaaagataatgtattagcagctatatttaaatacatcttatgttaatgataaac

SEQ ID NO: 1591 - DNA, 66 bp, Unknown
  Bacillus sp. multi
ttaatattttacttaatgtctgtctccattgtaccaatttaaatacatcctatgttagtgttaaac

SEQ ID NO: 1592 - DNA, 65 bp, Unknown
  Bacillus sp. multi
tttgaaataattcagcatttagaaggcaacatattatttaaatacatcttatgttagtgctaaac

SEQ ID NO: 1593 - DNA, 65 bp, Unknown
  Bacillus sp. multi
acgagggacaaactactgagttactgactagactcatttaaatacatcttatgttagtgttaaac

SEQ ID NO: 1594 - DNA, 65 bp, Unknown
  Bacillus sp. multi
tggtaccttagatacaataatagctagagatacaaatttaaatacatcttatgttaatactaaac

SEQ ID NO: 1595 - DNA, 65 bp, Unknown
  Bacillus sp. multi
gataaggtagctatggaatatatacgcgcttatatatttaaatacatcttatgttagtgttaaac

SEQ ID NO: 1596 - DNA, 64 bp, Unknown; identical to SEQ ID NO: 1579
  Bacillus sp. multi

SEQ ID NO: 1597 - DNA, 67 bp, Unknown
  Bacillus sp. multi
aaattaatctacaaaaacattttgcgcactctccccaatttaaatacatcttatgttagtactaaac

SEQ ID NO: 1598 - DNA, 64 bp, Unknown
  Bacillus sp. multi
acgttatgacggacgaaattgtttattctgctagatttaaatacatcttatgttagtgttaaac

SEQ ID NO: 1599 - DNA, 65 bp, Unknown; identical to SEQ ID NO: 1563
  Bacillus sp. multi

SEQ ID NO: 1600 - DNA, 64 bp, Unknown
  Bacillus sp. multi
aaattactgaaatctatacaaaatatgtagcgctatttaaatacatcttatgttagtgttaaac

SEQ ID NO: 1601 - DNA, 64 bp, Unknown; identical to SEQ ID NO: 1600
  Bacillus sp. multi

SEQ ID NO: 1602 - DNA, 64 bp, Unknown; identical to SEQ ID NO: 1598
  Bacillus sp. multi

SEQ ID NO: 1603 - DNA, 65 bp, Unknown; identical to SEQ ID NO: 1594
  Bacillus sp. multi

SEQ ID NO: 1604 - DNA, 64 bp, Unknown; identical to SEQ ID NO: 1598
  Bacillus sp. multi

SEQ ID NO: 1605 - DNA, 64 bp, Unknown
  Bacillus sp. multi
aaagaccttatcatcgttaggattaagctcaattatttaaatacatcttgtgttagtactaaac

SEQ ID NO: 1606 - DNA, 66 bp, Unknown; identical to SEQ ID NO: 1591
  Bacillus sp. multi

SEQ ID NO: 1607 - DNA, 67 bp, Unknown; identical to SEQ ID NO: 1582
  Bacillus sp. multi

SEQ ID NO: 1608 - DNA, 65 bp, Unknown; identical to SEQ ID NO: 1563
  Bacillus sp. multi

SEQ ID NO: 1609 - DNA, 65 bp, Unknown; identical to SEQ ID NO: 1592
  Bacillus sp. multi

SEQ ID NO: 1610 - DNA, 67 bp, Unknown; identical to SEQ ID NO: 1582
  Bacillus sp. multi

SEQ ID NO: 1611 - DNA, 65 bp, Unknown; identical to SEQ ID NO: 1592
  Bacillus sp. multi

SEQ ID NO: 1612 - DNA, 67 bp, Unknown; identical to SEQ ID NO: 1582
  Bacillus sp. multi

SEQ ID NO: 1613 - DNA, 67 bp, Paenibacillus sp. novel; identical to SEQ ID NO: 1582

SEQ ID NO: 1614 - DNA, 67 bp, Bacillus thuringiensis
aaattaatctacaaaaacactttgcgcactctccccaatttaaatacatcttatgttagtactaaac

SEQ ID NO: 1615 - DNA, 67 bp, Unknown; identical to SEQ ID NO: 1614
  Bacillus sp. multi

SEQ ID NO: 1616 - DNA, 67 bp, Unknown; identical to SEQ ID NO: 1614
  Bacillus sp. multi

SEQ ID NO: 1617 - DNA, 67 bp, Unknown; identical to SEQ ID NO: 1614
  Bacillus sp. multi

SEQ ID NO: 1618 - DNA, 66 bp, Unknown
  Bacillus sp. multi
aacaaaatttcgtattattgtggtaaaatatgcatgatctaaatacatcttatgttcatactaaac

SEQ ID NO: 1619 - DNA, 65 bp, Unknown; identical to SEQ ID NO: 1563
  Bacillus sp. multi

SEQ ID NO: 1620 - DNA, 67 bp, Unknown; identical to SEQ ID NO: 1614
  Bacillus sp. multi

SEQ ID NO: 1621 - DNA, 67 bp, Unknown; identical to SEQ ID NO: 1582
  Bacillus sp. multi

SEQ ID NO: 1622 - DNA, 67 bp, Unknown
  Bacillus sp. multi
gcctgaagtcaactttacataagtactgcatcatgctatttcaatacatctattgttatgtttaaac

SEQ ID NO: 1623 - DNA, 66 bp, Unknown
  Bacillus sp. multi
agggaaaagaaaaattaccatcagccgaatttcaatacatctattgttatgttttaactaacgaac

SEQ ID NO: 1624 - DNA, 66 bp, Unknown
  Bacillus sp. multi
taacgaacgtactagattattaatttcgaggtacctatttcaatacatctattgttatgttttaac

SEQ ID NO: 1625 - DNA, 66 bp, Unknown; identical to SEQ ID NO: 1624
  Bacillus sp. multi

SEQ ID NO: 1626 - DNA, 66 bp, Unknown
  Bacillus sp. multi
taaaacagacgatgcaaaacgttattataacgaaacatttcaatacatctattgttatttttttac

SEQ ID NO: 1627 - DNA, 65 bp, Unknown
  Bacillus sp. multi
ttagtttaggggtgctttcttcatacatttcaacatttcaatacatctattgttttgttttaacc

SEQ ID NO: 1628 - DNA, 64 bp, Unknown
  Bacillus sp. multi
aataaaagtgttttagaaaggccgcccacttgaatttcaatacatctattgttatgtcttaacc

SEQ ID NO: 1629 - DNA, 65 bp, Unknown
  Bacillus sp. multi
cttagtttaggggtgctttcttcatacatttcaacatttcaatacatctattgttttgttttaac

SEQ ID NO: 1630 - DNA, 65 bp, Unknown; identical to SEQ ID NO: 1627
  Bacillus sp. multi

SEQ ID NO: 1631 - DNA, 65 bp, Unknown
  Bacillus sp. multi
gatatgacaataggtgattgcttggattatatcgaatttcaatacatctattgttatgttttaac

SEQ ID NO: 1632 - DNA, 65 bp, Unknown
  Bacillus sp. multi
taaatagagggtcctaaccgacttattaataagtatttcaatacatctattattatgttttacct

SEQ ID NO: 1633 - DNA, 67 bp, Bacillus thuringiensis
tgggtttaactcctggaaaggttcaaaaatctttaaaatttcaatacatctattgttatgttttaac

SEQ ID NO: 1634 - DNA, 66 bp, Unknown
  Bacillus sp. multi
ttgctttcgtagaccagtgatttgctggaacatcaatttcaatacatctattgttatgttttaacc

SEQ ID NO: 1635 - DNA, 67 bp, Unknown
  Bacillus sp. multi
tcaccgtgcttattggtgattttattattcaacgaatatttcaatacatctatttttatgttttaac

SEQ ID NO: 1636 - DNA, 67 bp, Unknown; identical to SEQ ID NO: 1633
  Bacillus sp. multi

SEQ ID NO: 1637 - DNA, 64 bp, Unknown
  Bacillus sp. multi
tagcgccataccaggagtgccaggacattattgtatttcaatacatctattgttatgttttaac

SEQ ID NO: 1638 - DNA, 66 bp, Unknown
  Bacillus sp. multi
gcgttaggatcgtcccctatagaatctttaagttcaatttcaatacatctattgttatgttttaac

SEQ ID NO: 1639 - DNA, 64 bp, Unknown
  Bacillus sp. multi
caataaaagtgttttagaaaggccgcccacttgaatttcaatacatctattgttatgtcttaac

SEQ ID NO: 1640 - DNA, 67 bp, Unknown; identical to SEQ ID NO: 1633
  Bacillus sp. multi

SEQ ID NO: 1641 - DNA, 66 bp, Unknown
  Bacillus sp. multi
ttctctaccttttttaaaagtatattctgggctaaaatttcaatacatctattgttatgttttaac

SEQ ID NO: 1642 - DNA, 66 bp, Unknown
  Bacillus sp. multi
tcacttaattttgctagatttagattggatgcaattatttcaatacatctattgttaggttttaac

SEQ ID NO: 1643 - DNA, 67 bp, Unknown; identical to SEQ ID NO: 1633
  Bacillus sp. multi

SEQ ID NO: 1644 - DNA, 66 bp, Unknown
  Bacillus sp. multi
caacaacacatcgaaagctattcaaatgcatgttgaatttcaatacatctattgttatgttttaac

SEQ ID NO: 1645 - DNA, 66 bp, Unknown
  Bacillus sp. multi
tgacggttcagatgtataccgggttcgtgtagaaggatttcaatacatctattgttatgttttaac

SEQ ID NO: 1646 - DNA, 67 bp, Unknown
  Bacillus sp. multi
tcaccgtgcttattggtgagtttattattcaacgaatatttcaatacatctattgttatgttttaac

SEQ ID NO: 1647 - DNA, 65 bp, Unknown
  Bacillus sp. multi
gtttgttaaaaggaaaagtttcaactatatttcaatacatctattgttatgtttaaccaacgaac

SEQ ID NO: 1648 - DNA, 67 bp, Unknown
  Bacillus sp. multi
tcaccatgcttattggtgattttattattcaacgaatatttcaatacatctattgttatgttttaac

SEQ ID NO: 1649 - DNA, 66 bp, Unknown
  Bacillus sp. multi
aggttatcgttttggagactataaaccaaccgttatgatttcaatacatctattattatgttttac

SEQ ID NO: 1650 - DNA, 67 bp, Unknown
  Bacillus sp. multi
gggttatcgttttggagactataaaccaaccgttatgatttcaatacatctattattatgttttacc

SEQ ID NO: 1651 - DNA, 67 bp, Unknown
  Bacillus sp. multi
aggttatcgttttggagactataaaccaaccgttatgatttcaatacatctattattatgttttacc

SEQ ID NO: 1652 - DNA, 67 bp, Unknown; identical to SEQ ID NO: 1646
  Bacillus sp. multi

SEQ ID NO: 1653 - DNA, 67 bp, Unknown
  Bacillus sp. multi
attcgccttatatgtatgaagagacagttataacaagatttcaatacatctattgttttgtttaaac

SEQ ID NO: 1654 - DNA, 65 bp, Unknown
  Bacillus sp. multi
ttaaatatatttcatcaataagagtaggcggagatatttcaatacatctattgttatgttttaac

SEQ ID NO: 1655 - DNA, 66 bp, Unknown
  Bacillus sp. multi
cagtagatcgttaagtattacgaggacttataagacatttcaatacatctattgttatatttaaac

SEQ ID NO: 1656 - DNA, 65 bp, Unknown
  Bacillus sp. multi
gaaggaagctcgtgctgtatgtatccattcataatatttcaatacatctattgttatgttttaac

SEQ ID NO: 1657 - DNA, 66 bp, Unknown; identical to SEQ ID NO: 1644
  Bacillus sp. multi

SEQ ID NO: 1658 - DNA, 65 bp, Unknown; identical to SEQ ID NO: 1632
  Bacillus sp. multi

SEQ ID NO: 1659 - DNA, 66 bp, Unknown; identical to SEQ ID NO: 1638
  Bacillus sp. multi

SEQ ID NO: 1660 - DNA, 67 bp, Unknown; identical to SEQ ID NO: 1633
  Bacillus sp. multi

SEQ ID NO: 1661 - DNA, 65 bp, Unknown; identical to SEQ ID NO: 1656
  Bacillus sp. multi

SEQ ID NO: 1662 - DNA, 66 bp, Unknown
  Bacillus sp. multi
tcccaatattcagtcgtgttgttatcagacaattatatttcaatacatctattgttatgttttaac

SEQ ID NO: 1663 - DNA, 67 bp, Unknown
  Bacillus sp. multi
tgtgtttaactcctggataggttcaaaaatctttaaaatttcaatacatctattgttatgttttaac

SEQ ID NO: 1664 - DNA, 64 bp, Unknown
  Bacillus sp. multi
agcgccataccaggagtgccagggcattattgtatttcaatacatctattgttatgttttaact

SEQ ID NO: 1665 - DNA, 66 bp, Unknown
  Bacillus sp. multi
gtatcccccacctagtaaaaaggttcctggatattcatttcaatacatctattgttatgtttaaac

SEQ ID NO: 1666 - DNA, 67 bp, Unknown
  Bacillus sp. multi
gatatgtgacgtatcaggtattaagaagaccttctaaatttcaatacatctattgtttggtttgaac

SEQ ID NO: 1667 - DNA, 67 bp, Bacillus megaterium
ctataagccaagatctttatgagtgggcggatccaatttcaatccttacacccatgtagggtgtgac

SEQ ID NO: 1668 - DNA, 65 bp, Unknown
  Bacillus sp. multi
aaacttttttctgtaatacgcttaatcctcgtttcaatttacattccacatagttgatatcaaat

SEQ ID NO: 1669 - DNA, 64 bp, Unknown
  Bacillus sp. multi
aaagttgatgcggaaatcatccagcgttggggcgaatttacattccatataggtgatatcaaac

SEQ ID NO: 1670 - DNA, 64 bp, Unknown; identical to SEQ ID NO: 1669
  Bacillus sp. multi

SEQ ID NO: 1671 - DNA, 67 bp, Unknown
  Paenibacillus thiaminolyticus (multi)
acactgaaggacggaacaactatgacggtctatgagtcgcatcctacgcggatgcgtggattgaaat

SEQ ID NO: 1672 - DNA, 67 bp, Unknown
  Paenibacillus thiaminolyticus (multi)
tatgtcaatcggaagatgtgatatgttatttataagtcgcatcctacgcggatgcgtggattgaaat

SEQ ID NO: 1673 - DNA, 66 bp, Unknown
  Paenibacillus sp. multi
gtacacccgagctaacgcggaaccattactactggtcgcatcctacgcggatgcgtggattgaaat

SEQ ID NO: 1674 - DNA, 70 bp, Unknown
  Paenibacillus sp. multi
aagatagagtagctcttttcgaggaacatagtaaacatgtcgcatcctatgcggatgcgtggattgaaat

SEQ ID NO: 1675 - DNA, 66 bp, Unknown
  Paenibacillus lentimorbus (multi)
tctaacgcccaatccctccctatttttcttgccagtcgcatcctacgcggatgcgtggattgaaat

SEQ ID NO: 1676 - DNA, 65 bp, Unknown
  Paenibacillus lentimorbus (multi)
cagtcggtcgtgaatcgtttcatgccgaccaccgtcgcatcctacgcggatgcgtggactgaaat

SEQ ID NO: 1677 - DNA, 68 bp, Unknown
  Paenibacillus thiaminolyticus (multi)
tgtggtaaaatggtattaacaagtatatcggaggtggtcgcatcctacgcggatgcgtggattgaaat

SEQ ID NO: 1678 - DNA, 65 bp, Unknown
  Paenibacillus thiaminolyticus (multi)
atatttggcagaaagaaatggagcaccagactagtcgcatcctacgcggatgcgtggattgaaat

SEQ ID NO: 1679 - DNA, 65 bp, Unknown
  Paenibacillus thiaminolyticus (multi)
cttacattccacggacaaactcccaccgctcgcgtcgcatcctacgcggatgcgtggattgaaat

SEQ ID NO: 1680 - DNA, 65 bp, Unknown
  Paenibacillus thiaminolyticus (multi)
gtctatgtgggccggttcaacgcggcacacatcgtcgcatcctacacggatgcgtggattgaaat

SEQ ID NO: 1681 - DNA, 67 bp, Unknown
  Paenibacillus thiaminolyticus (multi)
gcatcgaggacaccacatagttatatctctcatttgtcgcatcctacgtggatgcgtggattgaaat

SEQ ID NO: 1682 - DNA, 66 bp, Paenibacillus terrae
caacgcacggagcgaacgattatcgaaatcctcagtcgcatcctacgcggatgcgtggattgaaat

SEQ ID NO: 1683 - DNA, 66 bp, Unknown
  Paenibacillus thiaminolyticus (multi)
gccttacctccgcccgcgacaataacgatcttttgtcgcatcctacgcggatgcgtggattgaaat

SEQ ID NO: 1684 - DNA, 66 bp, Unknown
  Paenibacillus thiaminolyticus (multi)
cggtagggcttcccatccatttcaacctcgaagagtcgcatcctatgcggatgcgtggattgaaat

SEQ ID NO: 1685 - DNA, 66 bp, Unknown
  Paenibacillus thiaminolyticus (multi)
taagctgattggctaccccattctcacatgcttgtcgcatcctatgtggatgcgtggattgaaatt

SEQ ID NO: 1686 - DNA, 65 bp, Unknown
  Bacillus sp. multi
ttgcagccgttttagaactaaattacaagtgctaacattcacattctacatagtgtttataaaac

SEQ ID NO: 1687 - DNA, 65 bp, Unknown
  Bacillus sp. multi
ataatttcgagttatgcacaagaattcagctatattattcacattctacatagttcatttaaaac

SEQ ID NO: 1688 - DNA, 61 bp, Unknown
  Streptomyces sp. multi
cattcttgagccccaccccctgagtcaatgccaaggggtcatccccgcgtgcgcggggagc

SEQ ID NO: 1689 - DNA, 66 bp, Unknown
  Bacillus sp. multi
ccacattgcattccattcgaagtcggatgtgaccatatcataacgatggttcttttggaactatag

SEQ ID NO: 1690 - DNA, 66 bp, Unknown
  Bacillus sp. multi
caaacttactaactgcattaagtagtaaagatcctagcatagcgatatttcttatggaactatagc

SEQ ID NO: 1691 - DNA, 66 bp, Unknown
  Bacillus sp. multi
ttttatgctcatcgcataattcaagatgaaaaggcggtttaataccaacataagatgtatttaaat

SEQ ID NO: 1692 - DNA, 65 bp, Unknown
  Bacillus sp. multi
cgaacatttgaagtgaatcaattattagcagaagcgaattctaacaatacatattgtatttaaaa

SEQ ID NO: 1693 - DNA, 65 bp, Unknown; identical to SEQ ID NO: 1692
  Bacillus sp. multi

SEQ ID NO: 1694 - DNA, 65 bp, Unknown
  Bacillus sp. multi
cgaacgatattaacaaccattttgtagaaaaggggaaattctaaccatacatattagatttaaaa

SEQ ID NO: 1695 - DNA, 57 bp, Unknown
  Lysinibacillus sp. multi
agaattacaattttttcctgaatgtgagattcaaaaagaataataaagttgtaacct

SEQ ID NO: 1696 - DNA, 61 bp, Unknown
  Streptomyces sp. multi
tacggcgggtccggtacggtgcgggggcgaggttcatatccgtcccgcaggcgcgggtatc

SEQ ID NO: 1697 - DNA, 67 bp, Unknown; identical to SEQ ID NO: 1646
  Bacillus sp. multi

SEQ ID NO: 1698 - DNA, 67 bp, Unknown; identical to SEQ ID NO: 1646
  Bacillus sp. multi

SEQ ID NO: 1699 - DNA, 66 bp, Unknown
  Bacillus sp. multi
aatccacatagcatacggtgtcatataatgacttaaatttcaatacatctattgttatgttttaac

SEQ ID NO: 1700 - DNA, 66 bp, Unknown
  Bacillus sp. multi
aacaaaaacgttaaaagctttatctccttttatggaatttcaatacatctattgttatgttttaac

SEQ ID NO: 1701 - DNA, 66 bp, Unknown
  Bacillus sp. multi
tgacggttcagatgtaaaccgggttcgtgtagaaggatttcaatacatctattgttatgttttaac

SEQ ID NO: 1702 - DNA, 65 bp, Unknown; identical to SEQ ID NO: 1631
  Bacillus sp. multi

SEQ ID NO: 1703 - DNA, 67 bp, Unknown; identical to SEQ ID NO: 1635
  Bacillus sp. multi

SEQ ID NO: 1704 - DNA, 69 bp, Unknown
  Paenibacillus thiaminolyticus (multi)
cggaagaacaaccaggagcgcgagctgcagcttcgccgtcgcatcctacgcggatgcgtggattgaaat

SEQ ID NO: 1705 - DNA, 66 bp, Unknown
  Paenibacillus lentimorbus (multi)
tgcattggaagtagcgtataggacaacaccctccgtcgcatcctacacggatgcgtggattgaaat

SEQ ID NO: 1706 - DNA, 65 bp, Unknown
  Paenibacillus thiaminolyticus (multi)
cataatcgatgattgcgttggccggcacagcgcgtcgcatcctacgcggatgcgtggattgaaat

SEQ ID NO: 1707 - DNA, 48 bp, Unknown
  Stenotrophomonas sp. multi
acgaccagccaccccgcacaatccagtagatccacgccatgcgtggat

SEQ ID NO: 1708 - DNA, 66 bp, Unknown
  Bacillus sp. multi
tatctacgtattcttgatatcttcctaaattaaaacgtttaacattaacataagatgtatttaaat

SEQ ID NO: 1709 - DNA, 66 bp, Unknown; identical to SEQ ID NO: 1708
  Bacillus sp. multi

SEQ ID NO: 1710 - DNA, 66 bp, Unknown
  Bacillus sp. multi
ttcaacggtgttatcatcaatttctctttcttcagtttaacattaacataagatgtatttaaatat

SEQ ID NO: 1711 - DNA, 65 bp, Unknown
  Bacillus sp. multi
gagtctagtcagtaactcagtagtttgtccctcgtgtttagtactaacacaagatgtatttaaat

SEQ ID NO: 1712 - DNA, 65 bp, Unknown; identical to SEQ ID NO: 1711
  Bacillus sp. multi

SEQ ID NO: 1713 - DNA, 65 bp, Unknown; identical to SEQ ID NO: 1711
  Bacillus sp. multi

SEQ ID NO: 1714 - DNA, 65 bp, Unknown
  Bacillus sp. multi
tcgtgtatgtaatcaccatcaatatcccgatattcgtttaccagtaacataagatgtatttaaat

SEQ ID NO: 1715 - DNA, 65 bp, Unknown; identical to SEQ ID NO: 1711
  Bacillus sp. multi

SEQ ID NO: 1716 - DNA, 65 bp, Unknown
  Bacillus sp. multi
attcgttgaataataaaatcattaacaagcacggtgtttaacactaacataagatgtatttaaat

SEQ ID NO: 1717 - DNA, 64 bp, Unknown
  Bacillus sp. multi
cctcaaaagaatcttattttaaaaaatccatagcgtttaacattaatataagatgtatttaaat

SEQ ID NO: 1718 - DNA, 64 bp, Unknown
  Bacillus sp. multi
aattgagcttaatcctaacgatgataaggtctttgtttaacattaacataagatgtatttaaat

SEQ ID NO: 1719 - DNA, 65 bp, Bacillus thuringiensis
tcgtgtatgtaatcaccatcaatatcccgatattcgtttaacatcaacataagatgtatttaaat

SEQ ID NO: 1720 - DNA, 67 bp, Unknown
  Bacillus sp. multi
cgtttaatgtgtaatttctatatcaaagaaggactttgtttaccattagcataagatgtatttaaat

SEQ ID NO: 1721 - DNA, 67 bp, Unknown
  Bacillus sp. multi
ggtgtcattttaccatttaaggataagtttcctaaaagtttagtactaacataagatgtatttaaat

SEQ ID NO: 1722 - DNA, 65 bp, Unknown; identical to SEQ ID NO: 1711
  Bacillus sp. multi

SEQ ID NO: 1723 - DNA, 64 bp, Unknown; identical to SEQ ID NO: 1717
  Bacillus sp. multi

SEQ ID NO: 1724 - DNA, 64 bp, Unknown; identical to SEQ ID NO: 1717
  Bacillus sp. multi

SEQ ID NO: 1725 - DNA, 65 bp, Unknown
  Bacillus sp. multi
gggacacttttccataattccaatattccatgaaagtttaacactaacataagatgtatttaaat

SEQ ID NO: 1726 - DNA, 65 bp, Unknown; identical to SEQ ID NO: 1725
  Bacillus sp. multi

SEQ ID NO: 1727 - DNA, 64 bp, Unknown
  Bacillus sp. multi
ccttcctagttaatgatgtaggagaaaaagtcctgtttaacatcaacataagatgtatttaaat

SEQ ID NO: 1728 - DNA, 65 bp, Unknown; identical to SEQ ID NO: 1711
  Bacillus sp. multi

SEQ ID NO: 1729 - DNA, 65 bp, Unknown; identical to SEQ ID NO: 1725
  Bacillus sp. multi

SEQ ID NO: 1730 - DNA, 67 bp, Unknown
  Bacillus sp. multi
ggtgtcattttaccatttaaggataagttccctaaaagtttagtactaacataagatgtatttaaat

SEQ ID NO: 1731 - DNA, 66 bp, Unknown
  Bacillus sp. multi
atttcaacggtgttatcatcaatttccctttcttcagtttagtactaacataagatgtatttaaat

SEQ ID NO: 1732 - DNA, 65 bp, Unknown
  Bacillus sp. multi
tcttgatcttcggtgatttggtctagtacttttcagtttagtactaatataagatgtatttaaat

SEQ ID NO: 1733 - DNA, 65 bp, Unknown; identical to SEQ ID NO: 1725
  Bacillus sp. multi

SEQ ID NO: 1734 - DNA, 65 bp, Unknown
  Bacillus sp. multi
acatgattatagcatgaatttaactcatgcaaagggtttaacactaacataagatgtatttaaat

SEQ ID NO: 1735 - DNA, 66 bp, Unknown
  Bacillus sp. multi
tactaatggtaaaacaaaacatagctttaatgcatggtttaacactaacacaagatgtatttaaat

SEQ ID NO: 1736 - DNA, 64 bp, Unknown; identical to SEQ ID NO: 1718
  Bacillus sp. multi

SEQ ID NO: 1737 - DNA, 65 bp, Unknown
  Bacillus sp. multi
tttagcatggacggactatatttgttttttaatgtgtttaacactgacataagatgtatttaaat

SEQ ID NO: 1738 - DNA, 66 bp, Unknown
  Bacillus sp. multi
atagctgctaatacattatcttttgctaaatcgcccgtttatcattaacataagatgtatttaaat

SEQ ID NO: 1739 - DNA, 66 bp, Unknown
  Bacillus sp. multi
tggtacaatggagacagacattaagtaaaatattaagtttaacactaacataggatgtatttaaat

SEQ ID NO: 1740 - DNA, 65 bp, Unknown
  Bacillus sp. multi
aatatgttgccttctaaatgctgaattatttcaaagtttagcactaacataagatgtatttaaat

SEQ ID NO: 1741 - DNA, 65 bp, Unknown
  Bacillus sp. multi
gagtctagtcagtaactcagtagtttgtccctcgtgtttaacactaacataagatgtatttaaat

SEQ ID NO: 1742 - DNA, 65 bp, Unknown
  Bacillus sp. multi
ttgtatctctagctattattgtatctaaggtaccagtttagtattaacataagatgtatttaaat

SEQ ID NO: 1743 - DNA, 65 bp, Unknown
  Bacillus sp. multi
atataagcgcgtatatattccatagctaccttatcgtttaacactaacataagatgtatttaaat

SEQ ID NO: 1744 - DNA, 64 bp, Unknown; identical to SEQ ID NO: 1727
  Bacillus sp. multi

SEQ ID NO: 1745 - DNA, 67 bp, Unknown
  Bacillus sp. multi
tggggagagtgcgcaaaatgtttttgtagattaatttgtttagtactaacataagatgtatttaaat

SEQ ID NO: 1746 - DNA, 64 bp, Unknown
  Bacillus sp. multi
ctagcagaataaacaatttcgtccgtcataacgtgtttaacactaacataagatgtatttaaat

SEQ ID NO: 1747 - DNA, 65 bp, Unknown; identical to SEQ ID NO: 1711
  Bacillus sp. multi

SEQ ID NO: 1748 - DNA, 64 bp, Unknown
  Bacillus sp. multi
agcgctacatattttgtatagatttcagtaatttgtttaacactaacataagatgtatttaaat

SEQ ID NO: 1749 - DNA, 64 bp, Unknown; identical to SEQ ID NO: 1748
  Bacillus sp. multi

SEQ ID NO: 1750 - DNA, 64 bp, Unknown
  Bacillus sp. multi
tagcagaataaacaatttcgtccgtcataacgtgtttaacactaacataagatgtatttaaatc

SEQ ID NO: 1751 - DNA, 65 bp, Unknown; identical to SEQ ID NO: 1742
  Bacillus sp. multi

SEQ ID NO: 1752 - DNA, 64 bp, Unknown; identical to SEQ ID NO: 1746
  Bacillus sp. multi

SEQ ID NO: 1753 - DNA, 64 bp, Unknown
  Bacillus sp. multi
aattgagcttaatcctaacgatgataaggtctttgtttagtactaacacaagatgtatttaaat

SEQ ID NO: 1754 - DNA, 66 bp, Unknown; identical to SEQ ID NO: 1739
  Bacillus sp. multi

SEQ ID NO: 1755 - DNA, 67 bp, Unknown; identical to SEQ ID NO: 1730
  Bacillus sp. multi

SEQ ID NO: 1756 - DNA, 65 bp, Unknown; identical to SEQ ID NO: 1711
  Bacillus sp. multi

SEQ ID NO: 1757 - DNA, 65 bp, Unknown; identical to SEQ ID NO: 1740
  Bacillus sp. multi

SEQ ID NO: 1758 - DNA, 67 bp, Unknown; identical to SEQ ID NO: 1730
  Bacillus sp. multi

SEQ ID NO: 1759 - DNA, 65 bp, Unknown; identical to SEQ ID NO: 1740
  Bacillus sp. multi

SEQ ID NO: 1760 - DNA, 67 bp, Unknown; identical to SEQ ID NO: 1730
  Bacillus sp. multi

SEQ ID NO: 1761 - DNA, 67 bp, Paenibacillus sp. novel; identical to SEQ ID NO: 1730

SEQ ID NO: 1762 - DNA, 67 bp, Bacillus thuringiensis
tggggagagtgcgcaaagtgtttttgtagattaatttgtttagtactaacataagatgtatttaaat

SEQ ID NO: 1763 - DNA, 67 bp, Unknown; identical to SEQ ID NO: 1762
  Bacillus sp. multi

SEQ ID NO: 1764 - DNA, 67 bp, Unknown; identical to SEQ ID NO: 1762
  Bacillus sp. multi

SEQ ID NO: 1765 - DNA, 67 bp, Unknown; identical to SEQ ID NO: 1762
  Bacillus sp. multi

SEQ ID NO: 1766 - DNA, 66 bp, Unknown
  Bacillus sp. multi
catgcatattttaccacaataatacgaaattttgttgtttagtatgaacataagatgtatttagat

SEQ ID NO: 1767 - DNA, 65 bp, Unknown; identical to SEQ ID NO: 1711
  Bacillus sp. multi

SEQ ID NO: 1768 - DNA, 67 bp, Unknown; identical to SEQ ID NO: 1762
  Bacillus sp. multi

SEQ ID NO: 1769 - DNA, 67 bp, Unknown; identical to SEQ ID NO: 1730
  Bacillus sp. multi

SEQ ID NO: 1770 - DNA, 67 bp, Unknown
  Bacillus sp. multi
agcatgatgcagtacttatgtaaagttgacttcaggcgtttaaacataacaatagatgtattgaaat

SEQ ID NO: 1771 - DNA, 66 bp, Unknown
  Bacillus sp. multi
tcggctgatggtaatttttcttttccctgttcgttagttaaaacataacaatagatgtattgaaat

SEQ ID NO: 1772 - DNA, 66 bp, Unknown
  Bacillus sp. multi
aggtacctcgaaattaataatctagtacgttcgttagttaaaacataacaatagatgtattgaaat

SEQ ID NO: 1773 - DNA, 66 bp, Unknown; identical to SEQ ID NO: 1772
  Bacillus sp. multi

SEQ ID NO: 1774 - DNA, 66 bp, Unknown
  Bacillus sp. multi
gtttcgttataataacgttttgcatcgtctgttttagtaaaaaaataacaatagatgtattgaaat

SEQ ID NO: 1775 - DNA, 65 bp, Unknown
  Bacillus sp. multi
gttgaaatgtatgaagaaagcacccctaaactaaggttaaaacaaaacaatagatgtattgaaat

SEQ ID NO: 1776 - DNA, 64 bp, Unknown
  Bacillus sp. multi
tcaagtgggcggcctttctaaaacacttttattggttaagacataacaatagatgtattgaaat

SEQ ID NO: 1777 - DNA, 65 bp, Unknown; identical to SEQ ID NO: 1775
  Bacillus sp. multi

SEQ ID NO: 1778 - DNA, 65 bp, Unknown; identical to SEQ ID NO: 1775
  Bacillus sp. multi

SEQ ID NO: 1779 - DNA, 65 bp, Unknown
  Bacillus sp. multi
tcgatataatccaagcaatcacctattgtcatatcgttaaaacataacaatagatgtattgaaat

SEQ ID NO: 1780 - DNA, 65 bp, Unknown
  Bacillus sp. multi
acttattaataagtcggttaggaccctctatttaaggtaaaacataataatagatgtattgaaat

SEQ ID NO: 1781 - DNA, 67 bp, Bacillus thuringiensis
tttaaagatttttgaacctttccaggagttaaacccagttaaaacataacaatagatgtattgaaat

SEQ ID NO: 1782 - DNA, 66 bp, Unknown
  Bacillus sp. multi
tgatgttccagcaaatcactggtctacgaaagcaaggttaaaacataacaatagatgtattgaaat

SEQ ID NO: 1783 - DNA, 67 bp, Unknown
  Bacillus sp. multi
attcgttgaataataaaatcaccaataagcacggtgagttaaaacataaaaatagatgtattgaaat

SEQ ID NO: 1784 - DNA, 67 bp, Unknown; identical to SEQ ID NO: 1781
  Bacillus sp. multi

SEQ ID NO: 1785 - DNA, 64 bp, Unknown
  Bacillus sp. multi
acaataatgtcctggcactcctggtatggcgctagttaaaacataacaatagatgtattgaaat

SEQ ID NO: 1786 - DNA, 66 bp, Unknown
  Bacillus sp. multi
gaacttaaagattctataggggacgatcctaacgcgttaaaacataacaatagatgtattgaaatt

SEQ ID NO: 1787 - DNA, 64 bp, Unknown; identical to SEQ ID NO: 1776
  Bacillus sp. multi

SEQ ID NO: 1788 - DNA, 67 bp, Unknown; identical to SEQ ID NO: 1781
  Bacillus sp. multi

SEQ ID NO: 1789 - DNA, 66 bp, Unknown
  Bacillus sp. multi
tttagcccagaatatacttttaaaaaaggtagagaagttaaaacataacaatagatgtattgaaat

SEQ ID NO: 1790 - DNA, 66 bp, Unknown
  Bacillus sp. multi
aattgcatccaatctaaatctagcaaaattaagtgagttaaaacctaacaatagatgtattgaaat

SEQ ID NO: 1791 - DNA, 67 bp, Unknown; identical to SEQ ID NO: 1781
  Bacillus sp. multi

SEQ ID NO: 1792 - DNA, 66 bp, Unknown
  Bacillus sp. multi
tcaacatgcatttgaatagctttcgatgtgttgttggttaaaacataacaatagatgtattgaaat

SEQ ID NO: 1793 - DNA, 66 bp, Unknown
  Bacillus sp. multi
ccttctacacgaacccggtatacatctgaaccgtcagttaaaacataacaatagatgtattgaaat

SEQ ID NO: 1794 - DNA, 67 bp, Unknown
  Bacillus sp. multi
attcgttgaataataaactcaccaataagcacggtgagttaaaacataacaatagatgtattgaaat

SEQ ID NO: 1795 - DNA, 65 bp, Unknown
  Bacillus sp. multi
gaaatatagttgaaacttttccttttaacaaacgttcgttggttaaacataacaatagatgtatt

SEQ ID NO: 1796 - DNA, 67 bp, Unknown
  Bacillus sp. multi
attcgttgaataataaaatcaccaataagcatggtgagttaaaacataacaatagatgtattgaaat

SEQ ID NO: 1797 - DNA, 66 bp, Unknown
  Bacillus sp. multi
cataacggttggtttatagtctccaaaacgataacctgtaaaacataataatagatgtattgaaat

SEQ ID NO: 1798 - DNA, 67 bp, Unknown
  Bacillus sp. multi
cataacggttggtttatagtctccaaaacgataacccggtaaaacataataatagatgtattgaaat

SEQ ID NO: 1799 - DNA, 67 bp, Unknown
  Bacillus sp. multi
cataacggttggtttatagtctccaaaacgataacctggtaaaacataataatagatgtattgaaat

SEQ ID NO: 1800 - DNA, 67 bp, Unknown; identical to SEQ ID NO: 1794
  Bacillus sp. multi

SEQ ID NO: 1801 - DNA, 67 bp, Unknown
  Bacillus sp. multi
cttgttataactgtctcttcatacatataaggcgaatgtttaaacaaaacaatagatgtattgaaat

SEQ ID NO: 1802 - DNA, 65 bp, Unknown
  Bacillus sp. multi
atctccgcctactcttattgatgaaatatatttaagttaaaacataacaatagatgtattgaaat

SEQ ID NO: 1803 - DNA, 66 bp, Unknown
  Bacillus sp. multi
gtcttataagtcctcgtaatacttaacgatctactggtttaaatataacaatagatgtattgaaat

SEQ ID NO: 1804 - DNA, 65 bp, Unknown
  Bacillus sp. multi
attatgaatggatacatacagcacgagcttccttcgttaaaacataacaatagatgtattgaaat

SEQ ID NO: 1805 - DNA, 66 bp, Unknown; identical to SEQ ID NO: 1792
  Bacillus sp. multi

SEQ ID NO: 1806 - DNA, 65 bp, Unknown; identical to SEQ ID NO: 1780
  Bacillus sp. multi

SEQ ID NO: 1807 - DNA, 66 bp, Unknown
  Bacillus sp. multi
tgaacttaaagattctataggggacgatcctaacgcgttaaaacataacaatagatgtattgaaat

SEQ ID NO: 1808 - DNA, 67 bp, Unknown; identical to SEQ ID NO: 1781
  Bacillus sp. multi

SEQ ID NO: 1809 - DNA, 65 bp, Unknown; identical to SEQ ID NO: 1804
  Bacillus sp. multi

SEQ ID NO: 1810 - DNA, 66 bp, Unknown
  Bacillus sp. multi
ataattgtctgataacaacacgactgaatattgggagttaaaacataacaatagatgtattgaaat

SEQ ID NO: 1811 - DNA, 67 bp, Unknown
  Bacillus sp. multi
tttaaagatttttgaacctatccaggagttaaacacagttaaaacataacaatagatgtattgaaat

SEQ ID NO: 1812 - DNA, 64 bp, Unknown
  Bacillus sp. multi
acaataatgccctggcactcctggtatggcgctagttaaaacataacaatagatgtattgaaat

SEQ ID NO: 1813 - DNA, 66 bp, Unknown
  Bacillus sp. multi
gaatatccaggaacctttttactaggtgggggatacgtttaaacataacaatagatgtattgaaat

SEQ ID NO: 1814 - DNA, 67 bp, Unknown
  Bacillus sp. multi
tagaaggtcttcttaatacctgatacgtcacatatcgttcaaaccaaacaatagatgtattgaaatt

SEQ ID NO: 1815 - DNA, 67 bp, Bacillus megaterium
ggatccgcccactcataaagatcttggcttataggtcacaccctacatgggtgtaaggattgaaatt

SEQ ID NO: 1816 - DNA, 65 bp, Unknown
  Bacillus sp. multi
tgaaacgaggattaagcgtattacagaaaaaagtttatttgatatcaactatgtggaatgtaaat

SEQ ID NO: 1817 - DNA, 64 bp, Unknown
  Bacillus sp. multi
tcgccccaacgctggatgatttccgcatcaactttgtttgatatcacctatatggaatgtaaat

SEQ ID NO: 1818 - DNA, 64 bp, Unknown; identical to SEQ ID NO: 1817
  Bacillus sp. multi

SEQ ID NO: 1819 - DNA, 67 bp, Unknown
  Paenibacillus thiaminolyticus (multi)
tcatagaccgtcatagttgttccgtccttcagtgtatttcaatccacgcatccgcgtaggatgcgac

SEQ ID NO: 1820 - DNA, 67 bp, Unknown
  Paenibacillus thiaminolyticus (multi)
ttataaataacatatcacatcttccgattgacataatttcaatccacgcatccgcgtaggatgcgac

SEQ ID NO: 1821 - DNA, 66 bp, Unknown
  Paenibacillus sp. multi
cagtagtaatggttccgcgttagctcgggtgtacatttcaatccacgcatccgcgtaggatgcgac

SEQ ID NO: 1822 - DNA, 70 bp, Unknown
  Paenibacillus sp. multi
atgtttactatgttcctcgaaaagagctactctatcttatttcaatccacgcatccgcataggatgcgac

SEQ ID NO: 1823 - DNA, 66 bp, Unknown
  Paenibacillus lentimorbus (multi)
tggcaagaaaaatagggagggattgggcgttagaatttcaatccacgcatccgcgtaggatgcgac

SEQ ID NO: 1824 - DNA, 65 bp, Unknown
  Paenibacillus lentimorbus (multi)
ggtggtcggcatgaaacgattcacgaccgactgatttcagtccacgcatccgcgtaggatgcgac

SEQ ID NO: 1825 - DNA, 68 bp, Unknown
  Paenibacillus thiaminolyticus (multi)
cacctccgatatacttgttaataccattttaccacaatttcaatccacgcatccgcgtaggatgcgac

SEQ ID NO: 1826 - DNA, 65 bp, Unknown
  Paenibacillus thiaminolyticus (multi)
tagtctggtgctccatttctttctgccaaatatatttcaatccacgcatccgcgtaggatgcgac

SEQ ID NO: 1827 - DNA, 65 bp, Unknown
  Paenibacillus thiaminolyticus (multi)
gcgagcggtgggagtttgtccgtggaatgtaagatttcaatccacgcatccgcgtaggatgcgac

SEQ ID NO: 1828 - DNA, 65 bp, Unknown
  Paenibacillus thiaminolyticus (multi)
gatgtgtgccgcgttgaaccggcccacatagacatttcaatccacgcatccgtgtaggatgcgac

SEQ ID NO: 1829 - DNA, 67 bp, Unknown
  Paenibacillus thiaminolyticus (multi)
aaatgagagatataactatgtggtgtcctcgatgcatttcaatccacgcatccacgtaggatgcgac

SEQ ID NO: 1830 - DNA, 66 bp, Paenibacillus terrae
tgaggatttcgataatcgttcgctccgtgcgttgatttcaatccacgcatccgcgtaggatgcgac

SEQ ID NO: 1831 - DNA, 66 bp, Unknown
  Paenibacillus thiaminolyticus (multi)
aaaagatcgttattgtcgcgggcggaggtaaggcatttcaatccacgcatccgcgtaggatgcgac

SEQ ID NO: 1832 - DNA, 66 bp, Unknown
  Paenibacillus thiaminolyticus (multi)
tcttcgaggttgaaatggatgggaagccctaccgatttcaatccacgcatccgcataggatgcgac

SEQ ID NO: 1833 - DNA, 66 bp, Unknown
  Paenibacillus thiaminolyticus (multi)
aagcatgtgagaatggggtagccaatcagcttaaatttcaatccacgcatccacataggatgcgac

SEQ ID NO: 1834 - DNA, 65 bp, Unknown
  Bacillus sp. multi
gaatgttagcacttgtaatttagttctaaaacggctgcaagttttataaacactatgtagaatgt

SEQ ID NO: 1835 - DNA, 65 bp, Unknown
  Bacillus sp. multi
aatatagctgaattcttgtgcataactcgaaattatgttttaaatgaactatgtagaatgtgaat

SEQ ID NO: 1836 - DNA, 61 bp, Unknown
  Streptomyces sp. multi
ttggcattgactcagggggtggggctcaagaatggctccccgcgcacgcggggatgacccc

SEQ ID NO: 1837 - DNA, 66 bp, Unknown
  Bacillus sp. multi
cacatccgacttcgaatggaatgcaatgtggctatagttccaaaagaaccatcgttatgatatggt

SEQ ID NO: 1838 - DNA, 66 bp, Unknown
  Bacillus sp. multi
tttactacttaatgcagttagtaagtttggctatagttccataagaaatatcgctatgctaggatc

SEQ ID NO: 1839 - DNA, 66 bp, Unknown
  Bacillus sp. multi
ggtattaaaccgccttttcatcttgaattatgcgatgagcataaaaatttaaatacatcttatgtt

SEQ ID NO: 1840 - DNA, 65 bp, Unknown
  Bacillus sp. multi
tcgcttctgctaataattgattcacttcaaatgttcgttttaaatacaatatgtattgttagaat

SEQ ID NO: 1841 - DNA, 65 bp, Unknown; identical to SEQ ID NO: 1840
  Bacillus sp. multi

SEQ ID NO: 1842 - DNA, 65 bp, Unknown
  Bacillus sp. multi
ttccccttttctacaaaatggttgttaatatcgttcgttttaaatctaatatgtatggttagaat

SEQ ID NO: 1843 - DNA, 57 bp, Unknown
  Lysinibacillus sp. multi
ctttttgaatctcacattcaggaaaaaattgtaattctaggttacaactttattatt

SEQ ID NO: 1844 - DNA, 61 bp, Unknown
  Streptomyces sp. multi
atgaacctcgcccccgcaccgtaccggacccgccgtagatacccgcgcctgcgggacggat

SEQ ID NO: 1845 - DNA, 67 bp, Unknown; identical to SEQ ID NO: 1794
  Bacillus sp. multi

SEQ ID NO: 1846 - DNA, 67 bp, Unknown; identical to SEQ ID NO: 1794
  Bacillus sp. multi

SEQ ID NO: 1847 - DNA, 66 bp, Unknown
  Bacillus sp. multi
ttaagtcattatatgacaccgtatgctatgtggattgttaaaacataacaatagatgtattgaaat

SEQ ID NO: 1848 - DNA, 66 bp, Unknown
  Bacillus sp. multi
cataaaaggagataaagcttttaacgtttttgttgttaaaacataacaatagatgtattgaaattc

SEQ ID NO: 1849 - DNA, 66 bp, Unknown
  Bacillus sp. multi
ccttctacacgaacccggtttacatctgaaccgtcagttaaaacataacaatagatgtattgaaat

SEQ ID NO: 1850 - DNA, 65 bp, Unknown; identical to SEQ ID NO: 1779
  Bacillus sp. multi

SEQ ID NO: 1851 - DNA, 67 bp, Unknown; identical to SEQ ID NO: 1783
  Bacillus sp. multi

SEQ ID NO: 1852 - DNA, 69 bp, Unknown
  Paenibacillus thiaminolyticus (multi)
ggcgaagctgcagctcgcgctcctggttgttcttccgatttcaatccacgcatccgcgtaggatgcgac

SEQ ID NO: 1853 - DNA, 66 bp, Unknown
  Paenibacillus lentimorbus (multi)
ggagggtgttgtcctatacgctacttccaatgcaatttcaatccacgcatccgtgtaggatgcgac

SEQ ID NO: 1854 - DNA, 65 bp, Unknown
  Paenibacillus thiaminolyticus (multi)
gcgctgtgccggccaacgcaatcatcgattatgatttcaatccacgcatccgcgtaggatgcgac

SEQ ID NO: 1855 - DNA, 48 bp, Unknown
  Stenotrophomonas sp. multi
ggattgtgcggggtggctggtcgtatccacgcatggcgtggatctact

SEQ ID NO: 1856 - DNA, 66 bp, Unknown
  Bacillus sp. multi
atttaaatacatcttatgttaatgttaaacgttttaatttaggaagatatcaagaatacgtagata

SEQ ID NO: 1857 - DNA, 66 bp, Unknown; identical to SEQ ID NO: 1856
  Bacillus sp. multi

SEQ ID NO: 1858 - DNA, 66 bp, Unknown
  Bacillus sp. multi
atatttaaatacatcttatgttaatgttaaactgaagaaagagaaattgatgataacaccgttgaa

SEQ ID NO: 1859 - DNA, 65 bp, Unknown
  Bacillus sp. multi
atttaaatacatcttgtgttagtactaaacacgagggacaaactactgagttactgactagactc

SEQ ID NO: 1860 - DNA, 65 bp, Unknown; identical to SEQ ID NO: 1859
  Bacillus sp. multi

SEQ ID NO: 1861 - DNA, 65 bp, Unknown; identical to SEQ ID NO: 1859
  Bacillus sp. multi

SEQ ID NO: 1862 - DNA, 65 bp, Unknown
  Bacillus sp. multi
atttaaatacatcttatgttactggtaaacgaatatcgggatattgatggtgattacatacacga

SEQ ID NO: 1863 - DNA, 65 bp, Unknown; identical to SEQ ID NO: 1859
  Bacillus sp. multi

SEQ ID NO: 1864 - DNA, 65 bp, Unknown
  Bacillus sp. multi
atttaaatacatcttatgttagtgttaaacaccgtgcttgttaatgattttattattcaacgaat

SEQ ID NO: 1865 - DNA, 64 bp, Unknown
  Bacillus sp. multi
atttaaatacatcttatattaatgttaaacgctatggattttttaaaataagattcttttgagg

SEQ ID NO: 1866 - DNA, 64 bp, Unknown
  Bacillus sp. multi
atttaaatacatcttatgttaatgttaaacaaagaccttatcatcgttaggattaagctcaatt

SEQ ID NO: 1867 - DNA, 65 bp, Bacillus thuringiensis
atttaaatacatcttatgttgatgttaaacgaatatcgggatattgatggtgattacatacacga

SEQ ID NO: 1868 - DNA, 67 bp, Unknown
  Bacillus sp. multi
atttaaatacatcttatgctaatggtaaacaaagtccttctttgatatagaaattacacattaaacg

SEQ ID NO: 1869 - DNA, 67 bp, Unknown
  Bacillus sp. multi
atttaaatacatcttatgttagtactaaacttttaggaaacttatccttaaatggtaaaatgacacc

SEQ ID NO: 1870 - DNA, 65 bp, Unknown; identical to SEQ ID NO: 1859
  Bacillus sp. multi

SEQ ID NO: 1871 - DNA, 64 bp, Unknown; identical to SEQ ID NO: 1865
  Bacillus sp. multi

SEQ ID NO: 1872 - DNA, 64 bp, Unknown; identical to SEQ ID NO: 1865
  Bacillus sp. multi

SEQ ID NO: 1873 - DNA, 65 bp, Unknown
  Bacillus sp. multi
atttaaatacatcttatgttagtgttaaactttcatggaatattggaattatggaaaagtgtccc

SEQ ID NO: 1874 - DNA, 65 bp, Unknown; identical to SEQ ID NO: 1873
  Bacillus sp. multi

SEQ ID NO: 1875 - DNA, 64 bp, Unknown
  Bacillus sp. multi
atttaaatacatcttatgttgatgttaaacaggactttttctcctacatcattaactaggaagg

SEQ ID NO: 1876 - DNA, 65 bp, Unknown; identical to SEQ ID NO: 1859
  Bacillus sp. multi

SEQ ID NO: 1877 - DNA, 65 bp, Unknown; identical to SEQ ID NO: 1873
  Bacillus sp. multi

SEQ ID NO: 1878 - DNA, 67 bp, Unknown
  Bacillus sp. multi
atttaaatacatcttatgttagtactaaacttttagggaacttatccttaaatggtaaaatgacacc

SEQ ID NO: 1879 - DNA, 66 bp, Unknown
  Bacillus sp. multi
atttaaatacatcttatgttagtactaaactgaagaaagggaaattgatgataacaccgttgaaat

SEQ ID NO: 1880 - DNA, 65 bp, Unknown
  Bacillus sp. multi
atttaaatacatcttatattagtactaaactgaaaagtactagaccaaatcaccgaagatcaaga

SEQ ID NO: 1881 - DNA, 65 bp, Unknown; identical to SEQ ID NO: 1873
  Bacillus sp. multi

SEQ ID NO: 1882 - DNA, 65 bp, Unknown
  Bacillus sp. multi
atttaaatacatcttatgttagtgttaaaccctttgcatgagttaaattcatgctataatcatgt

SEQ ID NO: 1883 - DNA, 66 bp, Unknown
  Bacillus sp. multi
atttaaatacatcttgtgttagtgttaaaccatgcattaaagctatgttttgttttaccattagta

SEQ ID NO: 1884 - DNA, 64 bp, Unknown; identical to SEQ ID NO: 1866
  Bacillus sp. multi

SEQ ID NO: 1885 - DNA, 65 bp, Unknown
  Bacillus sp. multi
atttaaatacatcttatgtcagtgttaaacacattaaaaaacaaatatagtccgtccatgctaaa

SEQ ID NO: 1886 - DNA, 66 bp, Unknown
  Bacillus sp. multi
atttaaatacatcttatgttaatgataaacgggcgatttagcaaaagataatgtattagcagctat

SEQ ID NO: 1887 - DNA, 66 bp, Unknown
  Bacillus sp. multi
atttaaatacatcctatgttagtgttaaacttaatattttacttaatgtctgtctccattgtacca

SEQ ID NO: 1888 - DNA, 65 bp, Unknown
  Bacillus sp. multi
atttaaatacatcttatgttagtgctaaactttgaaataattcagcatttagaaggcaacatatt

SEQ ID NO: 1889 - DNA, 65 bp, Unknown
  Bacillus sp. multi
atttaaatacatcttatgttagtgttaaacacgagggacaaactactgagttactgactagactc

SEQ ID NO: 1890 - DNA, 65 bp, Unknown
  Bacillus sp. multi
atttaaatacatcttatgttaatactaaactggtaccttagatacaataatagctagagatacaa

SEQ ID NO: 1891 - DNA, 65 bp, Unknown
  Bacillus sp. multi
atttaaatacatcttatgttagtgttaaacgataaggtagctatggaatatatacgcgcttatat

SEQ ID NO: 1892 - DNA, 64 bp, Unknown; identical to SEQ ID NO: 1875
  Bacillus sp. multi

SEQ ID NO: 1893 - DNA, 67 bp, Unknown
  Bacillus sp. multi
atttaaatacatcttatgttagtactaaacaaattaatctacaaaaacattttgcgcactctcccca

SEQ ID NO: 1894 - DNA, 64 bp, Unknown
  Bacillus sp. multi
atttaaatacatcttatgttagtgttaaacacgttatgacggacgaaattgtttattctgctag

SEQ ID NO: 1895 - DNA, 65 bp, Unknown; identical to SEQ ID NO: 1859
  Bacillus sp. multi

SEQ ID NO: 1896 - DNA, 64 bp, Unknown
  Bacillus sp. multi
atttaaatacatcttatgttagtgttaaacaaattactgaaatctatacaaaatatgtagcgct

SEQ ID NO: 1897 - DNA, 64 bp, Unknown; identical to SEQ ID NO: 1896
  Bacillus sp. multi

SEQ ID NO: 1898 - DNA, 64 bp, Unknown
  Bacillus sp. multi
gatttaaatacatcttatgttagtgttaaacacgttatgacggacgaaattgtttattctgcta

SEQ ID NO: 1899 - DNA, 65 bp, Unknown; identical to SEQ ID NO: 1890
  Bacillus sp. multi

SEQ ID NO: 1900 - DNA, 64 bp, Unknown; identical to SEQ ID NO: 1894
  Bacillus sp. multi

SEQ ID NO: 1901 - DNA, 64 bp, Unknown
  Bacillus sp. multi
atttaaatacatcttgtgttagtactaaacaaagaccttatcatcgttaggattaagctcaatt

SEQ ID NO: 1902 - DNA, 66 bp, Unknown; identical to SEQ ID NO: 1887
  Bacillus sp. multi

SEQ ID NO: 1903 - DNA, 67 bp, Unknown; identical to SEQ ID NO: 1878
  Bacillus sp. multi

SEQ ID NO: 1904 - DNA, 65 bp, Unknown; identical to SEQ ID NO: 1859
  Bacillus sp. multi

SEQ ID NO: 1905 - DNA, 65 bp, Unknown; identical to SEQ ID NO: 1888
  Bacillus sp. multi

SEQ ID NO: 1906 - DNA, 67 bp, Unknown; identical to SEQ ID NO: 1878
  Bacillus sp. multi

SEQ ID NO: 1907 - DNA, 65 bp, Unknown; identical to SEQ ID NO: 1888
  Bacillus sp. multi

SEQ ID NO: 1908 - DNA, 67 bp, Unknown; identical to SEQ ID NO: 1878
  Bacillus sp. multi

SEQ ID NO: 1909 - DNA, 67 bp, Paenibacillus sp. novel; identical to SEQ ID NO: 1878

SEQ ID NO: 1910 - DNA, 67 bp, Bacillus thuringiensis
atttaaatacatcttatgttagtactaaacaaattaatctacaaaaacactttgcgcactctcccca

SEQ ID NO: 1911 - DNA, 67 bp, Unknown; identical to SEQ ID NO: 1910
  Bacillus sp. multi

SEQ ID NO: 1912 - DNA, 67 bp, Unknown; identical to SEQ ID NO: 1910
  Bacillus sp. multi

SEQ ID NO: 1913 - DNA, 67 bp, Unknown; identical to SEQ ID NO: 1910
  Bacillus sp. multi

SEQ ID NO: 1914 - DNA, 66 bp, Unknown
  Bacillus sp. multi
atctaaatacatcttatgttcatactaaacaacaaaatttcgtattattgtggtaaaatatgcatg

SEQ ID NO: 1915 - DNA, 65 bp, Unknown; identical to SEQ ID NO: 1859
  Bacillus sp. multi

SEQ ID NO: 1916 - DNA, 67 bp, Unknown; identical to SEQ ID NO: 1910
  Bacillus sp. multi

SEQ ID NO: 1917 - DNA, 67 bp, Unknown; identical to SEQ ID NO: 1878
  Bacillus sp. multi

SEQ ID NO: 1918 - DNA, 67 bp, Unknown
  Bacillus sp. multi
atttcaatacatctattgttatgtttaaacgcctgaagtcaactttacataagtactgcatcatgct

SEQ ID NO: 1919 - DNA, 66 bp, Unknown
  Bacillus sp. multi
atttcaatacatctattgttatgttttaactaacgaacagggaaaagaaaaattaccatcagccga

SEQ ID NO: 1920 - DNA, 66 bp, Unknown
  Bacillus sp. multi
atttcaatacatctattgttatgttttaactaacgaacgtactagattattaatttcgaggtacct

SEQ ID NO: 1921 - DNA, 66 bp, Unknown; identical to SEQ ID NO: 1920
  Bacillus sp. multi

SEQ ID NO: 1922 - DNA, 66 bp, Unknown
  Bacillus sp. multi
atttcaatacatctattgttatttttttactaaaacagacgatgcaaaacgttattataacgaaac

SEQ ID NO: 1923 - DNA, 65 bp, Unknown
  Bacillus sp. multi
atttcaatacatctattgttttgttttaaccttagtttaggggtgctttcttcatacatttcaac

SEQ ID NO: 1924 - DNA, 64 bp, Unknown
  Bacillus sp. multi
atttcaatacatctattgttatgtcttaaccaataaaagtgttttagaaaggccgcccacttga

SEQ ID NO: 1925 - DNA, 65 bp, Unknown; identical to SEQ ID NO: 1923
  Bacillus sp. multi

SEQ ID NO: 1926 - DNA, 65 bp, Unknown; identical to SEQ ID NO: 1923
  Bacillus sp. multi

SEQ ID NO: 1927 - DNA, 65 bp, Unknown
  Bacillus sp. multi
atttcaatacatctattgttatgttttaacgatatgacaataggtgattgcttggattatatcga

SEQ ID NO: 1928 - DNA, 65 bp, Unknown
  Bacillus sp. multi
atttcaatacatctattattatgttttaccttaaatagagggtcctaaccgacttattaataagt

SEQ ID NO: 1929 - DNA, 67 bp, Bacillus thuringiensis
atttcaatacatctattgttatgttttaactgggtttaactcctggaaaggttcaaaaatctttaaa

SEQ ID NO: 1930 - DNA, 66 bp, Unknown
  Bacillus sp. multi
atttcaatacatctattgttatgttttaaccttgctttcgtagaccagtgatttgctggaacatca

SEQ ID NO: 1931 - DNA, 67 bp, Unknown
  Bacillus sp. multi
atttcaatacatctatttttatgttttaactcaccgtgcttattggtgattttattattcaacgaat

SEQ ID NO: 1932 - DNA, 67 bp, Unknown; identical to SEQ ID NO: 1929
  Bacillus sp. multi

SEQ ID NO: 1933 - DNA, 64 bp, Unknown
  Bacillus sp. multi
atttcaatacatctattgttatgttttaactagcgccataccaggagtgccaggacattattgt

SEQ ID NO: 1934 - DNA, 66 bp, Unknown
  Bacillus sp. multi
aatttcaatacatctattgttatgttttaacgcgttaggatcgtcccctatagaatctttaagttc

SEQ ID NO: 1935 - DNA, 64 bp, Unknown; identical to SEQ ID NO: 1924
  Bacillus sp. multi

SEQ ID NO: 1936 - DNA, 67 bp, Unknown; identical to SEQ ID NO: 1929
  Bacillus sp. multi

SEQ ID NO: 1937 - DNA, 66 bp, Unknown
  Bacillus sp. multi
atttcaatacatctattgttatgttttaacttctctaccttttttaaaagtatattctgggctaaa

SEQ ID NO: 1938 - DNA, 66 bp, Unknown
  Bacillus sp. multi
atttcaatacatctattgttaggttttaactcacttaattttgctagatttagattggatgcaatt

SEQ ID NO: 1939 - DNA, 67 bp, Unknown; identical to SEQ ID NO: 1929
  Bacillus sp. multi

SEQ ID NO: 1940 - DNA, 66 bp, Unknown
  Bacillus sp. multi
atttcaatacatctattgttatgttttaaccaacaacacatcgaaagctattcaaatgcatgttga

SEQ ID NO: 1941 - DNA, 66 bp, Unknown
  Bacillus sp. multi
atttcaatacatctattgttatgttttaactgacggttcagatgtataccgggttcgtgtagaagg

SEQ ID NO: 1942 - DNA, 67 bp, Unknown
  Bacillus sp. multi
atttcaatacatctattgttatgttttaactcaccgtgcttattggtgagtttattattcaacgaat

SEQ ID NO: 1943 - DNA, 65 bp, Unknown
  Bacillus sp. multi
aatacatctattgttatgtttaaccaacgaacgtttgttaaaaggaaaagtttcaactatatttc

SEQ ID NO: 1944 - DNA, 67 bp, Unknown
  Bacillus sp. multi
atttcaatacatctattgttatgttttaactcaccatgcttattggtgattttattattcaacgaat

SEQ ID NO: 1945 - DNA, 66 bp, Unknown
  Bacillus sp. multi
atttcaatacatctattattatgttttacaggttatcgttttggagactataaaccaaccgttatg

SEQ ID NO: 1946 - DNA, 67 bp, Unknown
  Bacillus sp. multi
atttcaatacatctattattatgttttaccgggttatcgttttggagactataaaccaaccgttatg

SEQ ID NO: 1947 - DNA, 67 bp, Unknown
  Bacillus sp. multi
atttcaatacatctattattatgttttaccaggttatcgttttggagactataaaccaaccgttatg

SEQ ID NO: 1948 - DNA, 67 bp, Unknown; identical to SEQ ID NO: 1942
  Bacillus sp. multi

SEQ ID NO: 1949 - DNA, 67 bp, Unknown
  Bacillus sp. multi
atttcaatacatctattgttttgtttaaacattcgccttatatgtatgaagagacagttataacaag

SEQ ID NO: 1950 - DNA, 65 bp, Unknown
  Bacillus sp. multi
atttcaatacatctattgttatgttttaacttaaatatatttcatcaataagagtaggcggagat

SEQ ID NO: 1951 - DNA, 66 bp, Unknown
  Bacillus sp. multi
atttcaatacatctattgttatatttaaaccagtagatcgttaagtattacgaggacttataagac

SEQ ID NO: 1952 - DNA, 65 bp, Unknown
  Bacillus sp. multi
atttcaatacatctattgttatgttttaacgaaggaagctcgtgctgtatgtatccattcataat

SEQ ID NO: 1953 - DNA, 66 bp, Unknown; identical to SEQ ID NO: 1940
  Bacillus sp. multi

SEQ ID NO: 1954 - DNA, 65 bp, Unknown; identical to SEQ ID NO: 1928
  Bacillus sp. multi

SEQ ID NO: 1955 - DNA, 66 bp, Unknown
  Bacillus sp. multi
atttcaatacatctattgttatgttttaacgcgttaggatcgtcccctatagaatctttaagttca

SEQ ID NO: 1956 - DNA, 67 bp, Unknown; identical to SEQ ID NO: 1929
  Bacillus sp. multi

SEQ ID NO: 1957 - DNA, 65 bp, Unknown; identical to SEQ ID NO: 1952
  Bacillus sp. multi

SEQ ID NO: 1958 - DNA, 66 bp, Unknown
  Bacillus sp. multi
atttcaatacatctattgttatgttttaactcccaatattcagtcgtgttgttatcagacaattat

SEQ ID NO: 1959 - DNA, 67 bp, Unknown
  Bacillus sp. multi
atttcaatacatctattgttatgttttaactgtgtttaactcctggataggttcaaaaatctttaaa

SEQ ID NO: 1960 - DNA, 64 bp, Unknown
  Bacillus sp. multi
atttcaatacatctattgttatgttttaactagcgccataccaggagtgccagggcattattgt

SEQ ID NO: 1961 - DNA, 66 bp, Unknown
  Bacillus sp. multi
atttcaatacatctattgttatgtttaaacgtatcccccacctagtaaaaaggttcctggatattc

SEQ ID NO: 1962 - DNA, 67 bp, Unknown
  Bacillus sp. multi
aatttcaatacatctattgtttggtttgaacgatatgtgacgtatcaggtattaagaagaccttcta

SEQ ID NO: 1963 - DNA, 67 bp, Bacillus megaterium
aatttcaatccttacacccatgtagggtgtgacctataagccaagatctttatgagtgggcggatcc

SEQ ID NO: 1964 - DNA, 65 bp, Unknown
  Bacillus sp. multi
atttacattccacatagttgatatcaaataaacttttttctgtaatacgcttaatcctcgtttca

SEQ ID NO: 1965 - DNA, 64 bp, Unknown
  Bacillus sp. multi
atttacattccatataggtgatatcaaacaaagttgatgcggaaatcatccagcgttggggcga

SEQ ID NO: 1966 - DNA, 64 bp, Unknown; identical to SEQ ID NO: 1965
  Bacillus sp. multi

SEQ ID NO: 1967 - DNA, 67 bp, Unknown
  Paenibacillus thiaminolyticus (multi)
gtcgcatcctacgcggatgcgtggattgaaatacactgaaggacggaacaactatgacggtctatga

SEQ ID NO: 1968 - DNA, 67 bp, Unknown
  Paenibacillus thiaminolyticus (multi)
gtcgcatcctacgcggatgcgtggattgaaattatgtcaatcggaagatgtgatatgttatttataa

SEQ ID NO: 1969 - DNA, 66 bp, Unknown
  Paenibacillus sp. multi
gtcgcatcctacgcggatgcgtggattgaaatgtacacccgagctaacgcggaaccattactactg

SEQ ID NO: 1970 - DNA, 70 bp, Unknown
  Paenibacillus sp. multi
gtcgcatcctatgcggatgcgtggattgaaataagatagagtagctcttttcgaggaacatagtaaacat

SEQ ID NO: 1971 - DNA, 66 bp, Unknown
  Paenibacillus lentimorbus (multi)
gtcgcatcctacgcggatgcgtggattgaaattctaacgcccaatccctccctatttttcttgcca

SEQ ID NO: 1972 - DNA, 65 bp, Unknown
  Paenibacillus lentimorbus (multi)
gtcgcatcctacgcggatgcgtggactgaaatcagtcggtcgtgaatcgtttcatgccgaccacc

SEQ ID NO: 1973 - DNA, 68 bp, Unknown
  Paenibacillus thiaminolyticus (multi)
gtcgcatcctacgcggatgcgtggattgaaattgtggtaaaatggtattaacaagtatatcggaggtg

SEQ ID NO: 1974 - DNA, 65 bp, Unknown
  Paenibacillus thiaminolyticus (multi)
gtcgcatcctacgcggatgcgtggattgaaatatatttggcagaaagaaatggagcaccagacta

SEQ ID NO: 1975 - DNA, 65 bp, Unknown
  Paenibacillus thiaminolyticus (multi)
gtcgcatcctacgcggatgcgtggattgaaatcttacattccacggacaaactcccaccgctcgc

SEQ ID NO: 1976 - DNA, 65 bp, Unknown
  Paenibacillus thiaminolyticus (multi)
gtcgcatcctacacggatgcgtggattgaaatgtctatgtgggccggttcaacgcggcacacatc

SEQ ID NO: 1977 - DNA, 67 bp, Unknown
  Paenibacillus thiaminolyticus (multi)
gtcgcatcctacgtggatgcgtggattgaaatgcatcgaggacaccacatagttatatctctcattt

SEQ ID NO: 1978 - DNA, 66 bp, Paenibacillus terrae
gtcgcatcctacgcggatgcgtggattgaaatcaacgcacggagcgaacgattatcgaaatcctca

SEQ ID NO: 1979 - DNA, 66 bp, Unknown
  Paenibacillus thiaminolyticus (multi)
gtcgcatcctacgcggatgcgtggattgaaatgccttacctccgcccgcgacaataacgatctttt

SEQ ID NO: 1980 - DNA, 66 bp, Unknown
  Paenibacillus thiaminolyticus (multi)
gtcgcatcctatgcggatgcgtggattgaaatcggtagggcttcccatccatttcaacctcgaaga

SEQ ID NO: 1981 - DNA, 66 bp, Unknown
  Paenibacillus thiaminolyticus (multi)
gtcgcatcctatgtggatgcgtggattgaaatttaagctgattggctaccccattctcacatgctt

SEQ ID NO: 1982 - DNA, 65 bp, Unknown
  Bacillus sp. multi
acattctacatagtgtttataaaacttgcagccgttttagaactaaattacaagtgctaacattc

SEQ ID NO: 1983 - DNA, 65 bp, Unknown
  Bacillus sp. multi
attcacattctacatagttcatttaaaacataatttcgagttatgcacaagaattcagctatatt

SEQ ID NO: 1984 - DNA, 61 bp, Unknown
  Streptomyces sp. multi
ggggtcatccccgcgtgcgcggggagccattcttgagccccaccccctgagtcaatgccaa

SEQ ID NO: 1985 - DNA, 66 bp, Unknown
  Bacillus sp. multi
accatatcataacgatggttcttttggaactatagccacattgcattccattcgaagtcggatgtg

SEQ ID NO: 1986 - DNA, 66 bp, Unknown
  Bacillus sp. multi
gatcctagcatagcgatatttcttatggaactatagccaaacttactaactgcattaagtagtaaa

SEQ ID NO: 1987 - DNA, 66 bp, Unknown
  Bacillus sp. multi
aacataagatgtatttaaatttttatgctcatcgcataattcaagatgaaaaggcggtttaatacc

SEQ ID NO: 1988 - DNA, 65 bp, Unknown
  Bacillus sp. multi
attctaacaatacatattgtatttaaaacgaacatttgaagtgaatcaattattagcagaagcga

SEQ ID NO: 1989 - DNA, 65 bp, Unknown; identical to SEQ ID NO: 1988
  Bacillus sp. multi

SEQ ID NO: 1990 - DNA, 65 bp, Unknown
  Bacillus sp. multi
attctaaccatacatattagatttaaaacgaacgatattaacaaccattttgtagaaaaggggaa

SEQ ID NO: 1991 - DNA, 57 bp, Unknown
  Lysinibacillus sp. multi
aataataaagttgtaacctagaattacaattttttcctgaatgtgagattcaaaaag

SEQ ID NO: 1992 - DNA, 61 bp, Unknown
  Streptomyces sp. multi
atccgtcccgcaggcgcgggtatctacggcgggtccggtacggtgcgggggcgaggttcat

SEQ ID NO: 1993 - DNA, 67 bp, Unknown; identical to SEQ ID NO: 1942
  Bacillus sp. multi

SEQ ID NO: 1994 - DNA, 67 bp, Unknown; identical to SEQ ID NO: 1942
  Bacillus sp. multi

SEQ ID NO: 1995 - DNA, 66 bp, Unknown
  Bacillus sp. multi
atttcaatacatctattgttatgttttaacaatccacatagcatacggtgtcatataatgacttaa

SEQ ID NO: 1996 - DNA, 66 bp, Unknown
  Bacillus sp. multi
gaatttcaatacatctattgttatgttttaacaacaaaaacgttaaaagctttatctccttttatg

SEQ ID NO: 1997 - DNA, 66 bp, Unknown
  Bacillus sp. multi
atttcaatacatctattgttatgttttaactgacggttcagatgtaaaccgggttcgtgtagaagg

SEQ ID NO: 1998 - DNA, 65 bp, Unknown; identical to SEQ ID NO: 1927
  Bacillus sp. multi

SEQ ID NO: 1999 - DNA, 67 bp, Unknown; identical to SEQ ID NO: 1931
  Bacillus sp. multi

SEQ ID NO: 2000 - DNA, 69 bp, Unknown
  Paenibacillus thiaminolyticus (multi)
gtcgcatcctacgcggatgcgtggattgaaatcggaagaacaaccaggagcgcgagctgcagcttcgcc

SEQ ID NO: 2001 - DNA, 66 bp, Unknown
  Paenibacillus lentimorbus (multi)
gtcgcatcctacacggatgcgtggattgaaattgcattggaagtagcgtataggacaacaccctcc

SEQ ID NO: 2002 - DNA, 65 bp, Unknown
  Paenibacillus thiaminolyticus (multi)
gtcgcatcctacgcggatgcgtggattgaaatcataatcgatgattgcgttggccggcacagcgc

SEQ ID NO: 2003 - DNA, 48 bp, Unknown
  Stenotrophomonas sp. multi
agtagatccacgccatgcgtggatacgaccagccaccccgcacaatcc

SEQ ID NO: 2004 - DNA, 34 bp, Unknown
  Bacillus sp. multi
gcgtcctctttttatataaaaggaggaacctggt

SEQ ID NO: 2005 - DNA, 36 bp, Unknown
  Bacillus sp. multi
gcgtcctctttttatataaaaggaggaacctggtag

SEQ ID NO: 2006 - DNA, 35 bp, Unknown
  Bacillus sp. multi
gcgtcctctttttatataaaaggaggaacctggta

SEQ ID NO: 2007 - DNA, 73 bp, Bacillus thurigiensis
tttttcctgtatacaattcagcgtcctctttttatataaaaggaggaacctggctgatgaaaaaattaatgca

SEQ ID NO: 2008 - DNA, 73 bp, Staphylococcus; identical to SEQ ID NO: 2007

SEQ ID NO: 2009 - DNA, 73 bp, Bacillus cereus; identical to SEQ ID NO: 2007

SEQ ID NO: 2010 - DNA, 73 bp, Bacillus thurigiensis
tttttcctatatacaattcagcgtcctctttttatataaaaggaggaacctggctgatgaaaaaattaatgca

SEQ ID NO: 2011 - DNA, 73 bp, Bacillus thurigiensis; identical to SEQ ID NO: 2007

SEQ ID NO: 2012 - DNA, 30 bp, Unknown
  Bacillus sp. multi
gtttggtactaacataagatgtatttaaat

SEQ ID NO: 2013 - DNA, 30 bp, Unknown; identical to SEQ ID NO: 1129
  Bacillus sp. multi

SEQ ID NO: 2014 - DNA, 30 bp, Unknown; identical to SEQ ID NO: 1119
  Bacillus sp. multi

SEQ ID NO: 2015 - DNA, 30 bp, Unknown; identical to SEQ ID NO: 1122
  Bacillus sp. multi

SEQ ID NO: 2016 - DNA, 30 bp, Unknown; identical to SEQ ID NO: 1128
  Bacillus sp. multi

SEQ ID NO: 2017 - DNA, 35 bp, Unknown
  Bacillus sp. multi
gcaggggttcgctaacggtacacctgatatagaag

SEQ ID NO: 2018 - DNA, 37 bp, Unknown; identical to SEQ ID NO: 1277
  Bacillus sp. multi

SEQ ID NO: 2019 - DNA, 5981 bp, Unknown
  Bacillus sp. multi
aatacaaaacattttacaagtctaaatgataaaaaaaataacacctacattgtaggtgttatttttttaatggccaccgccaccaggagtataatttatgttcgaaggaatataaattcctgttcctggattaagaaatcgattgttttctttgttacttgttttagaattcaattaatatttcacattctttttatctccattgaataattaacgattactcctttatcagtgtgccatatatctttgactgtttttttcttaatatcataataagaaagcatactttcctttggggaccccaatgtattataatcttttttactatcataaagacttgataaaaaaaagaaaccttcacttttttcactatactttaacgctcttattttaaagtgtttttccgtatcgtcaaatagtggctttatttttttggaattcaaatttatttctgcaacatgggaagtagggttggtcaaattttcatcataactgaatatcactgaactttcatcatcggcaaatgaagccccgctaataaatttttccactaagctaacatgtttttctttatttccatccacattataaatatctaaactgtatttagctggacgcattgtgatttgtttttcatttgcttcttcaagcttctttttatcctcagcctcagaaaaggaaactataactaatttattattaatgggattgtaatcaaaatccaaaatacttttatccttatcgtctttttcccatatttctaacttatccttttcaatattataagtggcaatatgaaaattacgatactcatcttttaataaaactctcatgaaaaccgttgtttgtttgttatctatttgtataagatctacattacctaattccttagtcaattgccttatttgatttttttgtaagtccttaacaaacaattgcattgtaccgtcttcagctttatcagcaaagtacaatttgttatggagttttgaataagaaaaagtagtataatctggtatctttttctttaataatactgtattttcttgtaacgttggatcatattcataaaatgtatttgtaagaagcttaggttcaaataggtttatgtataatttttgagaaggtgtatcatttttattaacaacaacactcccagatgtaaggaatttgtaactaagtatgatacacaaagatacagctattaatgaaaaaactatggttttcttcattatatcccccctaaaaaaaatccagatataaagtattatatccggactttttcgaaaattattcgattatcgctattccaccggatcgttcagttcgaccattcttaatctgaccatcacttagttttccccctaatgccacaaatgtattagggagtacatccactataacaccaaattttttaaactcgccataatcccatttctcaagaactctagatttccctttatctaagttcgttactacaattttggtgccctttctaatatatgcctcacttgagtcaacagcgcaatcattatccgtcatccactttccgtcagaccctggtttgtaaggcgtgtaattacttatcttaccgtaacgggttatcgtatccgctttagctgtttgtcctccaaatacattgactgttgttaataaaaacgtagcaataataaaaatgaaactgaatttcttcttcataatattttttctccttttcattttttgaactagttctttttaattttataacacgggaacaattattcaacataattgttaaataattccaaattgtattcatatatagatttatagagaaaatgctaatagcctggatacagttaagtaagtattactacaatttataatttttttcttgggtttaatataagagaagtaaaaaaatctaagttgatgggcatgtatggtgccccctaatagtataatttttgttgatttggttaggatggtgacatcagggacatgaagaggtgacatttttgggagtaacaattaagataatgaaatatcaaattttatgtccaatgaatgtcgattggacaatatttgaaaaacatttacgaaacttaacatatcaggtcagaacgataagtaatcgaaccattcaacaattatgggagtttgatgctttatcctttgactactttaaagaaagagggacataccctactgtccaagatttgtatgggtgtacacagaagaaaattgatggctatatataccatacattacaaagtaaatatccagatatacataaaggaaacatgtctactactcttcaaaaaattataaaaacgtggaagagtagaagaaatgaaattagaaaaggtgaaatgtcaattccttcttttcgaaatcgcataccaattgatctccataataattctgtagacataacaaaagagaagaatggagattatattgctggtatatctcttttttcacgagattttcataaggaaaatgacgatgtcccaaaagggaagatttttgtaaagttagctacccaaaaacaaaaaagcatgaaagttattttagaccgattaattaatcaaacatacagcaaaggcgcatgtatgattcataaatacaaaaataagtggtatttatcaattacttataaattcaatgctataaaagaaaataaatttgataaagaattaatcatgggaattgatttgggtggaataaatacagtttactttgcatttaatgaaggatttattcgtagcaatattaaaagcgatgaaattaaaatgtttaatgaaagaattcgccagagacgtatcaacttattgaaacaaagtaaatattgtagtaatagcagaactggaaaaggtaggacgaaacgattacagccaatagacgtgttaagtaataaaatagctaagtttcgaaatagcactaatcataaatatgcaaactatatagtgaaacagtgtctaaagcataattgcgggcggattcaaatggaacttttaaaaggtatatcaaaaaatgataggattcttaaagattggacttattttgatttgcaggagaagatcaaaaatcaagcagagattcatggaattgaagttattaaagttgccccagcgtatacgagtcaacgatgtagtcaatgcggatatatttgtaaagaaaatcgttgtacacaagctacgtttgaatgtaagcagtgtggatataaaacacatgctgattataatgcggcgaaaaacatttctacttatgacatcgaaaatattataaataaacaattagcggtacaaagcaaattgcattcaaaaaaatgtatggaagagtatatagaagagttaggatacctggattaatgtaggtaattgagtccatattaaataatttggtggatttacacgccataaatggagaagtagcacataagaaatttaccaagtgccaacactccgtaaggtagtatcaaatgtaaataagcattgatgcgtgggcatttttcatgctctgaagggtgtaacacaaagaccgttacacagtacatctatttgctggtaaaataatgtttaatgtccatcttattagttttttcgcatctgttaaagtatctatctttattttatcggggtttggtactaacataagatgtatttaaatgcaggggttcgctaacggtacacctgatatagaaggtttagtactaacataagatgtatttaaatggtgtcattttaccatttaaggataagtttcctaaaagtttagtactaacacaagatgtatttaaatgagtctagtcagtaactcagtagtttgtccctcgtgtttaccagtaacataagatgtatttaaattcgtgtatgtaatcaccatcaatatcccgatattcgtttaccattagcataagatgtatttaaatcgtttaatgtgtaatttctatatcaaagaaggactttgtttactataaacataaggggtatttaaataggtttataaaaatcattaaactaagctaagaaagtgaattttatcaatacgagttttttcttttacatattaaaatggaagtaccctttcaatgtatactgaccccttcataaattgtgaagggatttttttattcaataaatgagttttacaaaatatacaaaatgttaaacttataaaacccagtgatatcagtaagtgtgcatgaaatcactgggtttttatttggatatttaatggtgtgtgttacaaattataaaaagatataaacttagttttactttttaaatattatccgtcctaaaaaatggccaatgttcataaaggtacaattttctggacacatacaatggaggggtgtatcaaaattctgattattcaactatagaatcgcataggatatatatatatttctttacattcattattttcagaaacattacaaagctgtcagataaatgaaaggttattcaatatgaaaaagaaagtatgtgcattacacttattttgaaaaggtcgaagataaaggagacttactagatggaaacattaaaggttcgtgaattaaataaaacttataatgggaaggtatcatatgaagcacttacaaatattaatttaacaataaataagggtgagtttgtaggaattatggggccatcaggaagtggaaaaacaactctgctcaatatgatttccactattgatactccgacttcaggagaagtattaattaatgaaaaaaaccctgatcgattgccagttgatgaattagcattatttcgacgtcgtgaattgggatttatttttcaatcgtttaaccttctgaatacattaacagtgaaagaaaatatcgttcttccacttacattagaaaacgtgaatctgtcagaaatgaacaaacgagttgaatcaatttctatacaattgggtatagaaaagattttacataaacgcctatatgaaatttctggaggacaagctcaacggacagcaattgctcgtgcattaatccattctccacaattagttcttgcagatgagccgacagggaatttagattcgaaggctgcaaatgatgtaatgcaattattagtaaaattaaataaggaataccaaacaactatggtgttagtaacacatgatccattggtttccagttactgtgatcgagtagtatttattaaagatggaatgctttataacgagattaaatgtgaagataatcgcttaattttttataagaaaattatggatgaattgtctctatcaggaggaaccgagaatgagttttcgtcaattggcctggaataatgtcattcgtaataagcgattatatctaggatattttctgagcagtatttttactgtaatgatttttttcacgtttgagttacttgcatttcatccccaatttagtggaaagcttggagcaacaagtgaatctatgattggtttgggtacacaaggttttaaaattgctcaatatttaattatatttttttcttttttctttattttatattctgttggcacattcttgaagacgagaaaacgtgaatttggtatcttaacacttcatggcatgacgaatttccaattaaaacagttaattttcattgagaacatgttaattgggagtagttcaattattgtaggaattggaattgggcttatttttgggaagttaatcttgttagtaagtgcatctatatttgttttaaaaggaggattgccattctattttccaacaaaggcaatttttgtgacaagtatttcattcttgttgttatttttattggtttcgttctttactacaagaataattaaactaactcaggtaattgaattgatgaaatcaggagaaaaaccaaagccagaaccaagagtatctaaatggttagctatattcgcgattttgtttattagtattggttatgctgcagcattttatctagatactgcgttgaaaacaggaaatcactatatttatgctc

SEQ ID NO: 2020 - DNA, 1356 bp, Unknown
  Bacillus sp. multi
ctgggcgtcacgatcaagatcatgaagtaccagatcctctgcccgatgaacgtggactggatcatcttcgagaagcacctccggaacctcacgtaccagatccggacgatcagcaaccggaccatccagcagctctgggagttcgacgcgctgagcttcgactacttcaaggagcgcggcacctaccccacggtccaggacctctacggctgcacgcagaagaaaatagacggctacatctaccacaccctccagagcaagtacccggacatccacaagggcaacatgagcaccaccctccagaaaatcatcaagacctggaagtcccgccggaacgagatccggaagggcgagatgagcatccccagcttccgcaaccgcatccccatcgacctgcacaacaacagcgtggacatcacgaaggagaagaacggcgactacatcgcggggatcagcctgttcagccgcgacttccacaaggagaacgacgacgtgccgaagggcaagatattcgtcaagctggccacgcagaagcagaagtccatgaaggtgatcctggaccggctcatcaaccagacctacagcaagggcgcgtgcatgatccacaagtacaagaacaagtggtatctcagcatcacctacaagttcaacgccatcaaggagaagaagttcgacaaggagcttattatgggcatcgacatgggcggcatcaacaccgtgtacttcgccttcaacgaggggttcatccgctccaacatcaagtccgacgagatcaaggagttcaacgagcgcatccgccagcgccgcatcaacctgctcaaccagtccaagtattgctccaacagccgcaccggcaagggccgcaccaagcgcctccagcccatcgacgtcctctcgaacaagatcgccaagttccgcaacagcacgaaccacaagtacgcgaactacatcatcaagcagtgcctcaagtacaactgcgggcgcatccagatggagctgctcaaggggatcagcaagaacgacaaggtgctcaaggactggacctacttcgacctccaggaaaagatcaagaatcaggcggagatccacggcatcgaggtcatcaaggtcgccccggcctacaccagccagcggtgctcgcagtgcggctacatctgcaaggagaaccggtgcacccaggccatgttcgagtgcaagcagtgcgggtacaagacccacgcggactacaacgccgccaagaacatcgccacctacgacatcgagaacatcatcaacaagcagctcgccgcccagagcaagctccacagcaagaagtgcatggaggagtacatcgaggagctgggctacctcgactga

SEQ ID NO: 2021 - DNA, 1356 bp, Unknown
  Bacillus sp. multi
ctcggcgtcaccatcaagatcatgaagtaccagatcctctgcccgatgaacgtggactggatcatcttcgagaagcacctccggaacctgacgtaccagatccgcacgatctccaaccgcaccatccagcagctctgggagttcgacgcgctgagcttcgactacttcaaggagcgcggcacgtaccccacggtccaagatctgtacggctgcacccagaagaaaatcgacggctacatctaccacaccctccagagcaagtacccggacatccacaagggcaacatgagcaccacgctccagaaaatcatcaagacctggaagtcccgccgcaacgagatccgcaagggcgagatgtccatccccagcttccggaaccgcatccccatcgacctgcacaacaactccgtggacatcacgaaggagaagaatggggactacatcgcggggatcagcctgttcagccgcgacttccacaaggagaacgacgacgtgccgaagggcaaaatcttcgtgaagctcgccacccagaagcagaagtccatgaaggtgatcctggaccgcctcatcaaccagacctacagcaagggcgcgtgcatgatccacaagtacaagaacaagtggtatctctccatcacctacaagttcaacgcgatcaaggagaagaagttcgacaaggagttgatcatggggatcgacatgggcgggatcaacacggtgtacttcgccttcaacgaggggttcatccggtccaacatcaagtcggacgagatcaaggagttcaacgagcgcatccggcagcgccgcatcaacctcctgaaccagagcaaatactgttcgaactcccgcacgggcaaggggcgcaccaagcgcctccagcccatcgacgtgctgtcgaacaagatcgccaagttccgcaactccaccaaccacaagtacgcgaactacatcatcaagcagtgcctcaagtacaactgcgggcgcatccagatggagctgctcaagggcatctccaagaacgacaaggtgctcaaggactggacgtacttcgacctccaggagaagatcaagaaccaggccgagatccacggcatcgaggtcatcaaggtggccccggcctacaccagccagcggtgctcccagtgcggctacatctgcaaggagaaccgctgcacccaggccatgttcgagtgcaagcagtgcgggtacaagacgcacgccgactacaacgcggccaagaacatcgccacctacgacatcgagaacatcatcaacaagcagctcgcggcccagtccaagctccactccaagaagtgcatggaggagtacatcgaggagctgggctacctggactag

SEQ ID NO: 2022 - DNA, 1356 bp, Unknown
  Bacillus sp. multi
ctcggcgtcacgatcaagatcatgaagtaccagatcctctgcccgatgaacgtggactggatcatcttcgagaagcacctccgcaacctcacctaccagatccgcacgatcagcaaccggaccatccagcagctctgggagttcgacgccctctcgttcgactacttcaaggagcgcggcacctacccgacggtccaagacctgtacggctgcacccagaagaaaatcgacggctacatctaccacacgctccagagcaagtaccccgacatccacaaggggaacatgagcaccaccctccagaagattattaagacctggaagtcccgccggaacgagatccgcaagggcgagatgtcgatcccctccttccgcaaccgcatccccatcgacctgcacaacaactccgtggacatcacgaaggagaagaacggcgactacatcgcgggcatcagcctgttcagccgcgacttccacaaggagaacgacgacgtgccgaagggcaagatcttcgtcaagctggccacgcagaagcagaagtccatgaaggtcatcctggaccgcctcatcaaccagacgtactcgaagggcgcgtgcatgatccacaagtacaagaacaagtggtacttgtccatcacctacaagttcaacgcgatcaaggagaagaagttcgacaaggaacttatcatgggcatcgacatgggcggcatcaacaccgtgtacttcgccttcaacgaggggttcatccgcagcaacatcaagagcgacgagatcaaggagttcaacgagcgcatccggcagcgccggatcaacctgctgaaccagagcaaatactgttccaacagccggacggggaagggccgcaccaagcgcctccagcccatcgacgtgctgtcgaacaagatcgccaagttccgcaactccacgaaccacaagtacgcgaactacatcatcaagcagtgcctcaagtacaactgcgggcgcatccagatggagctgctcaagggcatcagcaagaacgacaaggtgctcaaggactggacgtacttcgacctccaggagaagattaagaaccaggcggagatccacggcatcgaggtcatcaaggtcgcgcccgcctacaccagccagcggtgctcgcagtgcggctacatctgcaaggagaaccgctgcacccaggccatgttcgagtgcaagcagtgcggctacaagacccacgccgactacaacgcggccaagaacatcgccacgtacgacatcgagaacatcatcaacaagcagctcgccgcccagtcgaagctccacagcaagaagtgcatggaggagtacatcgaggagctgggctacctggactag

SEQ ID NO: 2023 - DNA, 1356 bp, Unknown
  Bacillus sp. multi
ctcggggtgaccatcaagatcatgaagtaccagatcctctgccccatgaacgtggactggatcatcttcgagaagcacctccggaacctgacgtaccagatccgcaccatcagcaaccgcaccatccagcagctctgggagttcgacgccctctcgttcgactacttcaaggagcgcggcacctacccgaccgtccaagacttatacggctgcacccagaagaagatcgacggctacatctaccacacgctccagagcaagtacccggacatccacaagggcaacatgagcacgaccctccagaaaatcatcaagacctggaagtcccgccggaacgagatccggaagggcgagatgtcgatcccgtccttccgcaaccgcatccccatcgacctccacaacaactcggtggacatcacgaaggagaaaaacggcgactacatcgcgggcatcagcctgttctcccgcgacttccacaaggagaacgacgacgtgccgaagggcaagatattcgtgaagctcgccacgcagaagcagaagtccatgaaggtgatcctcgaccggctcatcaaccagacgtacagcaagggcgcgtgcatgatccacaagtacaagaacaagtggtatctgtccatcacctacaagttcaacgcgatcaaggagaagaagttcgacaaggaactcatcatggggatcgacatgggcgggatcaacaccgtgtacttcgccttcaacgaggggttcatccggtcgaacatcaagagcgacgagatcaaggagttcaacgagcgcatccggcagcggcggatcaacctcctgaaccagtccaagtattgttccaactcccgcacgggcaaggggcggaccaagcgcctccagcccatcgacgtgctgtcgaacaagatcgccaagttccgcaactccaccaaccacaagtacgccaactacatcatcaagcagtgcctcaagtacaactgcgggcgcatccagatggagctgctcaagggcatcagcaagaacgacaaggtgctcaaggactggacctacttcgacctccaggagaagatcaagaaccaggccgagatccacggcatcgaggtcatcaaggtcgccccggcctacacgagccagcgctgctcgcagtgcgggtacatctgcaaggagaaccggtgcacccaggccatgttcgagtgcaagcagtgcgggtacaagacgcacgccgactacaacgcggccaagaacatcgccacctacgacatcgagaacatcatcaacaagcagctcgccgcccagtccaagctccacagcaagaagtgcatggaggagtacatcgaggagctgggctacctcgactga

SEQ ID NO: 2024 - DNA, 1356 bp, Unknown
  Bacillus sp. multi
ctcggggtgacgatcaagatcatgaagtaccagatcctctgcccgatgaacgtggactggatcatcttcgagaagcacctccgcaacctgacctaccagatccgcaccatcagcaaccggacgatccagcagctctgggagttcgacgccctgtccttcgactacttcaaggagcgcggcacctacccgaccgtccaggatctctacggctgcacccagaagaagattgacgggtacatctaccacaccctccagtcgaagtacccggacatccacaagggcaacatgagcaccaccctccagaaaatcattaagacctggaagtcgcgccgcaacgagatccggaagggcgagatgagcatcccgagcttccgcaaccgcatccccatcgacctccacaacaactcggtggacatcacgaaggagaagaatggcgactacatcgcggggatctccctgttcagccgggacttccacaaggagaacgacgacgtgccgaagggcaaaatcttcgtcaagctggcgacgcagaagcagaagtcgatgaaggtgatcctggaccgcctcatcaaccagacctacagcaagggcgcgtgcatgatccacaagtacaagaacaagtggtacctgagcatcacctacaagttcaacgcgatcaaggagaagaaattcgacaaggagctgatcatgggcatcgacatgggcggcatcaacaccgtgtacttcgcgttcaacgaggggttcatccgctccaacatcaagtccgacgagatcaaggagttcaacgagcgcatccgccagcgccgcatcaacctgctcaaccagagcaagtattgctccaactcccgcaccgggaagggccggaccaagcgcctccagcccatcgacgtgctcagcaacaagatcgccaagttccgcaactccacgaaccacaagtacgccaactacatcatcaagcagtgcctcaagtacaactgcgggcgcatccagatggagctgctcaaggggatcagcaagaacgacaaggtgctcaaggactggacgtacttcgacctccaggagaagattaagaatcaggcggagatccacgggatcgaggtcatcaaggtcgcgcccgcctacacctcccagcggtgcagccagtgcgggtacatctgcaaggagaaccggtgcacccaggccatgttcgagtgcaagcagtgcggctacaagacgcacgcggactacaacgcggccaagaacatcgccacgtacgacatcgagaacatcatcaacaagcagctcgcggcgcagtccaagctccactccaagaagtgcatggaggagtacatcgaggagctgggctacctcgactga

SEQ ID NO: 2025 - DNA, 1356 bp, Unknown
  Bacillus sp. multi
ctcggggtcaccatcaagatcatgaagtaccagatcctctgccccatgaacgtggactggaccatcttcgagaagcacctccgcaacctgacgtaccaagtacggacgatctccaaccggacgatccagcagctctgggagttcgacgccctcagcttcgactacttcaaggagcggggcacctacccgaccgtccaagacctttacggctgcacgcagaagaagatcgacggctacatctaccacaccctccagtcgaagtacccggacatccacaagggcaacatgagcacgacgctccagaaaatcatcaagacctggaagtcccgccggaacgagatccgcaagggcgagatgagcatcccgtccttccggaaccgcatccccatcgacctccacaacaactccgtggacatcacgaaggagaagaacggcgactacatcgcgggcatcagcctgttcagccgcgacttccacaaggagaacgacgacgtgccgaagggcaaaatcttcgtcaagctggccacccagaagcagaagtcgatgaaggtgatcctcgaccgcctcatcaaccagacgtactcgaagggcgcgtgcatgatccacaagtacaagaacaagtggtacctttccatcacctacaagttcaacgcgatcaaggagaagaagttcgacaaggagcttatcatggggatcgacatgggcggcatcaacaccgtgtacttcgccttcaacgaggggttcatccgcagcaacatcaagagcgacgagatcaaggagttcaacgagcgcatccggcagcggcggatcaacctgctcaaccagagcaaatactgctccaactcccggacggggaagggccggacgaagcggctccagcccatcgacgtgctgagcaacaagatcgccaagttccgcaacagcaccaaccacaagtacgcgaactacatcatcaagcagtgcctcaagtacaactgcgggcgcatccagatggagctgctcaagggcatcagcaagaacgacaaggtgctcaaggactggacctacttcgacctccaggaaaagattaagaaccaggccgagatccacggcatcgaggtcatcaaggtggccccggcctacacgagccagcgctgctcccagtgcgggtacatctgcaaggagaaccgctgcacccaggccatgttcgagtgcaagcagtgcgggtacaagacgcacgcggactacaacgccgccaagaacatcgccacctacgacatcgagaacatcatcaacaagcagctcgccgcccagagcaagctccacagcaagaaatgcatggaggagtacatcgaggagctgggctacctggactag

SEQ ID NO: 2026 - DNA, 1356 bp, Unknown
  Bacillus sp. multi
ctgggcgtgacgatcaagatcatgaagtaccagatcctctgccccatgaacgtggactggacgatcttcgagaagcacctccgcaacctgacctaccaagtccggacgatctccaaccgcaccatccagcagctctgggagttcgacgccctcagcttcgactacttcaaggagcgcggcacgtaccccaccgtccaggacttgtacggctgcacgcagaagaaaattgacggctacatctaccacaccctccagtcgaagtacccggacatccacaagggcaacatgagcacgacgctccagaaaatcatcaagacctggaagtcccgccgcaacgagatccggaagggcgagatgtcgatcccgagcttccggaaccgcatccccatcgacctccacaacaactcggtggacatcacgaaggagaagaatggcgactacatcgcggggatctcgctgttctcccgcgacttccacaaggagaacgacgacgtgccgaagggcaaaatcttcgttaagctggcgacccagaagcagaagtcgatgaaggtcatcctggaccggctcatcaaccagacgtacagcaagggcgcgtgcatgatccacaagtacaagaacaagtggtacttgagcatcacctacaagttcaacgccatcaaggagaagaagttcgacaaggaacttatcatgggcatcgacatgggcgggatcaacaccgtgtacttcgccttcaacgaggggttcatccggagcaacatcaagtccgacgagatcaaggagttcaacgagcgcatccggcagcgccgcatcaacctgctcaaccagagcaagtactgctcgaactcccgcacggggaagggccggacgaagcgcctccagcccatcgacgtgctcagcaacaagatcgccaagttccgcaacagcacgaaccacaagtacgccaactacatcatcaagcagtgcctcaagtacaactgcgggcgcatccagatggagctgctcaaggggatctccaagaacgacaaggtgctcaaggactggacctacttcgacctccaggagaagatcaagaaccaggcggagatccacggcatcgaggtcatcaaggtcgccccggcctacacgagccagcggtgctcccagtgcgggtacatctgcaaggagaaccgctgcacccaggccatgttcgagtgcaagcagtgcgggtacaagacgcacgcggactacaacgcggccaagaacatcgccacgtacgacatcgagaacatcatcaacaagcagctcgcggcgcagagcaagctccactccaagaaatgcatggaggagtacatcgaggagctgggctacctcgactag

SEQ ID NO: 2027 - DNA, 1356 bp, Unknown
  Bacillus sp. multi
ctgggcgtgacgatcaagatcatgaagtaccagatcctctgcccgatgaacgtggactggacgatcttcgagaagcacctccgcaacctgacgtaccaagtgcggacgatcagcaaccggacgatccagcagctctgggagttcgacgcgctgtcgttcgactacttcaaggagcgcggcacctacccgaccgtccaagatctctacggctgcacgcagaagaagattgacggctacatctaccacaccctccagagcaagtacccggacatccacaagggcaacatgagcaccaccctccagaagattatcaagacctggaagtcccgccgcaacgagatccggaagggcgagatgtccatcccctccttccgcaaccgcatccccatcgacctgcacaacaacagcgtggacatcacgaaggagaagaatggcgactacatcgcgggcatctcgctgttcagccgcgacttccacaaggagaacgacgacgtgccgaagggcaagattttcgttaagctggcgacccagaagcagaagtcgatgaaggtgatcctcgaccggctcatcaaccagacctacagcaagggcgcgtgcatgatccacaagtacaagaacaagtggtacttgtccatcacctacaagttcaacgcgatcaaggagaagaaattcgacaaggagttgatcatgggcatcgacatgggcggcatcaacaccgtgtacttcgccttcaacgagggcttcatccggagcaacatcaagagcgacgagatcaaggagttcaacgagcgcatccgccagcgccgcatcaacctgctgaaccagagcaagtactgctccaacagccgcacggggaagggccggacgaagcgcctccagcccatcgacgtgctgtccaacaagatcgccaagttccgcaacagcaccaaccacaagtacgccaactacatcatcaagcagtgcctcaagtacaactgcgggcgcatccagatggagctgctcaaggggatctccaagaacgacaaggtgctcaaggactggacctacttcgacctccaggagaagattaagaaccaggcggagatccacggcatcgaggtcatcaaggtcgcgcccgcctacacctcgcagcggtgctcgcagtgcggctacatctgcaaggagaaccgctgcacccaggccatgttcgagtgcaagcagtgcggctacaagacccacgccgactacaacgcggccaagaacatcgccacgtacgacatcgagaacatcatcaacaagcagctcgcggcccagtcgaagctccactccaagaagtgcatggaggagtacatcgaggagctgggctacctcgactga

SEQ ID NO: 2028 - DNA, 1356 bp, Unknown
  Bacillus sp. multi
ctcggggtgaccatcaagatcatgaagtaccagatcctctgcccgatgaacgtggactggaccatcttcgagaagcacctccgcaacctcacgtaccaagtgcggacgatctcgaaccgcacgatccagcagctctgggagttcgacgccctgagcttcgactacttcaaggagcggggcacgtacccgaccgtccaggacctctacggctgcacccagaagaagatagacgggtacatctaccacacgctccagagcaagtaccccgacatccacaagggcaacatgagcacgacgctccagaaaatcatcaagacctggaagtcgcgccgcaacgagatccgcaagggcgagatgtcgatccccagcttccgcaaccgcatccccatcgacctgcacaacaactcggtggacatcacgaaggagaagaatggggactacatcgccgggatctcgctgttctccagggacttccacaaggagaacgacgacgtgccgaagggcaaaatcttcgtgaagctggccacccagaagcagaagtccatgaaggtcatcctggaccgcctcatcaaccagacctacagcaagggcgcgtgcatgatccacaagtacaagaacaagtggtatctcagcatcacctacaagttcaacgcgatcaaggagaagaagttcgacaaggagttaatcatggggatcgacatgggcgggatcaacacggtgtacttcgcgttcaacgagggcttcatccggtcgaacatcaagtccgacgagatcaaggagttcaacgagcgcatccggcagcgccggatcaacctgctgaaccagtccaagtattgttccaactcgcgcaccggcaagggccgcaccaagcgcctccagcccatcgacgtgctgtccaacaagatcgccaagttccgcaacagcaccaaccacaagtacgccaactacatcatcaagcagtgcctcaagtacaactgcgggcgcatccagatggagctgctcaagggcatcagcaagaacgacaaggtgctcaaggactggacgtacttcgacctccaggaaaagatcaagaaccaggcggagatccacggcatcgaggtcatcaaggtcgccccggcctacacgagccagcggtgctcccagtgcggctacatctgcaaggagaaccgctgcacccaggccatgttcgagtgcaagcagtgcggctacaagacgcacgcggactacaacgcggccaagaacatcgccacctacgacatcgagaacatcatcaacaagcagctcgccgcccagtcgaagctgcactccaagaagtgcatggaggagtacatcgaggagctgggctacctcgactga

SEQ ID NO: 2029 - DNA, 1356 bp, Unknown
  Bacillus sp. multi
ctcggggtgaccatcaagatcatgaagtaccagatcctctgcccgatgaacgtggactggacgatcttcgagaagcacctccggaacctcacctaccaggtgcggacgatctcgaaccgcacgatccagcagctctgggagttcgacgccctgtcgttcgactacttcaaggagcggggcacctacccgacggtccaagacctttacgggtgcacgcagaagaaaatagacgggtacatctaccacaccctccagagcaagtacccggacatccacaaggggaacatgagcaccacgctccagaagatcattaaaacctggaagtcgcggcgcaacgagatccgcaagggcgagatgtcgatcccgagcttccggaaccgcatccccatcgacctccacaacaactccgtggacatcacgaaggagaagaacggcgactacatcgcgggcatcagcctgttcagccgggacttccacaaggagaacgacgacgtgccgaagggcaaaatcttcgtgaagctggccacccagaagcagaagtccatgaaggtgatcctcgaccgcctcatcaaccagacctacagcaagggcgcgtgcatgatccacaagtacaagaacaagtggtatctctccatcacctacaagttcaacgccatcaaggagaagaaattcgacaaggagctaatcatggggatcgacatgggcggcatcaacacggtgtacttcgcgttcaacgaggggttcatccggagcaacatcaagtccgacgagatcaaggagttcaacgagcgcatccggcagcggcgcatcaacctgctcaaccagtccaagtattgctccaactcgcggacggggaagggccgcaccaagcgcctccagcccatcgacgtgctgagcaacaagatcgccaagttccgcaacagcacgaaccacaagtacgcgaactacatcatcaagcagtgcctcaagtacaactgcgggcgcatccagatggagctgctcaagggcatctccaagaacgacaaggtgctcaaggactggacgtacttcgacctccaggagaaaatcaagaaccaggcggagatccacggcatcgaggtcatcaaggtcgccccggcctacacctcccagcggtgcagccagtgcggctacatctgcaaggagaaccggtgcacccaggccatgttcgagtgcaagcagtgcggctacaagacccacgccgactacaacgccgccaagaacatcgccacctacgacatcgagaacatcatcaacaagcagctcgccgcccagtccaagctccacagcaagaagtgcatggaggagtacatcgaggagctgggctacctggactga

SEQ ID NO: 2030 - DNA, 1356 bp, Unknown
  Bacillus sp. multi
ctcggcgtgacgatcaagatcatgaagtaccagatcctctgccccatgaacgtggactggacgatcttcgagaagcacctccggaacctgacgtaccaagtccggacgatcagcaaccgcaccatccagcagctctgggagttcgacgccctgtccttcgactacttcaaggagcgcggcacctaccccacggtccaagacctgtacgggtgcacgcagaagaaaatcgacgggtacatctaccacaccctccagtcgaagtacccggacatccacaagggcaacatgagcacgaccctccagaaaatcatcaagacctggaagtcgaggcgcaacgagatccgcaagggcgagatgtccatccccagcttccgcaaccgcatccccatcgacctccacaacaactcggtggacatcacgaaggagaagaatggcgactacatcgcggggatctccctgttcagccgggatttccacaaggagaacgacgacgtgccgaagggcaagatcttcgtcaagctcgccacccagaagcagaagtcgatgaaggtcatcctggaccggctcatgaaccagacctacagcaagggcgcgtgcatgatccacaagtacaagaacaagtggtacttgagcatcacgtacaagttcaacgccatcaaggagaagaagttcgacaaggagctgatcatggggatcgacatgggcggcatcaacacggtgtacttcgcgttcaacgagggcttcatccggtcgaacatcaagagcgacgagatcaaggagttcaacgagcgcatccgccagcgccgcatcaacctcctcaaccagtccaagtattgctccaacagccggacggggaaggggcggaccaagcgcctccagcccatcgacgtcctcagcaacaagatcgccaagttccgcaactccaccaaccacaagtacgccaactacatcatcaagcagtgcctcaagtacaactgcgggcgcatccagatggagctgctcaagggcatctccaagaacgacaaggtgctcaaggactggacctacttcgacctccaggagaagatcaagaatcaggccgagatccacgggatcgaggtcatcaaggtcgccccggcctacaccagccagcgctgctcccagtgcgggtacatctgcaaggagaaccggtgcacccaggccatgttcgagtgcaagcagtgcggctacaagacgcacgccgactacaacgcggccaagaacatcgccacgtacgacatcgagaacatcatcaacaagcagctcgccgtccagtcgaagctgcacagcaagaagtgtatggaggagtacatcgaggagctgggctacctggactga

SEQ ID NO: 2031 - DNA, 1356 bp, Unknown
  Bacillus sp. multi
ctcggcgtcacgatcaagatcatgaagtaccagatcctctgccccatgaacgtggactggacgatcttcgagaagcacctccgcaacctcacgtaccaggttcggacgatctcgaaccgcacgatccagcagctctgggagttcgacgcgctgtccttcgactacttcaaggagcggggcacgtacccgaccgtccaagacctgtacggctgcacccagaagaagatcgacggctacatctaccacacgctccagtcgaagtacccggacatccacaagggcaacatgagcaccacgctccagaaaatcatcaagacctggaagtcccgccggaacgagatccggaagggcgagatgtccatccccagcttccgcaaccgcatccccatcgacctccacaacaactcggtggacatcacgaaggagaagaatggggactacatcgcgggcatctcgctcttcagccgcgacttccacaaggagaacgacgacgtgccgaagggcaagatattcgtgaagctggccacccagaagcagaagtccatgaaggtgatcctcgaccgcctcatgaaccagacctacagcaagggcgcgtgcatgatccacaagtacaagaacaagtggtatcttagtatcacctacaagttcaacgcgatcaaggagaagaagttcgacaaggagctgataatgggcatcgacatgggcggcatcaacacggtgtacttcgcgttcaacgaggggttcatccgctccaacatcaagagcgacgagatcaaggagttcaacgagcgcatccggcagcgccgcatcaacctgctcaaccagtccaagtactgctccaactcccgcaccggcaagggccgcaccaagcgcctccagcccatcgacgtcctcagcaacaagatcgccaagttccgcaactccaccaaccacaagtacgcgaactacatcatcaagcagtgcctcaagtacaactgcgggcgcatccagatggagctgctcaagggcatcagcaagaacgacaaggtgctcaaggactggacctacttcgacctccaggaaaagattaagaaccaggcggagatccacgggatcgaggtcatcaaggtcgccccggcctacaccagccagcggtgctcccagtgcgggtacatctgcaaggagaaccgctgcacccaggccatgttcgagtgcaagcagtgcggctacaagacgcacgcggactacaacgcggccaagaacatcgccacgtacgacatcgagaacatcatcaacaagcagctcgcggtgcagagcaagctgcacagcaagaagtgcatggaggagtacatcgaggagctgggctacctcgactag

SEQ ID NO: 2032 - DNA, 1356 bp, Unknown
  Bacillus sp. multi
ctcggggtcacgatcaagatcatgaagtaccagatcctctgccccatgaacgtggactggaccatcttcgagaagcacctccggaacctcacctaccaagtgcggacgatcagcaaccgcaccatccagcagctctgggagttcgacgcgctcagcttcgactacttcaaggagcgcggcacgtacccgaccgtccaggatctctacggctgcacgcagaagaagatcgacgggtacatctaccacacgctccagagcaagtaccccgacatccacaaggggaacatgagcaccacgctccaaaagatcatcaagacctggaagtcccgccgcaacgagatccgcaagggcgagatgtccatccccagcttccgcaaccgcatccccatcgacctccacaacaactcggtggacatcacgaaggagaagaacggggactacatcgccgggatctccctgttcagccgcgacttccacaaggagaacgacgacgtgccgaagggcaagatattcgtgaagctggcgacccagaagcagaagtcgatgaaggtcatcctcgaccgcctcatgaaccagacgtactcgaagggcgcgtgcatgatccacaagtacaagaacaagtggtacttgagcattacctacaagttcaacgcgatcaaggagaagaaattcgacaaggagttgatcatgggcatcgacatgggcggcatcaacaccgtgtacttcgcgttcaacgagggcttcatccgctccaacatcaagtccgacgagatcaaggagttcaacgagcgcatccggcagcggcggatcaacctgctcaaccagtccaagtattgctccaacagccggacggggaagggccgcaccaagcgcctccagcccatcgacgtgctgtcgaacaagatcgccaagttccgcaacagcacgaaccacaagtacgccaactacatcatcaagcagtgcctcaagtacaactgcgggcgcatccagatggagctgctcaagggcatctccaagaacgacaaggtgctcaaggactggacctacttcgacctccaggagaagattaagaaccaggccgagatccacggcatcgaggtcatcaaggtcgccccggcctacaccagccagcggtgcagccagtgcgggtacatctgcaaggagaaccggtgcacccaggccatgttcgagtgcaagcagtgcgggtacaagacgcacgccgactacaacgccgccaagaacatcgccacgtacgacatcgagaacatcatcaacaagcagctcgccgtccagtcgaagctgcacagcaagaagtgtatggaggagtacatcgaggagctgggctacctggactga

SEQ ID NO: 2033 - DNA, 1356 bp, Unknown
  Bacillus sp. multi
ctgggcgtgacgatcaagatcatgaagtaccagatcctctgcccgatgaacgtggactggacgatcttcgagaagcacctccgcaacctcacgtaccaggtccggacgatctcgaaccggacgatccagcagctctgggagttcgacgccctgtccttcgactacttcaaggagcgcggcacctacccgacggtccaagacctgtacggctgcacgcagaagaagattgacggctacatctaccacaccctccagagcaagtaccccgacatccacaagggcaacatgagcaccaccctccagaaaatcatcaagacctggaagtcgcgccgcaacgagatccggaagggcgagatgagcatccccagcttccgcaaccgcatccccatcgacctgcacaacaactccgtggacatcacgaaggagaagaatggcgactacatcgccgggatctccctgttcagccgggacttccacaaggagaacgacgacgtgccgaagggcaaaatcttcgtgaagctcgccacgcagaagcagaagtcgatgaaggtgatcctcgaccgcctcatgaaccagacgtacagcaagggcgcgtgcatgatccacaagtacaagaacaagtggtacttgagcatcacctacaagttcaacgcgatcaaggagaagaagttcgacaaggagcttatcatgggcatcgacatgggcggcatcaacaccgtgtacttcgcgttcaacgagggcttcatccgcagcaacatcaagagcgacgagatcaaggagttcaacgagcgcatccgccagcgccgcatcaacctcctgaaccagagcaagtattgctcgaactcgcgcacggggaaggggcgcacgaagcgcctccagcccatcgacgtgctcagcaacaagatcgccaagttccgcaactccaccaaccacaagtacgccaactacatcatcaagcagtgcctcaagtacaactgcgggcgcatccagatggagctgctcaagggcatctccaagaacgacaaggtgctcaaggactggacctacttcgacctccaggaaaagatcaagaatcaggccgagatccacggcatcgaggtcatcaaggtcgcgcccgcctacaccagccagcggtgctcgcagtgcgggtacatctgcaaggagaaccgctgcacccaggccatgttcgagtgcaagcagtgcggctacaagacgcacgcggactacaacgcggccaagaacatcgccacgtacgacatcgagaacatcatcaacaagcagctcgccgtgcagtcgaagctgcacagcaagaagtgtatggaggagtacatcgaggagctgggctacctcgactag

SEQ ID NO: 2034 - DNA, 1356 bp, Unknown
  Bacillus sp. multi
ctgggcgtgacgatcaagatcatgaagtaccagatcctctgccccatgaacgtggactggaccatcttcgagaagcacctccggaacctcacctaccaagtccggacgatcagcaaccgcaccatccagcagctctgggagttcgacgccctctcgttcgactacttcaaggagcgcggcacctaccccacggtccaagacctctatggctgcacgcagaagaagatcgacggctacatctaccacacgctccagtcgaagtaccccgacatccacaaggggaacatgagcacgaccctccagaaaatcatcaagacctggaagtcccggcgcaacgagatccgcaagggcgagatgagcatcccgtccttccggaaccgcatccccatcgacctgcacaacaactcggtggacatcacgaaggagaagaatggcgactacatcgcgggcatcagcctgttctcccgcgacttccacaaggagaacgacgacgtgccgaagggcaagattttcgtgaagctggcgacccagaagcagaagtccatgaaggtgatcctcgaccgcctgatgaaccagacctacagcaagggcgcgtgcatgatccacaagtacaagaacaagtggtacctctccatcacctacaagttcaacgccatcaaggagaagaaattcgacaaggagttaatcatgggcatcgacatgggcgggatcaacaccgtgtacttcgcgttcaacgagggcttcatccggtccaacatcaagagcgacgagatcaaggagttcaacgagcgcatccggcagcgccggatcaacctcctcaaccagtccaagtattgctccaactcccgcaccggcaagggccggaccaagcggctccagcccatcgacgtgctgagcaacaagatcgccaagttccgcaactcgaccaaccacaagtacgccaactacatcatcaagcagtgcctcaagtacaactgcgggcgcatccagatggagctgctcaagggcatctccaagaacgacaaggtgctcaaggactggacgtacttcgacctccaggagaagatcaagaatcaggcggagatccacggcatcgaggtcatcaaggtcgccccggcctacaccagccagcggtgctcccagtgcgggtacatctgcaaggagaaccgctgcacccaggccatgttcgagtgcaagcagtgcggctacaagacgcacgcggactacaacgccgccaagaacatcgccacctacgacatcgagaacatcatcaacaagcagctcgccgtgcagagcaagctgcacagcaagaagtgcatggaggagtacatcgaggagctgggctacctcgactga

SEQ ID NO: 2035 - DNA, 1356 bp, Unknown
  Bacillus sp. multi
ctgggcgtgacgatcaagatcatgaagtaccagatcctctgcccgatgaacgtggactggaccatcttcgagaagcacctccggaacctgacctaccaagtgcggacgatctccaaccgcaccatccagcagctctgggagttcgacgcgctctccttcgactacttcaaggagcgcggcacctaccccacggtccaagacctctacggctgcacgcagaagaaaatagacggctacatctaccacaccctccagtcgaagtacccggacatccacaagggcaacatgagcaccaccctccagaaaatcatcaagacctggaagtcgcgccgcaacgagatccgcaagggcgagatgtccatcccctccttccgcaaccgcatccccatcgacctccacaacaactccgtggacatcatcaaggagaagaatggggactacatcgcggggatctcgctgttcagccgggacttccacaaggagaacggcgacgtgccgaagggcaagatcttcgtcaagctggggacgcagaagcagaagtccatgaaggtgatcctggaccgcctcatcaaccagacctacagcaagggcgcgtgcatgatccacaagtacaagaacaagtggtacttgagcatcacctacaagttcaacgcgatcaaggagaacaagttcgacaaggagcttatcatggggatcgacatgggcgggatcaacaccgtgtacttcgccttcaacgagggcttcatccggtcgaacatcaagagcgacgagatcaagatgttcaacgagcgcatccggcagcgccggatcaacctgctcaagcagagcaagtattgttcgaactcccgcaccgggaagggccggaccaagcgcctccagcccatcgacgtgctctccaacaagatcgccaagttccgcaactccaccaaccacaagtacgccaactacatcatcaagcagtgcctcaagcacaactgcgggcgcatccagatggagctgctcaagggcatctccaagaacgacaaggtgctcaaggactggacctacttcgacctccaggagaagatcaagaatcaggccgagatccacgggatcgaggtcatcaaggtcgcgcccgcctacacctcgcagcggtgctcgcagtgcgggtacatctgcaaggagaaccggtgcacccaggccatgttcgagtgcaagcagtgcgggtacaagacccacgccgactacaacgccgccaagaacatcgccacctacgacatcgagaacatcatcaacaagcagctcgccgtgcagtccaagctccacagcaagaagtgcatggaggagtacatcgaggagctgggctacctcgactag

SEQ ID NO: 2036 - DNA, 1356 bp, Unknown
  Bacillus sp. multi
ctcggcgtgacgatcaagatcatgaagtaccagatcctctgcccgatgaacgtggactggacgatcttcgagaagcacctccgcaacctcacgtaccaagtacggacgatctccaaccggacgatccagcagctctgggagttcgacgccctctcgttcgactacttcaaggagcgcggcacgtaccccaccgtccaggatctgtacgggtgcacgcagaagaagatagacggctacatctaccacaccctccagagcaagtaccccgacatccacaagggcaacatgagcaccacgctccagaaaattatcaagacctggaagtcccggcggaacgagatccggaagggcgagatgagcatcccctccttccgcaaccgcatccccatcgacctccacaacaactccgtggacatcatcaaggagaagaacggggactacatcgcgggcatctccctgttctcgcgcgacttccacaaggagaacggcgacgtgccgaagggcaaaatcttcgtgaagctgggcacgcagaagcagaagtcgatgaaggtgatcctcgaccgcctcatcaaccagacctacagcaagggcgcgtgcatgatccacaagtacaagaacaagtggtatctatccatcacctacaagttcaacgccatcaaggagaacaagttcgacaaggagttgatcatgggcatcgacatgggcggcatcaacaccgtgtacttcgccttcaacgagggcttcatccggagcaacatcaagagcgacgagatcaagatgttcaacgagcgcatccggcagcgccgcatcaacctcctcaagcagtccaagtactgctccaactcgcgcacgggcaaggggcgcacgaagcggctccagcccatcgacgtgctctcgaacaagatcgccaagttccgcaacagcaccaaccacaagtacgcgaactacatcatcaagcagtgcctcaagcacaactgcgggcgcatccagatggagctgctcaagggcatcagcaagaacgacaaggtgctcaaggactggacctacttcgacctccaggagaagatcaagaatcaggccgagatccacgggatcgaggtcatcaaggtggccccggcctacaccagccagcgctgctcgcagtgcggctacatctgcaaggagaaccgctgcacccaggccatgttcgagtgcaagcagtgcggctacaagacccacgcggactacaacgccgccaagaacatcgccacctacgacatcgagaacatcatcaacaagcagctcgccgtgcagagcaagctgcacagcaagaagtgcatggaggagtacatcgaggagctgggctacctcgactga

SEQ ID NO: 2037 - DNA, 1356 bp, Unknown
  Bacillus sp. multi
ctcggcgtgacgatcaagatcatgaagtaccagatcctctgccccatgaacgtggactggaccatcttcgagaagcacctccggaacctcacctaccaagtccggacgatcagcaaccgcaccatccagcagctctgggagttcgacgccctgtcgttcgactacttcaaggagcgcggcacgtaccccaccgtccaagacctctacggctgcacccagaagaagatcgacgggtacatctaccacacgctccagagcaagtaccccgacatccacaagggcaacatgagcacgaccctccagaaaatcatcaagacctggaagtcgcgccgcaacgagatccgcaagggcgagatgtccatcccctccttccggaaccgcatccccatcgacctccacaacaactccgtggacatcatcaaggagaagaacggcgactacatcgcgggcatctccctgttcagccgggacttccacaaggagaacggcgacgtcccgaagggcaaaatcttcgtcaagctgggcacccagaagcagaagtccatgaaggtcatcctggaccgcctcatcaaccagacctacagcaagggcgcgtgcatgatccacaagtacaagaacaagtggtacctctcaattacctacaagttcaacgccatcaaggagaacaagttcgacaaggagttgattatggggatcgacatgggcgggatcaacaccgtgtacttcgccttcaacgaggggttcatccgcagcaacatcaagtcggacgagatcaagatgttcaacgagcgcatccgccagcgccgcatcaacctcctcaagcagagcaagtattgctccaactcgcgcacgggcaagggccgcacgaagcggctccagcccatcgacgtcctctcgaacaagatcgccaagttccgcaacagcaccaaccacaagtacgccaactacatcatcaagcagtgcctcaagcacaactgcgggcgcatccagatggagctgctcaagggcatcagcaagaacgacaaggtgctcaaggactggacgtacttcgacctccaggaaaagattaagaaccaggcggagatccacggcatcgaggtcatcaaggtggccccggcctacaccagccagcggtgcagccagtgcgggtacatctgcaaggagaaccgctgcacccaggccatgttcgagtgcaagcagtgcgggtacaagacccacgcggactacaacgcggccaagaacatcgccacgtacgacatcgagaacatcatcaacaagcagctcgccgtgcagtccaagctccactccaagaagtgcatggaggagtacatcgaggagctgggctacctcgactag

SEQ ID NO: 2038 - DNA, 1356 bp, Unknown
  Bacillus sp. multi
ctgggcgtgaccatcaagatcatgaagtaccagatcctctgcccgatgaacgtggactggaccatcttcgagaagcacctccgcaacctgacgtaccaggtgcggacgatcagcaaccggaccatccagcagctctgggagttcgacgcgctctcgttcgactacttcaaggagcggggcacctacccgaccgtccaagatctatacggctgcacgcagaagaagatcgacggctacatctaccacacgctccagagcaagtaccccgacatccacaagggcaacatgagcacgacgctccagaaaatcatcaagacctggaagtcccggcgcaacgagatccgcaagggcgagatgtccatccccagcttccgcaaccgcatccccatcgacctccacaacaactcggtggacatcatcaaggagaagaatggcgactacatcgcgggcatctccctgttctcccgcgacttccacaaggagaacggggacgtgccgaagggcaaaatcttcgtcaagctcggcacgcagaagcagaagtccatgaaggtcatcctcgaccggctcatcaaccagacctacagcaagggcgcgtgcatgatccacaagtacaagaacaagtggtatctgtcgattacctacaagttcaacgccatcaaggagaacaagttcgacaaggagctaatcatgggcatcgacatgggcggcatcaacaccgtgtacttcgcgttcaacgaggggttcatccggagcaacatcaagagcgacgagatcaagatgttcaacgagcgcatccggcagcggcggatcaacctgctcaagcagagcaagtactgctccaactcccgcacgggcaagggccggaccaagcgcctccagcccatcgacgtgctgtccaacaagatcgccaagttccgcaactcgacgaaccacaagtacgccaactacatcatcaagcagtgcctcaagcacaactgcgggcgcatccagatggagctgctcaagggcatctccaagaacgacaaggtgctcaaggactggacgtacttcgacctccaggaaaagattaagaaccaggccgagatccacggcatcgaggtcatcaaggtcgccccggcctacaccagccagcgctgctcgcagtgcggctacatctgcaaggagaaccgctgcacccaggccatgttcgagtgcaagcagtgcggctacaagacgcacgccgactacaacgcggccaagaacatcgccacctacgacatcgagaacatcatcaacaagcagctcgccgtgcagtcgaagctccacagcaagaagtgcatggaggagtacatcgaggagctgggctacctcgactga

SEQ ID NO: 2039 - DNA, 1356 bp, Unknown
  Bacillus sp. multi
ctgggcgtgacgatcaagatcatgaagtaccagatcctctgcccgatgaacgtggactggacgatcttcgagaagcacctccgcaacctgacgtaccaggtgcggacgatctccaaccgcacgatccagcagctctgggagttcgacgccctctccttcgactacttcaaggagcgcggcacctaccccacggtccaagacctatacggctgcacgcagaagaagatcgacgggtacatctaccacaccctccagagcaagtaccccgacatccacaaggggaacatgagcacgacgctccagaaaatcatcaagacctggaagtcccgccgcaacgagatccgcaagggcgagatgtccatcccgtcgttccgcaaccgcatccccatcgacctccacaacaactccgtggacatcatcaaggagaagaacggggactacatcgccgggatctccctgttctcccgcgacttccacaaggagaacggcgacgtcccgaagggcaaaatctttgtgaagctcggcacccagaagcagaagtcgatgaaggtgatcctcgaccgcctcatcaaccagacgtactcgaagggcgcgtgcatgatccacaagtacaagaacaagtggtacttgagtatcacctacaagttcaacgccatcaaggagaacaagttcgacaaggagctgataatgggcatcgacatgggcggcatcaacaccgtgtacttcgccttcaacgaggggttcatccggagcaacatcaagtcggacgagatcaagatgttcaacgagcgcatccgccagcggcgcatcaacctgctcaagcagagcaagtattgttcgaactcgcgcacgggcaaggggcggacgaagcggctccagcccatcgacgtcctcagcaacaagatcgccaagttccgcaacagcaccaaccacaagtacgcgaactacatcatcaagcagtgcctcaagcacaactgcgggcgcatccagatggagctgctcaagggcatctccaagaacgacaaggtgctcaaggactggacctacttcgacctccaggagaagatcaagaatcaggccgagatccacggcatcgaggtcatcaaggtcgccccggcctacacgagccagcgctgctcgcagtgcggctacatctgcaaggagaaccggtgcacccaggccatgttcgagtgcaagcagtgcggctacaagacgcacgcggactacaacgccgccaagaacatcgccacgtacgacatcgagaacatcatcaacaagcagctcgccgtgcagagcaagctccacagcaagaagtgcatggaggagtacatcgaggagctgggctacctggactga

SEQ ID NO: 2040 - DNA, 1356 bp, Unknown
  Bacillus sp. multi
ctgggcgtcacgatcaagatcatgaagtaccagatcctctgcccgatgaacgtggactggacgatcttcgagaagcacctccggaacctcacgtaccaagtgcggacgatctcgaaccggaccatccagcagctctgggagttcgacgccctctccttcgactacttcaaggagcgcggcacctacccgaccgtccaggatctctacggctgcacgcagaagaaaattgacggctacatctaccacaccctccagtcgaagtaccccgacatccacaagggcaacatgagcaccaccctccagaagattatcaaaacctggaagtcgcgccggaacgagatccgcaagggcgagatgagcatcccctccttccggaaccgcatccccatcgacctccacaacaactccgtggacatcatcaaggagaagaacggcgactacatcgccgggatcagcctcttcctccgggacttccacaaggagaacggcgacgtgccgaagggcaagatattcgtgaagctgggcacccagaagcagaagtccatgaaggtgatcctggaccggctcatcaaccagacgtacagcaagggcgcgtgcatgatccacaagtacaagaacaagtggtacttgtcgatcacctacaagttcaacgcgatcaaggagaacaagttcgacaaggagctgattatgggcatcgacatgggcgggatcaacacggtgtacttcgcgttcaacgagggcttcatccgcagcaacatcaagtccgacgagatcaagatgttcaacgagcgcatccggcagcggcggatcaacctgctcaagcagagcaagtattgctccaacagccggacggggaagggccggaccaagcgcctccagcccatcgacgtcctcagcaacaagatcgccaagttccgcaacagcaccaaccacaagtacgccaactacatcatcaagcagtgcctcaagcacaactgcgggcgcatccagatggagctgctcaaggggatctccaagaacgacaaggtgctcaaggactggacgtacttcgacctccaggagaaaatcaagaaccaggccgagatccacggcatcgaggtcatcaaggtggccccggcctacaccagccagcggtgctcgcagtgcggctacatctgcaaggagaaccggtgcacccaggccatgttcgagtgcaagcagtgcggctacaagacccacgccgactacaacgccgccaagaacatcgccacctacgacatcgagaacatcatcaacaagcagctcgccgtgcagtcgaagctccacagcaagaagtgcatggaggagtacatcgaggagctgggctacctcgactga

SEQ ID NO: 2041 - DNA, 1356 bp, Unknown
  Bacillus sp. multi
ctcggcgtcacgatcaagatcatgaagtaccagatcctctgccccatgaacgtggactggaccatcttcgagaagcacctccgcaacctgacctaccaagtccggacgatctccaaccggacgatccagcagctctgggagttcgacgccctctcgttcgactacttcaaggagcggggcacgtaccccacggtccaagacctctacggctgcacccaaaagaagatagacggctacatctaccacaccctccagagcaagtaccccgacatccacaagggcaacatgagcaccaccctccagaagatcattaagacctggaagtcccgccgcaacgagatccgcaagggcgagatgtccatcccgtccttccgcaaccgcatccccatcgacctccacaacaacagcgtggacatcatcaaggagaagaatggggactacatcgcgggcatctccctcttcctccgcgacttccacaaggagaacggcgacgtcccgaagggcaaaatcttcgtgaagctgggcacccagaagcagaagtccatgaaggtgatcctcgaccgcctcatcaaccagacgtactcgaagggcgcgtgcatgatccacaagtacaagaacaagtggtacttgagcatcacctacaagttcaacgcgatcaaggagaacaagttcgacaaggagcttatcatggggatcgacatgggcggcatcaacacggtgtacttcgcgttcaacgagggcttcatccggtccaacatcaagtccgacgagatcaagatgttcaacgagcgcatccggcagcgccggatcaacctgctcaagcagagcaagtattgctccaactcgcgcaccggcaaggggcgcaccaagcgcctccagcccatcgacgtcctcagcaacaagatcgccaagttccgcaacagcacgaaccacaagtacgcgaactacatcatcaagcagtgcctcaagcacaactgcgggcgcatccagatggagctgctcaaggggatcagcaagaacgacaaggtgctcaaggactggacctacttcgacctccaggagaagatcaagaaccaggccgagatccacggcatcgaggtcatcaaggtcgccccggcctacacctcgcagcggtgctcccagtgcgggtacatctgcaaggagaaccgctgcacccaggccatgttcgagtgcaagcagtgcggctacaagacccacgccgactacaacgccgccaagaacatcgccacgtacgacatcgagaacatcatcaacaagcagctcgccgtgcagtccaagctccacagcaagaaatgcatggaggagtacatcgaggagctgggctacctcgactga

SEQ ID NO: 2042 - DNA, 1356 bp, Unknown
  Bacillus sp. multi
ctgggcgtcaccatcaagatcatgaagtaccagatcctctgccccatgaacgtggactggaccatcttcgagaagcacctccgcaacctcacctaccaagtccggacgatctccaaccgcacgatccagcagctctgggagttcgacgccctgtcgttcgactacttcaaggagcgcggcacctacccgacggtccaggatctgtacggctgcacccagaagaagatcgacggctacatctaccacaccctccagagcaagtaccccgacatccacaagggcaacatgagcaccaccctccagaaaatcatcaagacctggaagtcccgccggaacgagatccgcaagggcgagatgtcgatcccgtccttccgcaaccgcatccccatcgacctccacaacaactccgtggacatcatcaaggagaagaatggggactacatcgcgggcatcagcctgttcctccgcgacttccacaaggagaacggggacgtgccgaagggcaagatattcgtgaagctgggcacccagaagcagaagtcgatgaaggtcatcctcgaccggctcatcaaccagacctacagcaagggcgcgtgcatgatccacaagtacaagaacaagtggtacttgtccatcacctacaagttcaacgcgatcaaggagaacaagttcgacaaggagttaatcatgggcatcgacatgggcggcatcaacaccgtgtacttcgccttcaacgaggggttcatccggtccaacatcaagagcgacgagatcaagatgttcaacgagcgcatccgccagcgccggatcaacctcctcaagcagtccaagtattgctcgaactcgcggacggggaagggccggacgaagcgcctccagcccatcgacgtgctctccaacaagatcgccaagttccgcaacagcaccaaccacaagtacgccaactacatcatcaagcagtgcctcaagcacaactgcgggcgcatccagatggagctgctcaagggcatcagcaagaacgacaaggtgctcaaggactggacctacttcgacctccaggagaaaatcaagaatcaggccgagatccacggcatcgaggtcatcaaggtcgccccggcctacaccagccagcgctgctcgcagtgcggctacatctgcaaggagaaccggtgcacccaggccatgttcgagtgcaagcagtgcggctacaagacccacgcggactacaacgcggccaagaacatcgccacgtacgacatcgagaacatcatcaacaagcagctcgcggtgcagtccaagctgcacagcaagaagtgcatggaggagtacatcgaggagctgggctacctcgactag

SEQ ID NO: 2043 - DNA, 1356 bp, Unknown
  Bacillus sp. multi
ctcggcgtcaccatcaagatcatgaagtaccagatcctctgcccgatgaacgtggactggaccatcttcgagaagcacctccgcaacctgacctaccaagtccggacgatctccaaccggaccatccagcagctctgggagttcgacgccctcagcttcgactacttcaaggagcgcggcacctacccgaccgtccaggatctctacgggtgcacgcagaagaagatcgacggctacatctaccacaccctccagagcaagtaccccgacatccacaaggggaacatgagcaccacgctccagaagatcatcaagacctggaagtcccgccgcaacgagatccgcaagggcgagatgagcatcccctccttccgcaaccgcatccccatcgacctccacaacaactccgtggacatcatcaaggagaagaatggcgactacatcgcggggatctccctgttcctccgcgacttccacaaggagaacggcgacgtgccgaagggcaaaatcttcgtgaagctcggcacccagaagcagaagtccatgaaggtgatcctggaccggctcatcaaccagacctactcgaagggcgcgtgcatgatccacaagtacaagaacaagtggtatctgagcatcacctacaagttcaacgcgatcaaggagaacaagttcgacaaggagctgataatggggatcgacatgggcggcatcaacacggtgtacttcgccttcaacgagggcttcatccggtcgaacatcaagtccgacgagatcaagatgttcaacgagcgcatccgccagcgccgcatcaacctcctcaagcagagcaagtattgttcgaactcccgcaccgggaagggccggacgaagcgcctccagcccatcgacgtcctgagcaacaagatcgccaagttccgcaacagcaccaaccacaagtacgcgaactacatcatcaagcagtgcctcaagcacaactgcgggcgcatccagatggagctgctcaaggggatcagcaagaacgacaaggtgctcaaggactggacgtacttcgacctccaggaaaagattaagaatcaggcggagatccacggcatcgaggtcatcaaggtcgccccggcctacaccagccagcggtgctcgcagtgcgggtacatctgcaaggagaaccgctgcacccaggccatgttcgagtgcaagcagtgcgggtacaagacccacgccgactacaacgccgccaagaacatcgccacctacgacatcgagaacatcatcaacaagcagctcgcggtccagtcgaagctccactccaagaagtgcatggaggagtacatcgaggagctgggctacctcgactga

SEQ ID NO: 2044 - DNA, 1356 bp, Unknown
  Bacillus sp. multi
ctcggcgtgaccatcaagatcatgaagtaccagatcctctgccccatgaacgtggactggacgatcttcgagaagcacctccgcaacctgacgtaccaagtgcggacgatctccaaccggaccatccagcagctctgggagttcgacgcgctgtccttcgactacttcaaggagcgcggcacgtacccgaccgtccaggacttatacggctgcacccagaagaagatagacggctacatctaccacaccctccagagcaagtacccggacatccacaagggcaacatgagcacgaccctccagaagatcatcaagacctggaagtcccgccgcaacgagatccgcaagggcgagatgtcgatcccctccttccgcaaccgcatccccatcgacctccacaacaacagcgtggacatcatcaaggagaagaatggcgactacatcgcggggatctccctcttcctccgcgacttccacaaggagaacggcgacgtcccgaagggcaaaatcttcgtgaagctcgggacgcagaagcagaagtccatgaaggtgatcctggaccgcctcatcaaccagacctacagcaagggcgcgtgcatgatccacaagtacaagaacaagtggtacctatccatcacatacaagttcaacgcgatcaaggagaacaagttcgacaaggagctaatcatgggcatcgacatgggcggcatcaacacggtgtacttcgcgttcaacgagggcttcatccggtcgaacatcaagagcgacgagatcaagatgttcaacgagcgcatccgccagcgccggatcaacctcctcaagcagtccaaatactgttccaactcccggacggggaagggccggaccaagcggctccagcccatcgacgtgctcagcaacaagatcgccaagttccgcaacagcacgaaccacaagtacgccaactacatcatcaagcagtgcctcaagcacaactgcgggcgcatccagatggagctgctcaagggcatctccaagaacgacaaggtgctcaaggactggacctacttcgacctccaggagaagatcaagaaccaggccgagatccacgggatcgaggtcatcaaggtcgccccggcctacacctcccagcgctgctcgcagtgcggctacatctgcaaggagaaccgctgcacccaggccatgttcgagtgcaagcagtgcgggtacaagacccacgcggactacaacgcggccaagaacatcgccacgtacgacatcgagaacatcatcaacaagcagctcgccgtgcagtccaagctgcactccaagaagtgcatggaggagtacatcgaggagctgggctacctcgactga

SEQ ID NO: 2045 - DNA, 1356 bp, Unknown
  Bacillus sp. multi
ctcggcgtgaccatcaagatcatgaagtaccagatcctctgcccgatgaacgtggactggacgatcttcgagaagcacctccgcaacctgacgtaccaagttcggacgatctccaaccgcaccatccagcagctctgggagttcgacgcgctctccttcgactacttcaaggagcggggcacgtaccccacggtccaggatctctacggctgcacgcaaaagaaaatcgacggctacatctaccacacgctccagagcaagtaccccgacatccacaaggggaacatgagcaccacgctccagaaaatcatcaagacctggaagtcccggcgcaacgagatccggaagggcgagatgtcgatcccctccttccgcaaccgcatccccatcgacctccacaacaacagcgtggacatcatcaaggagaagaacggcgactacatcgcggggatcagcctgttcagccgcgacttccacaaggagaacggcgacgtcccgaagggcaaaatcttcgtcaagctcggcacccagaagcagaagtccatgaaggtgatcctggaccgcctcatcaaccagacctactcgaagggcgcgtgcatgatccacaagtacaagaacaagtggtacctctccatcacctacaagttcaacgcgatcaaggagaacaagttcgacaaggagcttatcatgggcatcgacatgggcgggatcaacacggtgtacttcgccttcaacgagggcttcatccgctccaacatcaagtccgacgagatcaagatgttcaacgagcgcatccgccagcgccggatcaacctcctcaagcagagcaagtactactccaactcgcgcaccggcaagggccgcaccaagcgcctccagcccatcgacgtcctgtcgaacaagatcgccaagttccgcaactcgaccaaccacaagtacgcgaactacatcatcaagcagtgcctcaagcacaactgcgggcgcatccagatggagctgctcaaggggatcagcaagaacgacaaggtgctcaaggactggacctacttcgacctccaggagaagattaagaaccaggccgagatccacgggatcgaggtcatcaaggtcgccccggcctacaccagccagcgctgctcgcagtgcggctacatctgcaaggagaaccgctgcacccaggccatgttcgagtgcaagcagtgcggctacaagacccacgcggactacaacgcggccaagaacatcgccacgtacgacatcgagaacatcatcaacaagcagctcgccgtgcagtccaagctccactccaagaagtgtatggaggagtacatcgaggagctgggctacctcgactga

SEQ ID NO: 2046 - DNA, 1356 bp, Unknown
  Bacillus sp. multi
ctgggcgtcacgatcaagatcatgaagtaccagatcctctgcccgatgaacgtggactggaccatcttcgagaagcacctccgcaacctcacgtaccaagtacggacgatctcgaaccggaccatccagcagctctgggagttcgacgccctctccttcgactacttcaaggagcgcggcacctacccgaccgtccaggacctctacggctgcacgcagaagaagatagacgggtacatctaccacaccctccagagcaagtaccccgacatccacaaggggaacatgagcaccacgctccagaaaatcatcaagacctggaagtcccgccgcaacgagatccgcaagggcgagatgtccatcccgtcgttccgcaaccgcatccccatcgacctccacaacaactcggtggacatcatcaaggagaagaacggcgactacatcgcgggcatctccctgttctcgcgcgacttccacaaggagaacggcgacgtgccgaagggcaaaatcttcgtgaagctcggcacccagaagcagaagtcgatgaaggtgatcctcgaccgcctcatcaaccagacctactcgaagggcgcgtgcatgatccacaagtacaagaacaagtggtatctgagcatcacctacaagttcaacgcgatcaaggagaacaagttcgacaaggagcttatcatggggatcgacatgggcgggatcaacaccgtgtacttcgcgttcaacgagggcttcatccggtccaacatcaagagcgacgagatcaagatgttcaacgagcgcatccgccagcgccggatcaacctgctcaagcagagcaagtattatagcaacagccgcaccggcaagggccgcaccaagcgcctccagcccatcgacgtgctgtccaacaagatcgccaagttccgcaacagcaccaaccacaagtacgcgaactacatcatcaagcagtgcctcaagcacaactgcgggcgcatccagatggagctgctcaaggggatctccaagaacgacaaggtgctcaaggactggacgtacttcgacctccaggaaaagatcaagaaccaggcggagatccacggcatcgaggtcatcaaggtggccccggcctacacctcgcagcggtgctcgcagtgcggctacatctgcaaggagaaccggtgcacccaggccatgttcgagtgcaagcagtgcgggtacaagacccacgcggactacaacgccgccaagaacatcgccacctacgacatcgagaacatcatcaacaagcagctcgccgtgcagtcgaagctgcactccaagaagtgcatggaggagtacatcgaggagctgggctacctggactga

SEQ ID NO: 2047 - DNA, 1356 bp, Unknown
  Bacillus sp. multi
ctcggggtgaccatcaagatcatgaagtaccagatcctctgcccgatgaacgtggactggacgatcttcgagaagcacctccggaacctcacgtaccaagtgcggacgatctccaaccgcacgatccagcagctctgggagttcgacgccctgtcgttcgactacttcaaggagcgcgggacgtacccgaccgtccaagacctgtacggctgcacgcagaagaaaatcgacggctacatctaccacacgctccagagcaagtacccggacatccacaagggcaacatgagcacgacgctccagaaaatcatcaagacctggaagtcccggcgcaacgagatccgcaagggcgagatgtccatcccgtccttccgcaaccgcatccccatcgacctgcacaacaacagcgtggacatcatcaaggagaagaacggcgactacatcgccgggatcagcctgttctcccgcgacttccacaaggagaacggcgacgtgccgaagggcaagatattcgtcaagctcggcacccagaagcagaagtccatgaaggtcatcctggaccgcctcatcaaccagacctacagcaagggcgcgtgcatgatccacaagtacaagaacaagtggtacttgagcatcacctacaagttcaacgcgatcaaggagaacaagttcgacaaggagctgataatgggcatcgacatgggcgggatcaacaccgtgtacttcgccttcaacgaggggttcatccgctccaacatcaagtcggacgagatcaagatgttcaacgagcgcatccgccagcggcggatcaacctcctcaagcagtccaagtactacagcaactcccggacggggaaggggcgcacgaagcgcctccagcccatcgacgtcctcagcaacaagatcgccaagttccgcaacagcaccaaccacaagtacgccaactacatcatcaagcagtgcctcaagcacaactgcgggcgcatccagatggagctgctcaagggcatctccaagaacgacaaggtgctcaaggactggacgtacttcgacctccaggagaaaattaagaatcaggcggagatccacggcatcgaggtcatcaaggtcgccccggcctacacgagccagcgctgctcccagtgcggctacatctgcaaggagaaccgctgcacccaggccatgttcgagtgcaagcagtgcgggtacaagacccacgccgactacaacgccgccaagaacatcgccacgtacgacatcgagaacatcatcaacaagcagctcgccgtccagagcaagctgcactccaagaagtgcatggaggagtacatcgaggagctgggctacctcgactag

SEQ ID NO: 2048 - DNA, 1356 bp, Unknown
  Bacillus sp. multi
ctgggcgtgacgatcaagatcatgaagtaccagatcctctgccccatgaacgtggactggacgatcttcgagaagcacctccgcaacctgacctaccaagtgcggacgatctcgaaccggacgatccagcagctctgggagttcgacgccctgagcttcgactacttcaaggagcgcggcacgtacccgaccgtccaagacctgtacggctgcacgcagaagaagatcgacggctacatctaccacaccctccagagcaagtacccggacatccacaaggggaacatgagcacgaccctccaaaagatcattaagacctggaagtcccggcgcaacgagatccgcaagggcgagatgagcatcccctccttccggaaccgcatccccatcgacctccacaacaactcggtggacatcatcaaggagaagaacggggactacatcgcggggatcagcctgttcagccgcgacttccacaaggagaacggggacgtgccgaagggcaagatcttcgtaaagctcggcacgcagaagcagaagtccatgaaggtgatcctggaccgcctcatcaaccagacgtacagcaagggcgcgtgcatgatccacaagtacaagaacaagtggtacctttcgatcacgtacaagttcaacgcgatcaaggagaacaagttcgacaaggagttaatcatgggcatcgacatgggcggcatcaacaccgtgtacttcgccttcaacgagggcttcatccggtccaacatcaagtcggacgagatcaagatgttcaacgagcgcatccgccagcgccggatcaacctcctcaagcagagcaagtattacagcaactcgcgcaccggcaagggccgcaccaagcggctccagcccatcgacgtcctctccaacaagatcgccaagttccgcaactcgaccaaccacaagtacgccaactacatcatcaagcagtgcctcaagcacaactgcgggcgcatccagatggagctgctcaagggcatctccaagaacgacaaggtgctcaaggactggacgtacttcgacctccaggagaagatcaagaatcaggcggagatccacggcatcgaggtcatcaaggtggccccggcctacacctcgcagcggtgctcgcagtgcgggtacatctgcaaggagaaccgctgcacccaggccatgttcgagtgcaagcagtgcgggtacaagacgcacgccgactacaacgccgccaagaacatcgccacctacgacatcgagaacatcatcaacaagcagctcgcggtccagagcaagctccacagcaagaagtgcatggaggagtacatcgaggagctgggctacctggactga

SEQ ID NO: 2049 - DNA, 1356 bp, Unknown
  Bacillus sp. multi
ctgggcgtgacgatcaagatcatgaagtaccagatcctctgcccgatgaacgtggactggaccatcttcgagaagcacctccggaacctgacctaccaggtgcggacgatctccaaccgcacgatccagcagctctgggagttcgacgccctcagcttcgactacttcaaggagcgcggcacgtaccccaccgtccaagatctctacgggtgcacgcagaagaaaatcgacgggtacatctaccacaccctccagagcaagtacccggacatccacaaggggaacatgagcacgaccctccagaaaatcatcaagacctggaagtcccgccggaacgagatccgcaagggcgagatgtccatcccgagcttccgcaaccgcatccccatcgacctccacaacaactcggtggacatcatcaaggagaagaatggggactacatcgcgggcatcagcctgttcagccgcgacttccacaaggagaacggcgacgtcccgaagggcaagatattcgtgaagctgggcacccagaagcagaagtccatgaaggtgatcctggaccggctcatcaaccagacgtacagcaagggcgcgtgcatgatccacaagtacaagaacaagtggtacttgtccatcacctacaagttcaacgccatcaaggagaacaagttcgacaaggaactcataatgggcatcgacatgggcggcatcaacaccgtgtacttcgcgttcaacgagggcttcatccgctccaacatcaagtcggacgagatcaagatgttcaacgagcgcatccgccagcggcgcatcaacctcctcaagcagagcaagtattactccaactcccgcacgggcaagggccgcacgaagcgcctccagcccatcgacgtgctgtcgaacaagatcgccaagttccgcaacagcacgaaccacaagtacgcgaactacatcatcaagcagtgcctcaagcacaactgcgggcgcatccagatggagctgctcaagggcatcagcaagaacgacaaggtgctcaaggactggacgtacttcgacctccaggagaagatcaagaaccaggcggagatccacgggatcgaggtcatcaaggtcgcgcccgcctacacgagccagcggtgctcccagtgcggctacatctgcaaggagaaccggtgcacccaggccatgttcgagtgcaagcagtgcggctacaagacgcacgccgactacaacgcggccaagaacatcgccacctacgacatcgagaacatcatcaacaagcagctcgccgtgcagagcaagctgcacagcaagaagtgcatggaggagtacatcgaggagctgggctacctcgactga

SEQ ID NO: 2050 - DNA, 1356 bp, Unknown
  Bacillus sp. multi
ctcggggtgaccatcaagatcatgaagtaccagatcctctgcccgatgaacgtggactggaccatcttcgagaagcacctccgcaacctcacctaccaagttcggacgatctcgaaccggaccatccagcagctctgggagttcgacgccctgagcttcgactacttcaaggagcgcggcacgtacccgaccgtccaagatctctacggctgcacccagaagaagatagacggctacatctaccacacgctccagtcgaagtacccggacatccacaaggggaacatgagcaccacgctccagaaaatcattaagacctggaagtcccgccggaacgagatccggaagggcgagatgtcgatcccctccttccgcaaccgcatccccatcgacctccacaacaacagcgtggacatcatcaaggagaagaacggcgactacatcgcggggatcagcctgttcagccgcgacttccacaaggagaacggcgacgtgccgaagggcaagattttcgtcaagctggggacgcagaagcagaagtccatgaaggtcatcctcgaccgcctcatcaaccagacctactcgaagggcgcgtgcatgatccacaagtacaagaacaagtggtacttgagcatcacgtacaagttcaacgccatcaaggagaacaagttcgacaaggagcttatcatgggcatcgacatgggcgggatcaacaccgtgtacttcgccttcaacgagggcttcatccggtcgaacatcaagtccgacgagatcaagatgttcaacgagcgcatccgccagcgccggatcaacctcctcaagcagtccaagtattgctccaactcgcgcaccgggaagggccgcacgaagcgcctccagcccatcgacgtcctctccaacaagatcgccaagttccgcaactccacgaaccacaagtacgccaactacatcatcaagcagtgcctcaagcacaactgcgggcgcatccagatggagctgctcaagggcatcagcaagaacgacaaggtgctcaaggactggacgtacttcgacctccaggagaagatcaagaaccaggcggagatccaccggatcgaggtcatcaaggtcgccccggcctacaccagccagcgctgctcccagtgcggctacatctgcaaggagaaccggtgcacccaggccatgttcgagtgcaagcagtgcggctacaagacccacgcggactacaacgccgccaagaacatcgccacctacgacatcgagaacatcatcaacaagcagctcgccgtgcagtcgaagctgcacagcaagaagtgcatggaggagtacatcgaggagctgggctacctcgactag

SEQ ID NO: 2051 - DNA, 1356 bp, Unknown
  Bacillus sp. multi
ctgggcgtgacgatcaagatcatgaagtaccagatcctctgcccgatgaacgtggactggaccatcttcgagaagcacctccggaacctcacgtaccaagtgcggacgatcagcaaccggaccatccagcagctctgggagttcgacgccctctccttcgactacttcaaggagcgcggcacgtaccccaccgtccaagacctgtacggctgcacccagaagaaaatcgacggctacatctaccacacgctccagagcaagtaccccgacatccacaaggggaacatgagcacgacgctccagaagataatcaagacctggaagtcccgccgcaacgagatccgcaagggcgagatgagcatcccctccttccgcaaccgcatccccatcgacctccacaacaactccgtggacatcatcaaggagaagaatggcgactacatcgcgggcatctccctgttctcccgcgacttccacaaggagaacggcgacgtcccgaagggcaaaatcttcgtgaagctcggcacccagaagcagaagtccatgaaggtcatcctcgaccggctcatcaaccagacgtacagcaagggcgcgtgcatgatccacaagtacaagaacaagtggtatctcagcatcacctacaagttcaacgccatcaaggagaacaagttcgacaaggaactgattatgggcatcgacatgggcggcatcaacaccgtgtacttcgcgttcaacgagggcttcatccgctccaacatcaagtcggacgagatcaagatgttcaacgagcgcatccggcagcggcgcatcaacctcctcaagcagagcaagtattgctccaactcgcggacgggcaagggccgcacgaagcgcctccagcccatcgacgtcctctccaacaagatcgccaagttccgcaacagcacgaaccacaagtacgcgaactacatcatcaagcagtgcctcaagcacaactgcgggcgcatccagatggagctgctcaagggcatctccaagaacgacaaggtgctcaaggactggacgtacttcgacctccaggagaagattaagaaccaggccgagatccaccgcatcgaggtcatcaaggtcgcgcccgcctacacctcccagcgctgctcgcagtgcgggtacatctgcaaggagaaccggtgcacccaggccatgttcgagtgcaagcagtgcggctacaagacccacgcggactacaacgcggccaagaacatcgccacgtacgacatcgagaacatcatcaacaagcagctcgccgtgcagagcaagctccactccaagaagtgcatggaggagtacatcgaggagctgggctacctcgactga

SEQ ID NO: 2052 - DNA, 1356 bp, Unknown
  Bacillus sp. multi
ctcggggtcaccatcaagatcatgaagtaccagatcctctgcccgatgaacgtggactggacgatcttcgagaagcacctccggaacctcacctaccaagtccggacgatctccaaccggacgatccagcagctctgggagttcgacgccctctccttcgactacttcaaggagcggggcacgtacccgaccgtccaagatctctacggctgcacccagaagaagatcgacgggtacatctaccacacgctccagagcaagtaccccgacatccacaaggggaacatgagcaccaccctccagaagatcatcaagacctggaagtcgcggcgcaacgagatccgcaagggcgagatgtcgatcccgagcttccgcaaccgcatccccatcgacctccacaacaacagcgtggacatcatcaaggagaagaacggcgactacatcgcggggatctcgctgttcagccgggacttccacaaggagaacggggacgtgccgaagggcaagatcttcgttaagctggggacgcagaagcagaagtcgatgaaggtgatcctggaccgcctcatcaaccagacctacagcaagggcgcgtgcatgatccacaagtacaagaacaagtggtacttgagtatcacctacaagttcaacgccatcaaggagaacaagttcgacaaggagttaatcatggggatcgacatgggcggcatcaacacggtgtacttcgcgttcaacgaggggttcatccggagcaacatcaagagcgacgagatcaagatgttcaacgagcgcatccgccagcggcgcatcaacctcctcaagcagagcaaatactgctccaactcccgcacggggaagggccggacgaagcgcctccagcccatcgacgtgctgtccaacaagatcgccaagttccgcaacagcacgaaccacaagtacgccaactacatcatcaagcagtgcctcaagcacaactgcgggcgcatccagatggagctgctcaagggcatctccaagaacgacaaggtgctcaaggactggacctacttcgacctccaggagaaaatcaagaaccaggcggagatccaccgcatcgaggtcatcaaggtcgccccggcctacacgagccagcgctgctcccagtgcggctacatctgcaaggagaaccgctgcacccaggccatgttcgagtgcaagcagtgcgggtacaagacgcacgcggactacaacgcggccaagaacatcgccacctacgacatcgagaacatcatcaacaagcagctcgcggtgcagtcgaagctccactccaagaaatgcatggaggagtacatcgaggagctgggctacctggactga

SEQ ID NO: 2053 - DNA, 1356 bp, Unknown
  Bacillus sp. multi
ctcggcgtcaccatcaagatcatgaagtaccagatcctctgcccgatgaacgtggactggacgatcttcgagaagcacctccgcaacctcacgtaccaagttcggacgatcagcaaccgcacgatccagcagctctgggagttcgacgcgctgtcgttcgactacttcaaggagcgcggcacctacccgaccgtccaggacttgtacgggtgcacgcagaagaagatcgacggctacatctaccacaccctccagtcgaagtaccccgacatccacaagggcaacatgagcaccacgctccagaaaatcatcaagacctggaagtcccgccggaacgagatccggaagggcgagatgtcgatcccgagcttccggaaccgcatccccatcgacctgcacaacaactccgtggacatcatcaaggagaagaatggcgactacatcgcgggcatcagcctgttcagccgcgacttccacaaggagaacggggacgtgccgaagggcaagatattcgtgaagctgggcacgcagaagcagaagtcgatgaaggtgatcctggaccggctcatcaaccagacctactcgaagggcgcgtgcatgatccacaagtacaagaacaagtggtatttgagcatcacgtacaagttcaacgcgatcaaggagaacaagttcgacaaggagctcataatggggatcgacatgggcgggatcaacacggtgtacttcgccttcaacgaggggttcatccgcagcaacatcaagagcgacgagatcaagatgttcaacgagcgcatccgccagcggcgcatcaacctcctcaagcagtccaagtactgctccaactcgcgcaccggcaagggccgcaccaagcggctccagcccatcgacgtgctgagcaacaagatcgccaagttccgcaacagcaccaaccacaagtacgcgaactacatcatcaagcagtgcctcaagcacaactgcgggcgcatccagatggagctgctcaagggcatctccaagaacgacaaggtgctcaaggactggacctacttcgacctccaggaaaagattaagaaccaggcggagatccaccgcatcgaggtcatcaaggtcgccccggcctacacctcccagcggtgctcccagtgcgggtacatctgcaaggagaaccggtgcacccaggccatgttcgagtgcaagcagtgcgggtacaagacccacgcggactacaacgccgccaagaacatcgccacctacgacatcgagaacatcatcaacaagcagctcgccgtgcagagcaagctgcacagcaagaagtgcatggaggagtacatcgaggagctgggctacctggactga

SEQ ID NO: 2054 - DNA, 1356 bp, Unknown
  Bacillus sp. multi
ctgggcgtgacgatcaagatcatgaagtaccagatcctctgcccgatgaacgtggactggaccatcttcgagaagcacctccgcaacctgacgtaccaggttcggacgatctccaaccgcaccatccagcagctctgggagttcgacgccctgtcgttcgactacttcaaggagcgcggcacgtaccccacggtccaggatctctacggctgcacgcagaagaaaatcgacggctacatctaccacaccctccagtcgaagtaccccgacatccacaagggcaacatgagcaccacgctccagaaaatcatcaagacctggaagtcccgccgcaacgagatccgcaagggcgagatgtccatcccgtccttccgcaaccgcatccccatcgacctccacaacaactccgtggacatcatcaaggagaagaacggcgactacatcgcgggcatctccctgttctcccgcgacttccacaaggagaacggcgacgtcccgaagggcaagatattcgtgaagctcggcacccagaagcagaagtccatgaaggtgatcctggaccggctcatcaaccagacctacagcaagggcgcgtgcatgatccacaagtacaagaacaagtggtacttgtcgatcacctacaagttcaacgccatcaaggagaacaagttcgacaaggaactaatcatgggcatcgacatgggcggcatcaacaccgtgtacttcgcgttcaacgagggcttcatccgcagcaacatcaagtccgacgagatcaagatgttcaacgagcgcatccgccagcgccggatcaacctgctcaagcagtccaagtattgttccaacagccggacgggcaagggccgcaccaagcgcctccagcccatcgacgtgctgagcaacaagatcgccaagttccgcaacagcaccaaccacaagtacgccaactacatcatcaagcagtgcctcaagcacaactgcgggcgcatccagatggagctgctcaagggcatctccaagaacgacaaggtgctcaaggactggacctacttcgacctccaggaaaagatcaagaaccaggccgagatccaccgcatcgaggtcatcaaggtggccccggcctacacgagccagcgctgctcgcagtgcggctacatctgcaaggagaaccgctgcacccaggccatgttcgagtgcaagcagtgcggctacaagacccacgcggactacaacgccgccaagaacatcgccacgtacgacatcgagaacatcatcaacaagcagctcgcggtgcagagcaagctccacagcaagaagtgcatggaggagtacatcgaggagctgggctacctcgactag

SEQ ID NO: 2055 - DNA, 1335 bp, Unknown
  Bacillus sp. multi
atgaagtaccagatcctctgcccgatgaacgtggactggaccatcttcgagaagcacctccggaacctgacgtaccaagtgcggacgatctccaaccgcaccatccagcagctctgggagttcgacgccctctcgttcgactacttcaaggcgcgcggcacgtacccgacggtccaggatctatacggctgcacccagaagaagatcgacggctacatctaccacaccctccagagcaagtacccggacatccacaagggcaacatgagcaccacgctccagaaaatcattaagacctggaagtcccggcgcaacgagatccgcaagggcgagatgtccatcccgagcttccgcaaccgcatccccatcgacctgcacaacaacagcgtggacatcacgaaggagaagaatggggactacatcgcggggatctccctgttctcgcgcgacttccacaaggagaacgacgacgtgccgaagggcaagatcttcatcaagctcgccacccagaagcagaagtccatgaaggtcatcctggaccggctcatcaaccagacctacagcaagggcgcgtgcatgatccacaagtacaagaacaagtggtatctctcgatcacctacaagttcaacgcgatcaaggagaacaagttcgacaaggagctcatcatgggcatcgacatgggcggcatcaacaccgtgtacttcgccttcaacgaggggttcatccgctccaacatcaagtccgacgagatcaagaccttcaacgagcgcatccgccagcggcgcatcaacctcctcaagcagagcaaatactgctccaactcccgcacgggcaagggccgcaccaagcggctccagcccatcgacgtgctgagcaacaagatcgccaagttccgcaacagcaccaaccacaagtacgcgaactacatcatcaagcagtgcctcaagtacaactgcgggcgcatccagatggagctgctcaaggggatcagcaagaacgacaaggtgctcaacgactggacctacttcgacctccaggagaaaatcaagaatcaggcggagatccacggcatcgaggtcatcaagatcgccccggcctacacctcccagcggtgctcgcagtgcggctacatctgcaaggagaaccgctgcacccaggcgatgttcgagtgcaagcagtgcgggtacaagacccacgccgactacaacgccgccaagaacatcagcacgtacgacatcgagaacatcatcaacaagcagctcgccgtgcagtcgaagctccacagcaagaagtgcatggccgagtacatggaggagctgggctacctggactga

SEQ ID NO: 2056 - DNA, 1335 bp, Unknown
  Bacillus sp. multi
atgaagtaccagatcctctgccccatgaacgtggactggaccatcttcgagaagcacctccggaacctcacgtaccaggtgcggacgatcagcaaccggacgatccagcagctctgggagttcgacgccctctcgttcgactacttcaaggcgcgcgggacgtaccccacggtccaagacctgtacggctgcacccagaagaagatagacggctacatctaccacacgctccagagcaagtacccggacatccacaagggcaacatgagcaccacgctccagaaaatcatcaagacctggaagtcccgccggaacgagatccgcaagggcgagatgtccatcccctccttccgcaaccgcatccccatcgacctccacaacaacagcgtggacatcacgaaggagaagaacggcgactacatcgcgggcatcagcctgttcagccgcgacttccacaaggagaacgacgacgtgccgaagggcaaaatcttcatcaagctggccacccagaagcagaagtccatgaaggtgatcctcgaccggctcatcaaccagacctacagcaagggcgcgtgcatgatccacaagtacaagaacaagtggtatctctccatcacctacaagttcaacgcgatcaaggagaacaagttcgacaaggaacttatcatgggcatcgacatgggcggcatcaacaccgtgtacttcgccttcaacgaggggttcatccgctccaacatcaagagcgacgagatcaagaccttcaacgagcgcatccggcagcgccggatcaacctgctcaagcagagcaaatactgttccaacagccgcaccgggaagggccgcaccaagcggctccagcccatcgacgtcctctcgaacaagatcgccaagttccgcaactcgacgaaccacaagtacgcgaactacatcatcaagcagtgcctcaagtacaactgcgggcgcatccagatggagctgctcaagggcatctccaagaacgacaaggtgctgaacgactggacgtacttcgacctccaggagaagatcaagaaccaggccgagatccacggcatcgaggtcatcaagatcgccccggcctacaccagccagcgctgctcccagtgcggctacatctgcaaggagaaccggtgcacccaggccatgttcgagtgcaagcagtgcggctacaagacgcacgccgactacaacgccgccaagaacatctcgacgtacgacatcgagaacatcatcaacaagcagctcgccgtgcagtcgaagctgcacagcaagaagtgtatggcggagtacatggaggagctgggctacctcgactag

SEQ ID NO: 2057 - DNA, 1335 bp, Unknown
  Bacillus sp. multi
atgaagtaccagatcctctgcccgatgaacgtggactggacgatcttcgagaagcacctccgcaacctcacgtaccaagtccggacgatcagcaaccgcaccatccagcagctctgggagttcgacgccctgtccttcgactacttcaaggcgcgcggcacctaccccacggtccaagacctctacggctgcacgcagaagaaaatcgacgggtacatctaccacacgctccagagcaagtaccccgacatccacaaggggaacatgagcaccaccctccaaaagatcattaagacctggaagtcccggcgcaacgagatccgcaagggcgagatgtccatcccgtccttccgcaaccgcatccccatcgacctgcacaacaactccgtggacatcacgaaggagaagaacggcgactacatcgcgggcatcagcctcttcagccgcgacttccacaaggagaacgacgacgtgccgaagggcaaaatcttcatcaagctggcgacgcagaagcagaagtccatgaaggtcatcctggaccgcctcatcaaccagacgtactcgaagggcgcgtgcatgatccacaagtacaagaacaagtggtatctcagcatcacctacaagttcaacgccatcaaggagaacaagttcgacaaggagcttatcatgggcatcgacatgggcgggatcaacacggtgtacttcgccttcaacgagggcttcatccgcagcaacatcaagagcgacgagatcaagaccttcaacgagcgcatccggcagcggcgcatcaacctcctcaagcagagcaagtattgctccaactcgcgcacggggaagggccggaccaagcgcctccagcccatcgacgtgctcagcaacaagatcgccaagttccgcaactcgaccaaccacaagtacgccaactacatcatcaagcagtgcctcaagtacaactgcgggcgcatccagatggagctgctcaagggcatctccaagaacgacaaggtgctgaacgactggacctacttcgacctccaggagaagatcaagaatcaggccgagatccacggcatcgaggtcatcaagatcgcgcccgcctacaccagccagcggtgctcgcagtgcgggtacatctgcaaggagaaccgctgcacccaggccatgttcgagtgcaagcagtgcggctacaagacccacgccgactacaacgccgccaagaacatcagcacgtacgacatcgagaacatcatcaacaagcagctcgccgtgcagagcaagctccactccaagaagtgcatggccgagtacatggaggagctgggctacctggactga

SEQ ID NO: 2058 - DNA, 1335 bp, Unknown
  Bacillus sp. multi
atgaagtaccagatcctctgcccgatgaacgtggactggacgatcttcgagaagcacctccgcaacctcacgtaccaagtgcggacgatctccaaccgcaccatccagcagctctgggagttcgacgccctgtccttcgactacttcaaggcgcgcggcacgtaccccaccgtccaagacttgtacggctgcacccagaagaagatcgacggctacatctaccacaccctccagagcaagtaccccgacatccacaagggcaacatgagcaccaccctccagaagatcatcaagacctggaagtcccggcgcaacgagatccgcaagggcgagatgtccatcccgagcttccggaaccgcatccccatcgacctccacaacaactcggtggacatcacgaaggagaagaatggcgactacatcgccgggatctcgctgttcagccgcgacttccacaaggagaacgacgacgtgccgaagggcaaaatctttatcaagctcgccacccagaagcagaagtccatgaaggtcatcctggaccgcctcatcaaccagacgtacagcaagggcgcgtgcatgatccacaagtacaagaacaagtggtacttgtccatcacctacaagttcaacgccatcaaggagaacaagttcgacaaggagcttatcatgggcatcgacatgggcgggatcaacaccgtgtacttcgccttcaacgagggcttcatccggagcaacatcaagagcgacgagatcaagaccttcaacgagcgcatccgccagcgccgcatcaacctcctcaagcagagcaaatactgctccaacagccgcacggggaaggggcgcaccaagcgcctccagcccatcgacgtgctgtccaacaagatcgccaagttccgcaactccaccaaccacaagtacgccaactacatcatcaagcagtgcctcaagtacaactgcgggcgcatccagatggagctgctcaagggcatcagcaagaacgacaaggtgctgaacgactggacctacttcgacctccaggagaagatcaagaaccaggccgagatccacggcatcgaggtcatcaagatcgccccggcctacaccagccagcggtgctcccagtgcggctacatctgcaaggagaaccggtgcacccaggccatgttcgagtgcaagcagtgcggctacaagacgcacgcggactacaacgcggccaagaacatctcgacgtacgacatcgagaacatcatcaacaagcagctcgcggtgcagtcgaagctgcacagcaagaaatgcatggccgagtacatggaggagctgggctacctcgactga

SEQ ID NO: 2059 - DNA, 1335 bp, Unknown
  Bacillus sp. multi
atgaagtaccagatcctctgccccatgaacgtggactggacgatcttcgagaagcacctccgcaacctcacctaccaggtgcggacgatcagcaaccgcacgatccagcagctctgggagttcgacgcgctctcgttcgactacttcaaggcgcggggcacgtaccccacggtccaagacctgtacggctgcacccagaagaagatcgacggctacatctaccacacgctccagtcgaagtaccccgacatccacaagggcaacatgagcaccaccctccagaaaatcatcaagacctggaagtcccgccgcaacgagatccgcaagggcgagatgtcgatcccgagcttccgcaaccgcatccccatcgacctccacaacaactcggtggacatcacgaaggagaagaatggggactacatcgcggggatctccctgttcagccgcgacttccacaaggagaacgacgacgtgccgaagggcaagatattcatcaagctggccacccagaagcagaagtcgatgaaggtgatcctggaccgcctcatcaaccagacctacagcaagggcgcgtgcatgatccacaagtacaagaacaagtggtacttatccatcacctacaagttcaacgccatcaaggagaacaagttcgacaaggaactcatcatgggcatcgacatgggcggcatcaacaccgtgtacttcgcgttcaacgaggggttcatccggtccaacatcaagtccgacgagatcaagaccttcaacgagcgcatccgccagcgccgcatcaacctgctcaagcagagcaagtattgctccaacagccgcacggggaagggccggaccaagcgcctccagcccatcgacgtgctgtcgaacaagatcgccaagttccgcaacagcaccaaccacaagtacgccaactacatcatcaagcagtgcctcaagtacaactgcgggcgcatccagatggagctgctcaaggggatctccaagaacgacaaggtgctgaacgactggacctacttcgacctccaggagaaaatcaagaatcaggcggagatccacggcatcgaggtcatcaagatcgccccggcctacaccagccagcgctgctcgcagtgcgggtacatctgcaaggagaaccgctgcacccaggccatgttcgagtgcaagcagtgcgggtacaagacgcacgcggactacaacgccgccaagaacatctccacgtacgacatcgagaacatcatcaacaagcagctcgccgtccagtccaagctccactccaagaagtgcatggcggagtacatggaggagctgggctacctggactga

SEQ ID NO: 2060 - DNA, 1335 bp, Unknown
  Bacillus sp. multi
atgaagtaccagatcctctgcccgatgaacgtggactggaccatcttcgagaagcacctccggaacctcacgtaccaagtccggacgatcagcaaccgcacgatccagcagctctgggagttcgacgccctcagcttcgactacttcaaggcgcgcggcacgtaccccacggtccaggatctctacggctgcacgcagaagaagatagacggctacatctaccacacgctccagagcaagtacccggacatccacaaggggaacatgagcaccacgctccagaaaatcatcaaaacctggaagtcccggcggaacgagatccgcaagggcgagatgtcgatccccagcttccggaaccgcatccccatcgacctccacaacaactcggtggacatcacgaaggagaagaacggggactacatcgcgggcatctcgctgttcagccgcgacttccacaaggagaacgacgacgtgccgaagggcaagatattcattaagctggccacccagaagcagaagtcgatgaaggtgatcctcgaccgcctcatcaaccagacctactcgaagggcgcgtgcatgatccacaagtacaagaacaagtggtacttatccatcacctacaagttcaacgccatcaaggagaacaagttcgacaaggagctgataatgggcatcgacatgggcgggatcaacaccgtgtacttcgccttcaacgagggcttcatccggagcaacatcaagtcggacgagatcaagaccttcaacgagcgcatccgccagcggcgcatcaacctcctcaagcagagcaagtattgctcgaactcgcgcacggggaaggggcggaccaagcgcctccagcccatcgacgtcctctccaacaagatcgccaagttccgcaactcgacgaaccacaagtacgccaactacatcatcaagcagtgcctcaagcacaactgcgggcgcatccagatggagctgctcaaggggatctccaagaacgacaaggtgctcaaggactggacctacttcgacctccaggagaagatcaagaaccaggcggagatccacggcatcgaggtcatcaagatcgccccggcctacacgagccagcggtgcagccagtgcggctacatctgcaaggagaaccggtgcacccaggccatgttcgagtgcaagcagtgcggctacaagacccacgccgactacaacgccgccaagaacatctccacgtacgacatcgagaacatcatcaacaagcagctcgccgtgcagtccaagctgcacagcaagaagtgcatggcggagtacatggaggagctgggctacctcgactga

SEQ ID NO: 2061 - DNA, 1335 bp, Unknown
  Bacillus sp. multi
atgaagtaccagatcctctgccccatgaacgtggactggaccatcttcgagaagcacctccggaacctcacgtaccaagtccggacgatctccaaccggaccatccagcagctctgggagttcgacgcgctgtccttcgactacttcaaggcgcggggcacctaccccaccgtccaggacctatacggctgcacgcagaagaagatcgacggctacatctaccacaccctccagagcaagtacccggacatccacaagggcaacatgagcaccacgctccagaaaatcatcaagacctggaagtcccgccgcaacgagatccgcaagggcgagatgtccatcccctccttccgcaaccgcatccccatcgacctccacaacaacagcgtggacatcacgaaggagaagaatggcgactacatcgcgggcatctccctgttcagccgcgacttccacaaggagaacgacgacgtgccgaagggcaaaatcttcatcaagctcgccacgcagaagcagaagtcgatgaaggtcatcctggaccgcctcatcaaccagacctactcgaagggcgcgtgcatgatccacaagtacaagaacaagtggtacttgtcgatcacctacaagttcaacgcgatcaaggagaacaagttcgacaaggagttgattatgggcatcgacatgggcggcatcaacaccgtgtacttcgcgttcaacgaggggttcatccgctccaacatcaagtcggacgagatcaagaccttcaacgagcgcatccggcagcgccggatcaacctgctcaagcagagcaagtattgttcgaactcccgcaccggcaaggggcgcacgaagcggctccagcccatcgacgtcctgtcgaacaagatcgccaagttccgcaacagcaccaaccacaagtacgcgaactacatcatcaagcagtgcctcaagcacaactgcgggcgcatccagatggagctgctcaaggggatcagcaagaacgacaaggtgctcaaggactggacgtacttcgacctccaggaaaagatcaagaaccaggcggagatccacggcatcgaggtcatcaagatcgccccggcctacaccagccagcgctgctcccagtgcggctacatctgcaaggagaaccgctgcacccaggccatgttcgagtgcaagcagtgcggctacaagacgcacgccgactacaacgccgccaagaacatctcgacgtacgacatcgagaacatcatcaacaagcagctcgccgtgcagtccaagctgcactccaagaagtgcatggcggagtacatggaggagctgggctacctcgactag

SEQ ID NO: 2062 - DNA, 1335 bp, Unknown
  Bacillus sp. multi
atgaagtaccagatcctctgccccatgaacgtggactggaccatcttcgagaagcacctccgcaacctcacctaccaggtccggacgatctccaaccggaccatccagcagctctgggagttcgacgccctgtccttcgactacttcaaggcgcgcgggacgtacccgaccgtccaagacctgtacggctgcacgcagaagaaaattgacgggtacatctaccacaccctccagagcaagtacccggacatccacaagggcaacatgagcacgacgctccagaaaatcatcaagacctggaagtcgcgccggaacgagatccgcaagggcgagatgtcgatcccgagcttccggaaccgcatccccatcgacctccacaacaactcggtggacatcacgaaggagaagaatggggactacatcgcgggcatctcgctgttctcgcgggacttccacaaggagaacgacgacgtgccgaagggcaagatattcattaagctcgccacccagaagcagaagtccatgaaggtcatcctcgaccggctcatcaaccagacctactcgaagggcgcgtgcatgatccacaagtacaagaacaagtggtacctgagcataacctacaagttcaacgccatcaaggagaacaagttcgacaaggagctgataatgggcatcgacatgggcgggatcaacacggtgtacttcgcgttcaacgaggggttcatccgctccaacatcaagtcggacgagatcaagacgttcaacgagcgcatccggcagcgccgcatcaacctcctcaagcagtccaagtactgctccaacagccgcaccgggaaggggcgcaccaagcggctccagcccatcgacgtgctgagcaacaagatcgccaagttccgcaactcgacgaaccacaagtacgccaactacatcatcaagcagtgcctcaagcacaactgcgggcgcatccagatggagctgctcaagggcatctccaagaacgacaaggtgctcaaggactggacgtacttcgacctccaggagaaaatcaagaatcaggccgagatccacggcatcgaggtcatcaagatcgccccggcctacaccagccagcggtgctcccagtgcggctacatctgcaaggagaaccgctgcacccaggcgatgttcgagtgcaagcagtgcgggtacaagacgcacgcggactacaacgccgccaagaacatctccacgtacgacatcgagaacatcatcaacaagcagctcgccgtgcagtcgaagctccacagcaagaagtgcatggcggagtacatggaggagctgggctacctcgactga

SEQ ID NO: 2063 - DNA, 1335 bp, Unknown
  Bacillus sp. multi
atgaagtaccagatcctctgccccatgaacgtggactggaccatcttcgagaagcacctccgcaacctcacctaccaggtccggacgatctccaaccgcaccatccagcagctctgggagttcgacgccctctcgttcgactacttcaaggcgcgcggcacgtacccgacggtccaagacctgtacggctgcacccagaagaaaatcgacgggtacatctaccacaccctccagtcgaagtacccggacatccacaagggcaacatgagcaccaccctccagaaaatcatcaagacctggaagtcccgccggaacgagatccgcaagggcgagatgtccatcccgtccttccgcaaccgcatccccatcgacctccacaacaactccgtggacatcacgaaggagaagaacggcgactacatcgcgggcatcagcctgttcagccgcgacttccacaaggagaacgacgacgtgccgaagggcaaaatctttatcaagctggccacgcagaagcagaagtccatgaaggtcatcctcgaccggctcatcaaccagacctacagcaagggcgcgtgcatgatccacaagtacaagaacaagtggtatctgtccatcacctacaagttcaacgccatcaaggagaacaagttcgacaaggagctgattatggggatcgacatgggcgggatcaacaccgtgtacttcgccttcaacgagggcttcatccggtccaacatcaagtcggacgagatcaagaccttcaacgagcgcatccggcagcggcgcatcaacctcctcaagcagtccaagtattgctccaactcccgcaccggcaagggccggaccaagcggctccagcccatcgacgtgctgtccaacaagatcgccaagttccgcaactcgaccaaccacaagtacgcgaactacatcatcaagcagtgcctcaagcacaactgcgggcgcatccagatggagctgctcaaggggatcagcaagaacgacaaggtgctcaaggactggacctacttcgacctccaggagaaaatcaagaatcaggcggagatccacggcatcgaggtcatcaagatcgcgcccgcctacacctcccagcggtgctcgcagtgcgggtacatctgcaaggagaaccgctgcacccaggccatgttcgagtgcaagcagtgcggctacaagacccacgcggactacaacgcggccaagaacatctcgacctacgacatcgagaacatcatcaacaagcagctcgccgtgcagtccaagctccactccaagaaatgcatggccgagtacatggaggagctgggctacctcgactga

SEQ ID NO: 2064 - DNA, 1335 bp, Unknown
  Bacillus sp. multi
atgaagtaccagatcctctgccccatgaacgtggactggacgatcttcgagaagcacctccggaacctgacgtaccaagtacggacgatctccaaccgcacgatccagcagctctgggagttcgacgccctgtccttcgactacttcaaggcgcgcggcacgtacccgaccgtccaggacttgtacggctgcacccagaagaaaattgacgggtacatctaccacacgctccagagcaagtaccccgacatccacaagggcaacatgagcaccaccctccagaagatcatcaagacctggaagtcccggcgcaacgagatccgcaagggcgagatgtccatcccgagcttccgcaaccgcatccccatcgacctccacaacaactccgtggacatcacgaaggagaagaacggcgactacatcgccgggatcagcctgttcagccgcgacttccacaaggagaacgacgacgtgccgaagggcaagatattcatcaagctggcgacccagaagcagaagtcgatgaaggtgatcctggaccggctcatcaaccagacctacagcaagggcgcgtgcatgatccacaagtacaagaacaagtggtacttgagcatcacctacaagttcaacgccatcaaggagaacaagttcgacaaggaactcatcatgggcatcgacatgggcgggatcaacaccgtgtacttcgccttcaacgagggcttcatccgctccaacatcaagtccgacgagatcaagaccttcaacgagcgcatccggcagcgccgcatcaacctgctcaagcagtccaaatactgttccaactcgcgcacgggcaagggccgcaccaagcggctccagcccatcgacgtcctgtcgaacaagatcgccaagttccgcaactcgaccaaccacaagtacgccaactacatcatcaagcagtgcctcaagcacaactgcgggcgcatccagatggagctgctcaagggcatctccaagaacgacaaggtgctcaaggactggacgtacttcgacctccaggagaagattaagaaccaggcggagatccacggcatcgaggtcatcaagatcgcgcccgcctacacctcgcagcggtgcagccagtgcgggtacatctgcaaggagaaccgctgcacccaggcgatgttcgagtgcaagcagtgcggctacaagacccacgccgactacaacgccgccaagaacatctcgacctacgacatcgagaacatcatcaacaagcagctcgccgtccagagcaagctgcactccaagaagtgcatggccgagtacatggaggagctgggctacctcgactag

SEQ ID NO: 2065 - DNA, 1335 bp, Unknown
  Bacillus sp. multi
atgaagtaccagatcctctgccccatgaacgtggactggaccatcttcgagaagcacctccgcaacctgacctaccaagttcggacgatctcgaaccgcacgatccagcagctctgggagttcgacgcgctcagcttcgactacttcaaggagcgcggcacgtaccccaccgtccaggatctctacggctgcacccagaagaagattgacgggtacatctaccacaccctccagagcaagtaccccgacatccacaagggcaacatgagcaccaccctccaaaagattatcaagacctggaaatcccggcggaacgagatccgcaagggcgagatgtccatccccagcttccggaaccgcatccccatcgacctgcacaacaactccgtggacatcacgaaggagaagaacggcgactacatcgcggggatcagcctgttctcccgcgacttccataaggagaacgacgacgtgccgaagggcaagatattcgtcaagctggccacgcagaagcagaagtccatgaaggtgatcctcgaccgcctcatcaaccagacctacagcaagggcgcgtgcatgatccacaagtacaagaacaagtggtatttgagcatcacctacaagttcaacgccatcaaggagaacaagttcgacaaggagttaatcatgggcatcgacctgggcggcatcaacacggtgtacttcgccttcaacgaggggttcatccggagcaacatcaagagcgacgagatcaagatgttcaacgagcgcatccgccagcggcgcatcaacctgctcaagcagtccaagtactgttccaactcgcgcacgggcaagggccggaccaagcgcctccagcccatcgacgtgctgtccaacaagatcgccaagttccgcaactccaccaaccacaagtacgcgaactacatcgtgaagcagtgcctcaagcacaactgcgggcgcatccagatggagctgctcaagggcatcagcaagaacgaccgcatcctcaaggactggacctacttcgacctccaggagaagatcaagaaccaggccgagatccacggcatcgaggtcatcaaggtcgccccggcctacacgagccagcgctgctcccagtgcggctacatctgcaaggagaaccgctgcacccaggcgacgttcgagtgcaagcagtgcgggtacaagacccacgcggactacaacgcggccaagaacatcagcacgtacgacatcgagaacatcatcaacaagcagctcgcggtgcagtccaagctccactccaagaagtgcatggaggagtacatcgaggagctgggctacctcgactga

SEQ ID NO: 2066 - DNA, 1335 bp, Unknown
  Bacillus sp. multi
atgaagtaccagatcctctgccccatgaacgtggactggacgatcttcgagaagcacctccgcaacctgacgtaccaggtgcggacgatcagcaaccgcacgatccagcagctctgggagttcgacgccctgtcgttcgactacttcaaggagcgcgggacgtacccgacggtccaggatctctacggctgcacccagaagaaaatcgacgggtacatctaccacaccctccagtcgaagtaccccgacatccacaaggggaacatgagcacgacgctccagaaaatcatcaagacctggaaatcgcgccggaacgagatccgcaagggcgagatgagcatcccgagcttccgcaaccgcatccccatcgacctgcacaacaactccgtggacatcacgaaggaaaagaacggggactacatcgcggggatcagcctgttcagccgtgactttcataaggagaacgacgacgtgccgaagggcaaaatcttcgtgaagctggccacccagaagcagaagtcgatgaaggtcatcctcgaccggctcatcaaccagacctactcgaagggcgcgtgcatgatccacaagtacaagaacaagtggtacttgtctatcacctacaagttcaacgcgatcaaggagaacaagttcgacaaggagctgataatggggatcgacctgggcggcatcaacaccgtgtacttcgcgttcaacgagggcttcatccgcagcaacatcaagtccgacgagatcaagatgttcaacgagcgcatccggcagcggcgcatcaacctcctcaagcagtccaagtactgttccaactcccgcaccggcaaggggcggaccaagcgcctccagcccatcgacgtgctctcgaacaagatcgccaagttccgcaacagcaccaaccacaagtacgcgaactacatcgtgaagcagtgcctcaagcacaactgcgggcgcatccagatggagctgctcaaggggatcagcaagaacgaccgcatcctcaaggactggacgtacttcgacctccaggagaagatcaagaatcaggccgagatccacggcatcgaggtcatcaaggtcgccccggcctacacctcccagcggtgctcccagtgcgggtacatctgcaaggagaaccggtgcacccaggccaccttcgagtgcaagcagtgcgggtacaagacgcacgcggactacaacgcggccaagaacatctccacgtacgacatcgagaacatcatcaacaagcagctcgccgtgcagtcgaagctgcacagcaagaagtgcatggaggagtacatcgaggagctgggctacctcgactag

SEQ ID NO: 2067 - DNA, 1335 bp, Unknown
  Bacillus sp. multi
atgaagtaccagatcctctgccccatgaacgtggactggaccatcttcgagaagcacctccggaacctgacgtaccaagtccggacgatcagcaaccgcaccatccagcagctctgggagttcgacgccctgagcttcgactacttcaaggagcgcggcacctacccgaccgtccaagacctctacggctgcacgcagaagaaaatcgacggctacatctaccacacgctccagagcaagtaccccgacatccacaagggcaacatgagcacgaccctccagaaaatcatcaagacctggaagtcccgccgcaacgagatccgcaagggcgagatgagcatcccgtccttccggaaccgcatccccatcgacctccacaacaactcggtggacatcacgaaggagaagaacggcgactacatcgcgggcatctcgctgttctcgcgcgacttccacaaggagaacgacgacgtgccgaagggcaagatattcgtgaagctcgccacgcagaagcagaagtccatgaaggtgatcctggaccgcctcatcaaccagacctacagcaagggcgcgtgcatgatccacaagtacaagaacaagtggtatcttagcatcacctacaagttcaacgcgatcaaggagaacaagttcgacaaggaacttattatgggcatcgacctgggcgggatcaacaccgtgtacttcgccttcaacgaggggttcatccggtcgaacatcaagagcgacgagatcaagatgttcaacgagcgcatccgccagcgccgcatcaacctcctcaagcagagcaagtactgttcgaactcgcgcacgggcaagggccggaccaagcggctccagcccatcgacgtcctctccaacaagatcgccaagttccgcaactcgacgaaccacaagtacgccaactacatcgtcaagcagtgcctcaagcacaactgcgggcgcatccagatggagctgctcaaggggatctccaagaacgaccgcatcctcaaggactggacctacttcgacctccaggagaaaatcaagaatcaggccgagatccacgggatcgaggtcatcaaggtggccccggcctacacgagccagcgctgctcccagtgcgggtacatctgcaaggagaaccgctgcacccaggccacgttcgagtgcaagcagtgcgggtacaagacccacgccgactacaacgcggccaagaacatctcgacgtacgacatcgagaacatcatcaacaagcagctcgccgtgcagtccaagctgcactccaagaagtgtatggaggagtacatcgaggagctgggctacctggactag

SEQ ID NO: 2068 - DNA, 1335 bp, Unknown
  Bacillus sp. multi
atgaagtaccagatcctctgccccatgaacgtggactggacgatcttcgagaagcacctccgcaacctgacctaccaagtccggacgatctccaaccggaccatccagcagctctgggagttcgacgcgctgtccttcgactacttcaaggagcgcggcacctacccgaccgtccaagatttgtacggctgcacccagaagaaaatagacggctacatctaccacacgctccagagcaagtaccccgacatccacaagggcaacatgagcaccacgctccagaaaatcatcaagacctggaagtcgcgccgcaacgagatccggaagggcgagatgtcgatccccagcttccggaaccgcatccccatcgacctgcacaacaactcggtggacatcacgaaggagaagaatggcgactacatcgcggggatctccctgttctcgcgggacttccacaaggagaacgacgacgtgccgaagggcaagatattcgtcaagctcgccacgcagaagcagaagtcgatgaaggtgatcctggaccggctcatcaaccagacctacagcaagggcgcgtgcatgatccacaagtacaagaacaagtggtacttgagcatcacctacaagttcaacgcgatcaaggagaacaagttcgacaaggagctgataatgggcatcgacctcggcggcatcaacacggtgtacttcgccttcaacgagggcttcatccgctccaacatcaagtcggacgagatcaagatgttcaacgagcgcatccggcagcgccggatcaacctcctcaagcagtccaagtactgttccaactcccgcacgggcaagggccggacgaagcgcctccagcccatcgacgtgctctcgaacaagatcgccaagttccgcaacagcaccaaccacaagtacgcgaactacatcgtgaagcagtgcctcaagcacaactgcgggcgcatccagatggagctgctcaaggggatcagcaagaacgaccgcatcctcaaggactggacctacttcgacctccaggagaagattaagaatcaggccgagatccacggcatcgaggtcatcaaggtcgccccggcctacaccagccagcggtgctcccagtgcgggtacatctgcaaggagaaccggtgcacccaggccaccttcgagtgcaagcagtgcgggtacaagacccacgccgactacaacgcggccaagaacatctcgacctacgacatcgagaacatcatcaacaagcagctcgccgtccagtcgaagctccacagcaagaagtgcatggaggagtacatcgaggagctgggctacctggactag

SEQ ID NO: 2069 - DNA, 1335 bp, Unknown
  Bacillus sp. multi
atgaagtaccagatcctctgcccgatgaacgtggactggacgatcttcgagaagcacctccggaacctcacgtaccaggtgcggacgatcagcaaccgcaccatccagcagctctgggagttcgacgcgctctcgttcgactacttcaaggagcgcggcacctaccccacggtccaagacctatacggctgcacgcagaagaagatcgacggctacatctaccacaccctccagtcgaagtaccccgacatccacaaggggaacatgagcaccaccctccaaaagatcatcaagacctggaagtcgcggcggaacgagatccggaagggcgagatgtcgatcccgagcttccggaaccgcatccccatcgacctccacaacaacagcgtggacatcacgaaggagaagaatggggactacatcgcgggcatcagcctgttctcacgggatttccacaaggagaacgacgacgtgccgaagggcaaaatcttcgtcaagctggcgacccagaagcagaagtccatgaaggtgatcctcgaccgcctcatcaaccagacctactcgaagggcgcgtgcatgatccacaagtacaagaacaagtggtatttgagcatcacctacaagttcaacgcgatcaaggagaacaagttcgacaaggagcttatcatggggatcgacctcggcggcatcaacaccgtgtacttcgccttcaacgagggcttcatccggtcgaacatcaagagcgacgagatcaagatgttcaacgagcgcatccgccagcgccgcatcaacctcctcaagcagagcaaatactgctccaactcgcgcacgggcaaggggcgcaccaagcggctccagcccatcgacgtcctgtccaacaagatcgccaagttccgcaactccaccaaccacaagtacgcgaactacatcgtgaagcagtgcctcaagcacaactgcgggcgcatccagatggagctgctcaagggcatctccaagaacgaccgcatcctcaaggactggacctacttcgacctccaggagaagattaagaatcaggccgagatccacggcatcgaggtcatcaaggtggccccggcctacacctcgcagcggtgcagccagtgcggctacatctgcaaggagaaccgctgcacccaggcgacgttcgagtgcaagcagtgcggctacaagacccacgccgactacaacgccgccaagaacatctccacctacgacatcgagaacatcatcaacaagcagctcgcggtgcagagcaagctccacagcaagaagtgtatggaggagtacatcgaggagctgggctacctcgactag

SEQ ID NO: 2070 - DNA, 1356 bp, Bacillus thuringiensis
ctgggcgtcacgatcaagatcatgaagtaccagatcctctgccccatgaacgtggactggaccatcttcgagaagcacctccggaacctgacctaccaagtccggacgatcagcaaccggacgatccagcagctctgggagttcgacgcgctgtcgttcgactacttcaaggcgcggggcacgtaccccaccgtccaagacctatacggctgcacccagaagaagatcgacgggtacatctaccacaccctccagagcaagtacccggacatccacaagggcaacatgagcaccaccctccagaaaatcatcaagacctggaagtcccgccgcaacgagatccggaagggcgagatgtcgatcccgtccttccgcaaccgcatccccatcgacctccacaacaactcggtggacatcacgaaggagaagaatggggactacatcgccgggatcagcctgttctcgcgcgacttccacaaggagaacgacgacgtgccgaagggcaagatattcatcaagctggccacccagaagcagaagtccatgaaggtcatcctggaccgcctcatcaaccagacctactcgaagggcgcgtgcatgatccacaagtacaagaacaagtggtatctgagcatcacctacaagttcaacgccatcaaggagaacaagttcgacaaggagctaatcatggggatcgacatgggcggcatcaacacggtgtacttcgcgttcaacgagggcttcatccggagcaacatcaagtccgacgagatcaagaccttcaacgagcgcatccgccagcggcgcatcaacctgctcaagcagtccaagtattgctcgaactcgcggacggggaagggccggaccaagcgcctccagcccatcgacgtcctcagcaacaagatcgccaagttccgcaacagcaccaaccacaagtacgcgaactacatcatcaagcagtgcctcaagcacaactgcgggcgcatccagatggagctgctcaaggggatcagcaagaacgacaaggtgctcaaggactggacctacttcgacctccaggagaagatcaagaatcaggcggagatccacggcatcgaggtcatcaagatcgccccggcctacacctcccagcggtgctcccagtgcggctacatctgcaaggagaaccgctgcacccaggcgatgttcgagtgcaagcagtgcggctacaagacccacgccgactacaacgccgccaagaacatcagcacgtacgacatcgagaacatcatcaacaagcagctcgcggtgcagagcaagctccactccaagaaatgcatggcggagtacatggaggagctgggctacctggactga

SEQ ID NO: 2071 - DNA, 1356 bp, Bacillus thuringiensis
ctgggcgtgaccatcaagatcatgaagtaccagatcctctgcccgatgaacgtggactggacgatcttcgagaagcacctccggaacctcacgtaccaagtgcggacgatctccaaccgcacgatccagcagctctgggagttcgacgccctgtcgttcgactacttcaaggcgcggggcacgtacccgaccgtccaggacttgtacggctgcacccagaagaaaatcgacgggtacatctaccacaccctccagagcaagtaccccgacatccacaagggcaacatgagcaccacgctccagaaaatcatcaagacctggaagtcccgccggaacgagatccgcaagggcgagatgtccatcccctccttccgcaaccgcatccccatcgacctccacaacaactcggtggacatcacgaaggagaagaacggggactacatcgcgggcatctccctgttcagccgcgacttccacaaggagaacgacgacgtgccgaagggcaagatattcatcaagctcgccacccagaagcagaagtccatgaaggtgatcctcgaccgcctcatcaaccagacctacagcaagggcgcgtgcatgatccacaagtacaagaacaagtggtatctctcaatcacctacaagttcaacgccatcaaggagaacaagttcgacaaggagctcattatgggcatcgacatgggcggcatcaacaccgtgtacttcgcgttcaacgagggcttcatccggtccaacatcaagagcgacgagatcaagaccttcaacgagcgcatccgccagcggcggatcaacctcctcaagcagtccaagtattgctcgaactcgcgcacgggcaagggccgcaccaagcggctccagcccatcgacgtcctgagcaacaagatcgccaagttccgcaactcgacgaaccacaagtacgcgaactacatcatcaagcagtgcctcaagcacaactgcgggcgcatccagatggagctgctcaagggcatcagcaagaacgacaaggtgctcaaggactggacgtacttcgacctccaggaaaagatcaagaatcaggcggagatccacggcatcgaggtcatcaagatcgccccggcctacacgagccagcggtgctcccagtgcggctacatctgcaaggagaaccggtgcacccaggcgatgttcgagtgcaagcagtgcgggtacaagacccacgccgactacaacgccgccaagaacatcagcacgtacgacatcgagaacatcatcaacaagcagctcgcggtccagagcaagctgcactccaagaagtgcatggccgagtacatggaggagctgggctacctggactga

SEQ ID NO: 2072 - DNA, 1356 bp, Bacillus thuringiensis
ctcggggtgaccatcaagatcatgaagtaccagatcctctgcccgatgaacgtggactggaccatcttcgagaagcacctccgcaacctcacctaccaggtacggacgatcagcaaccgcaccatccagcagctctgggagttcgacgcgctgtccttcgactacttcaaggcgcgcggcacgtacccgacggtccaggacttgtacggctgcacccagaagaagattgacggctacatctaccacacgctccagagcaagtaccccgacatccacaagggcaacatgagcacgacgctccagaagatcatcaagacctggaagtcgcgccgcaacgagatccgcaagggcgagatgtccatcccgagcttccgcaaccgcatccccatcgacctgcacaacaactcggtggacatcacgaaggagaagaatggggactacatcgccgggatctcgctgttcagccgggacttccacaaggagaacgacgacgtgccgaagggcaaaatcttcatcaagctcgccacccagaagcagaagtccatgaaggtgatcctggaccggctcatcaaccagacctacagcaagggcgcgtgcatgatccacaagtacaagaacaagtggtatctcagcatcacctacaagttcaacgcgatcaaggagaacaagttcgacaaggagcttatcatgggcatcgacatgggcggcatcaacaccgtgtacttcgccttcaacgagggcttcatccgctccaacatcaagagcgacgagatcaagaccttcaacgagcgcatccggcagcgccgcatcaacctgctcaagcagagcaaatactgctccaactcccgcaccggcaagggccggacgaagcgcctccagcccatcgacgtgctcagcaacaagatcgccaagttccgcaactcgaccaaccacaagtacgcgaactacatcatcaagcagtgcctcaagcacaactgcgggcgcatccagatggagctgctcaaggggatctccaagaacgacaaggtgctcaaggactggacgtacttcgacctccaggagaagattaagaatcaggccgagatccacgggatcgaggtcatcaagatcgccccggcctacacgagccagcgctgctcccagtgcggctacatctgcaaggagaaccggtgcacccaggcgatgttcgagtgcaagcagtgcgggtacaagacgcacgcggactacaacgccgccaagaacatcagcacgtacgacatcgagaacatcatcaacaagcagctcgccgtgcagtccaagctccacagcaagaaatgcatggccgagtacatggaggagctgggctacctcgactga

SEQ ID NO: 2073 - DNA, 1356 bp, Bacillus thuringiensis
ctcggggtcaccatcaagatcatgaagtaccagatcctctgcccgatgaacgtggactggacgatcttcgagaagcacctccgcaacctgacctaccaagttcggacgatctcgaaccgcaccatccagcagctctgggagttcgacgccctgtccttcgactacttcaaggcgcgcggcacctacccgaccgtccaggacctgtacggctgcacccagaagaaaatcgacggctacatctaccacacgctccagagcaagtacccggacatccacaaggggaacatgagcaccaccctccagaaaatcatcaagacctggaagtcccgccgcaacgagatccggaagggcgagatgagcatcccgagcttccgcaaccgcatccccatcgacctccacaacaactccgtggacatcacgaaggagaagaacggggactacatcgcggggatctcgctgttcagccgcgacttccacaaggagaacgacgacgtgccgaagggcaagatattcattaagctcgccacgcagaagcagaagtcgatgaaggtgatcctcgaccggctcatcaaccagacgtacagcaagggcgcgtgcatgatccacaagtacaagaacaagtggtatctaagcatcacctacaagttcaacgcgatcaaggagaacaagttcgacaaggaactcatcatggggatcgacatgggcgggatcaacaccgtgtacttcgccttcaacgagggcttcatccggagcaacatcaagagcgacgagatcaagaccttcaacgagcgcatccggcagcggcggatcaacctgctcaagcagagcaagtattgctccaacagccgcacgggcaagggccggacgaagcgcctccagcccatcgacgtcctgtcgaacaagatcgccaagttccgcaacagcaccaaccacaagtacgccaactacatcatcaagcagtgcctcaagcacaactgcgggcgcatccagatggagctgctcaagggcatcagcaagaacgacaaggtgctcaaggactggacctacttcgacctccaggagaaaatcaagaaccaggcggagatccacggcatcgaggtcatcaagatcgccccggcctacaccagccagcggtgctcgcagtgcggctacatctgcaaggagaaccgctgcacccaggccatgttcgagtgcaagcagtgcgggtacaagacccacgcggactacaacgccgccaagaacatcagcacctacgacatcgagaacatcatcaacaagcagctcgcggtgcagtcgaagctccacagcaagaagtgcatggccgagtacatggaggagctgggctacctggactga

SEQ ID NO: 2074 - DNA, 1356 bp, Bacillus thuringiensis
ctcggggtgacgatcaagatcatgaagtaccagatcctctgccccatgaacgtggactggaccatcttcgagaagcacctccgcaacctcacctaccaagtccggacgatctcgaaccggaccatccagcagctctgggagttcgacgcgctgtccttcgactacttcaaggcgcgcggcacgtaccccaccgtccaagacttgtacggctgcacgcagaagaaaatagacggctacatctaccacaccctccagagcaagtaccccgacatccacaagggcaacatgagcacgaccctccagaaaatcattaagacctggaagtcccgccgcaacgagatccgcaagggcgagatgtccatcccgtccttccggaaccgcatccccatcgacctgcacaacaactccgtggacatcacgaaggagaagaacggggactacatcgcggggatctcgctgttcagccgcgacttccacaaggagaacgacgacgtgccgaagggcaagatcttcatcaagctggcgacgcagaagcagaagtcgatgaaggtcatcctggaccgcctcatcaaccagacgtactcgaagggcgcgtgcatgatccacaagtacaagaacaagtggtacttgtcgatcacgtacaagttcaacgccatcaaggagaacaagttcgacaaggagcttatcatgggcatcgacatgggcggcatcaacacggtgtacttcgccttcaacgagggcttcatccgcagcaacatcaagagcgacgagatcaagaccttcaacgagcgcatccgccagcggcggatcaacctgctcaagcagagcaagtattgctcgaactcgcgcacgggcaagggccgcaccaagcggctccagcccatcgacgtgctgagcaacaagatcgccaagttccgcaactccaccaaccacaagtacgccaactacatcatcaagcagtgcctcaagcacaactgcgggcgcatccagatggagctgctcaagggcatcagcaagaacgacaaggtgctcaaggactggacctacttcgacctccaggagaagattaagaaccaggccgagatccacgggatcgaggtcatcaagatcgccccggcctacacctcgcagcggtgcagccagtgcggctacatctgcaaggagaaccggtgcacccaggcgatgttcgagtgcaagcagtgcgggtacaagacgcacgccgactacaacgccgccaagaacatcagcacctacgacatcgagaacatcatcaacaagcagctcgcggtgcagtccaagctgcacagcaagaagtgcatggcggagtacatggaggagctgggctacctggactga

SEQ ID NO: 2075 - DNA, 1356 bp, Unknown
  Bacillus sp. multi
ctgggcgtgacgatcaagatcatgaagtaccagatcctctgccccatgaacgtggactggacgatcttcgagaagcacctccggaacctcacgtaccagatccgcaccatctcgaaccgcacgatccagcagctctgggagttcgacgccctgtccttcgactacttcaaggagcggggcacctaccccaccgtccaagacctctacggctgcacgcagaagaagatcgacgggtacatctaccacacgctccagtcgaagtaccccgacatccacaaggggaacatgagcacgaccctccagaagatcatcaagacctggaagtcacggaggaacgagatccgcaagggcgagatgagcatcccgtccttccgcaaccgcatccccatcgacctccacaacaacagcgtggacatcacgaaggagaagaatggggactacatcgccgggatctcgctgttctcgcgggacttccacaaggagaacgacgacgtgccgaagggcaaaatcttcgtcaagctggccacgcagaagcagaagtccatgaaggtcatcctggaccgcctcatcaaccagacctacagcaagggcgcgtgcatgatccacaagtacaagaacaagtggtatctaagcatcacgtacaagttcaacgccatcaaggagaacaagttcgacaaggagcttatcatgggcatcgacctcggcggcatcaacacggtgtacttcgcgttcaacgaggggttcatccgcagcaacatcaagagcgacgagatcaagatgttcaacgagcgcatccggcagcggcggatcaacctgctcaagcagagcaaatactgctcgaactcgcgcaccggcaagggccgcaccaagcgcctccagcccatcgacgtcctcagcaacaagatcgccaagttccgcaactcgaccaaccacaagtacgcgaactacatcgtcaagcagtgcctcaagcacaactgcgggcgcatccagatggagctgctcaagggcatctccaagaacgaccgcatcctcaaggactggacgtacttcgacctccaggaaaagattaagaatcaggccgagatccacggcatcgaggtcatcaaggtggccccggcctacacctcccagcggtgcagccagtgcgggtacatctgcaaggagaaccgctgcacccaggccacgttcgagtgcaagcagtgcggctacaagacgcacgcggactacaacgcggccaagaacatcagcacgtacgacatcgagaacatcatcaacaagcagctcgcggtccagagcaagctccacagcaagaaatgcatggaggagtacatcgaggagctgggctacctggactag

SEQ ID NO: 2076 - DNA, 1356 bp, Unknown
  Bacillus sp. multi
ctcggggtcacgatcaagatcatgaagtaccagatcctctgcccgatgaacgtggactggacgatcttcgagaagcacctccgcaacctcacctaccagatccgcaccatctcgaaccggaccatccagcagctctgggagttcgacgcgctctcgttcgactacttcaaggagcgcggcacctaccccaccgtccaagacctgtacggctgcacgcagaagaaaattgacgggtacatctaccacaccctccagagcaagtaccccgacatccacaaggggaacatgagcaccaccctccagaagatcattaagacctggaagtcgcgccggaacgagatccgcaagggcgagatgagcatcccctccttccgcaaccgcatccccatcgacctccacaacaactccgtggacatcacgaaggagaagaatggcgactacatcgcggggatcagcctcttcagccgggacttccacaaggagaacgacgacgtgccgaagggcaaaatcttcgtgaagctggccacgcagaagcagaagtccatgaaggtgatcctcgaccggctcatcaaccagacctactcgaagggcgcgtgcatgatccacaagtacaagaacaagtggtatctgtctattacctacaagttcaacgccatcaaggagaacaagttcgacaaggaactcatcatggggatcgacctcggcgggatcaacacggtgtacttcgccttcaacgaggggttcatccgctccaacatcaagtccgacgagatcaagatgttcaacgagcgcatccggcagcggcggatcaacctgctcaagcagagcaagtactgttccaactcgcggacgggcaagggccgcaccaagcgcctccagcccatcgacgtgctgtccaacaagatcgccaagttccgcaacagcaccaaccacaagtacgccaactacatcgtcaagcagtgcctcaagcacaactgcgggcgcatccagatggagctgctcaagggcatcagcaagaacgaccgcatcctcaaggactggacctacttcgacctccaggagaagattaagaaccaggcggagatccacggcatcgaggtcatcaaggtcgcgcccgcctacaccagccagcggtgctcccagtgcggctacatctgcaaggagaaccgctgcacccaggcgaccttcgagtgcaagcagtgcggctacaagacccacgcggactacaacgcggccaagaacatctccacgtacgacatcgagaacatcatcaacaagcagctcgccgtgcagagcaagctgcacagcaagaaatgcatggaggagtacatcgaggagctgggctacctggactga

SEQ ID NO: 2077 - DNA, 1356 bp, Unknown
  Bacillus sp. multi
ctcggggtcaccatcaagatcatgaagtaccagatcctctgccccatgaacgtggactggaccatcttcgagaagcacctccggaacctcacctaccagatccgcaccatctccaaccggaccatccagcagctctgggagttcgacgcgctgtcgttcgactacttcaaggagcggggcacctacccgacggtccaagatctctacggctgcacgcagaagaagattgacggctacatctaccacaccctccagagcaagtaccccgacatccacaagggcaacatgagcaccacgctccagaaaatcatcaagacctggaagtcccgccgcaacgagatccgcaagggcgagatgtccatccccagcttccgcaaccgcatccccatcgacctccacaacaactccgtggacatcacgaaggagaagaatggcgactacatcgccgggatcagcctgttctcccgcgacttccacaaggagaacgacgacgtgccgaagggcaaaatcttcgtgaagctggcgacgcagaagcagaagtccatgaaggtgatcctggaccggctcatcaaccagacgtactcgaagggcgcgtgcatgatccacaagtacaagaacaagtggtatctgagcatcacctacaagttcaacgccatcaaggagaacaagttcgacaaggaactgattatggggatcgacctcggcggcatcaacaccgtgtacttcgcgttcaacgagggcttcatccggagcaacatcaagagcgacgagatcaagatgttcaacgagcgcatccgccagcgccgcatcaacctcctcaagcagtccaaatactgctcgaactcccgcacggggaagggccgcaccaagcgcctccagcccatcgacgtgctgtcgaacaagatcgccaagttccgcaacagcaccaaccacaagtacgcgaactacatcgtcaagcagtgcctcaagcacaactgcgggcgcatccagatggagctgctcaaggggatctccaagaacgaccgcatcctcaaggactggacctacttcgacctccaggagaaaatcaagaatcaggccgagatccacgggatcgaggtcatcaaggtcgccccggcctacacgagccagcggtgctcgcagtgcgggtacatctgcaaggagaaccgctgcacccaggcgacgttcgagtgcaagcagtgcggctacaagacgcacgccgactacaacgccgccaagaacatcagcacgtacgacatcgagaacatcatcaacaagcagctcgcggtccagagcaagctccacagcaagaaatgcatggaggagtacatcgaggagctgggctacctcgactag

SEQ ID NO: 2078 - DNA, 1356 bp, Unknown
  Bacillus sp. multi
ctcggggtcaccatcaagatcatgaagtaccagatcctctgccccatgaacgtggactggacgatcttcgagaagcacctccggaacctcacctaccagatccgcaccatctccaaccggaccatccagcagctctgggagttcgacgccctctcgttcgactacttcaaggagcgcggcacctaccccaccgtccaggacttgtacggctgcacccagaagaaaattgacgggtacatctaccacacgctccagtcgaagtacccggacatccacaagggcaacatgagcacgaccctccaaaagattatcaagacctggaagtcccgccgcaacgagatccgcaagggcgagatgtccatccccagcttccgcaaccgcatccccatcgacctgcacaacaactcggtggacatcacgaaggagaagaacggcgactacatcgccgggatctccctgttcagccgcgacttccacaaggagaacgacgacgtgccgaagggcaaaatcttcgtgaagctggccacgcagaagcagaagtccatgaaggtcatcctggaccggctcatcaaccagacctacagcaagggcgcgtgcatgatccacaagtacaagaacaagtggtatctgagcatcacctacaagttcaacgcgatcaaggagaacaagttcgacaaggagctaatcatggggatcgacctcggcggcatcaacacggtgtacttcgccttcaacgaggggttcatccggagcaacatcaagtccgacgagatcaagatgttcaacgagcgcatccgccagcgccgcatcaacctgctcaagcagtccaaatactgttccaacagccgcacggggaaggggcgcaccaagcgcctccagcccatcgacgtgctctccaacaagatcgccaagttccgcaacagcacgaaccacaagtacgcgaactacatcgtgaagcagtgcctcaagcacaactgcgggcgcatccagatggagctgctcaaggggatctccaagaacgaccgcatcctcaaggactggacctacttcgacctccaggagaaaatcaagaatcaggcggagatccacggcatcgaggtcatcaaggtcgccccggcctacaccagccagcgctgctcgcagtgcggctacatctgcaaggagaaccgctgcacccaggcgacgttcgagtgcaagcagtgcggctacaagacgcacgccgactacaacgcggccaagaacatctccacgtacgacatcgagaacatcatcaacaagcagctcgccgtgcagtcgaagctccactccaagaaatgcatggaggagtacatcgaggagctgggctacctcgactga

SEQ ID NO: 2079 - DNA, 1356 bp, Unknown
  Bacillus sp. multi
ctcggcgtgaccatcaagatcatgaagtaccagatcctctgcccgatgaacgtggactggaccatcttcgagaagcacctccgcaacctgacctaccagatccggaccatcagcaaccggaccatccagcagctctgggagttcgacgcgctgtcgttcgactacttcaaggagcgcggcacctaccccacggtccaagacctgtacgggtgcacgcagaagaagatcgacggctacatctaccacaccctccagagcaagtacccggacatccacaagggcaacatgagcaccacgctccagaagatcatcaagacctggaaatctaggcggaacgagatccgcaagggcgagatgagcatcccgagcttccgcaaccgcatccccatcgacctgcacaacaactcggtggacatcacgaaggagaagaacggcgactacatcgcggggatcagcctgttcagtcgagacttccacaaggagaacgacgacgtgccgaagggcaaaatcttcgtgaagctcgccacgcagaagcagaagtcgatgaaggtcatcctggaccgcctcatcaaccagacctacagcaagggcgcgtgcatgatccacaagtacaagaacaagtggtatctgtccatcacctacaagttcaacgcgatcaaggagaacaagttcgacaaggagctcatcatgggcatcgacctcggcggcatcaacacggtgtacttcgccttcaacgagggcttcatccggagcaacatcaagtccgacgagatcaagatgttcaacgagcgcatccgccagcgccggatcaacctcctcaagcagagcaaatactgttccaactcccgcaccgggaagggccggaccaagcgcctccagcccatcgacgtgctcagcaacaagatcgccaagttccgcaacagcacgaaccacaagtacgcgaactacatcgtcaagcagtgcctcaagcacaactgcgggcgcatccagatggagctgctcaaggggatcagcaagaacgaccgcatcctcaaggactggacgtacttcgacctccaggagaaaattaagaaccaggccgagatccacggcatcgaggtcatcaaggtcgccccggcctacaccagccagcgctgctcccagtgcggctacatctgcaaggagaaccgctgcacccaggccacgttcgagtgcaagcagtgcggctacaagacccacgcggactacaacgccgccaagaacatctccacgtacgacatcgagaacatcatcaacaagcagctcgcggtgcagtccaagctccactccaagaagtgtatggaggagtacatcgaggagctgggctacctcgactga

SEQ ID NO: 2080 - DNA, 1356 bp, Unknown
  Bacillus sp. multi
ctcggcgtgacgatcaagatcatgaagtaccagatcctctgccccatgaacgtggactggacgatcttcgagaagcacctccgcaacctgacgtaccaagtacggacgatctcgaaccggacgatccagcagctctgggagttcgacgccctgtccttcgactacttcaaggagcgcggcacctaccccaccgtccaggacttgtacggctgcacgcagaagaagatcgacggctacatctaccacaccctccagagcaagtaccccgacatccacaagggcaacatgagcacgacgctccagaagatcatcaagacctggaagtcccgccgcaacgagatccgcaagggcgagatgtcgatccccagcttccggaaccgcatccccatcgacctccacaacaactcggtggacatcacgaaggagaagaatggcgactacatcgcggggatcagcctgttcagccgcgacttccacaaggagaacgacgacgtgccgaagggcaaaatcttcgtgaagctcgccacgcagaagcagaagtcgatgaaggtcatcctggaccgcctcatcaaccagacctacagcaagggcgcgtgcatgatccacaagtacaagaacaagtggtatctatctatcacctacaagttcaacgccatcaaggagaacaagttcgacaaggagcttatcatgggcatcgacctgggcgggatcaacaccgtgtacttcgccttcaacgagggcttcatccgctccaacatcaagagcgacgagatcaagatgttcaacgagcgcatccgccagcgccggatcaacctcctcaagcagtccaaatactgttccaactcccggacgggcaagggccgcacgaagcgcctccagcccatcgacgtgctctccaacaagatcgccaagttccgcaacagcaccaaccacaagtacgccaactacatcgtcaagcagtgcctcaagcacaactgcgggcgcatccagatggagctgctcaaggggatcagcaagaacgaccgcatcctcaaggactggacgtacttcgacctccaggagaaaatcaagaatcaggcggagatccacgggatcgaggtcatcaaggtcgccccggcctacacctcccagcgctgctcgcagtgcggctacatctgcaaggagaaccgctgcacccaggcgacgttcgagtgcaagcagtgcgggtacaagacccacgcggactacaacgccgccaagaacatcagcacctacgacatcgagaacatcatcaacaagcagctcgccgtgcagtcgaagctgcacagcaagaaatgcatggaggagtacatcgaggagctgggctacctggactga

SEQ ID NO: 2081 - DNA, 1356 bp, Unknown
  Bacillus sp. multi
ctcggggtgaccatcaagatcatgaagtaccagatcctctgccccatgaacgtggactggacgatcttcgagaagcacctccggaacctcacctaccaggttcggacgatctcgaaccgcaccatccagcagctctgggagttcgacgccctcagcttcgactacttcaaggagcgcggcacgtaccccaccgtccaagacctttacgggtgcacgcagaagaagattgacggctacatctaccacaccctccagagcaagtacccggacatccacaagggcaacatgagcaccacgctccagaaaatcattaagacctggaagtcgcgccgcaacgagatccggaagggcgagatgtccatcccctccttccgcaaccgcatccccatcgacctgcacaacaacagcgtggacatcacgaaggagaagaacggcgactacatcgcgggcatctccctgttcagccgggacttccacaaggagaacgacgacgtgccgaagggcaagatcttcgtcaagctggccacccagaagcagaagtccatgaaggtgatcctggaccggctcatcaaccagacgtactcgaagggcgcgtgcatgatccacaagtacaagaacaagtggtatctttcgatcacctacaagttcaacgccatcaaggagaacaagttcgacaaggagcttattatggggatcgacctcggcggcatcaacaccgtgtacttcgccttcaacgagggcttcatccggagcaacatcaagtccgacgagatcaagatgttcaacgagcgcatccgccagcgccgcatcaacctgctcaagcagagcaagtattgttccaacagccgcacggggaaggggcggaccaagcgcctccagcccatcgacgtcctgtcgaacaagatcgccaagttccgcaactccaccaaccacaagtacgccaactacatcgtgaagcagtgcctcaagcacaactgcgggcgcatccagatggagctgctcaagggcatctccaagaacgaccgcatcctcaaggactggacctacttcgacctccaggagaagattaagaaccaggccgagatccacggcatcgaggtcatcaaggtcgcgcccgcctacaccagccagcggtgctcgcagtgcggctacatctgcaaggagaaccgctgcacccaggcgacgttcgagtgcaagcagtgcggctacaagacccacgccgactacaacgccgccaagaacatctcgacctacgacatcgagaacatcatcaacaagcagctcgcggtccagagcaagctccacagcaagaagtgtatggaggagtacatcgaggagctgggctacctcgactga

SEQ ID NO: 2082 - DNA, 1356 bp, Unknown
  Bacillus sp. multi
ctcggggtgaccatcaagatcatgaagtaccagatcctctgcccgatgaacgtggactggaccatcttcgagaagcacctccggaacctcacgtaccaggttcggacgatctccaaccgcaccatccagcagctctgggagttcgacgcgctgtcgttcgactacttcaaggagcggggcacgtaccccaccgtccaggacttgtacggctgcacccagaagaagatcgacgggtacatctaccacacgctccagagcaagtaccccgacatccacaaggggaacatgagcacgaccctccagaagataatcaagacctggaagtcacgccgcaacgagatccgcaagggcgagatgtcgatcccgagcttccggaaccgcatccccatcgacctccacaacaactcggtggacatcacgaaggagaagaatggggactacatcgcgggcatcagcctgttcagcagagacttccacaaggagaacgacgacgtgccgaagggcaaaatcttcgtgaagctcgccacgcagaagcagaagtcgatgaaggtcatcctggaccggctcatcaaccagacctactcgaagggcgcgtgcatgatccacaagtacaagaacaagtggtacttgagcatcacctacaagttcaacgccatcaaggagaacaagttcgacaaggagctgattatgggcatcgacctgggcgggatcaacaccgtgtacttcgcgttcaacgagggcttcatccggtccaacatcaagtcggacgagatcaagatgttcaacgagcgcatccgccagcgccgcatcaacctgctcaagcagtccaaatactgttccaactcccggacggggaaggggcggacgaagcgcctccagcccatcgacgtcctgagcaacaagatcgccaagttccgcaacagcaccaaccacaagtacgcgaactacatcgtcaagcagtgcctcaagcacaactgcgggcgcatccagatggagctgctcaaggggatctccaagaacgaccgcatcctcaaggactggacgtacttcgacctccaggagaaaatcaagaatcaggccgagatccacgggatcgaggtcatcaaggtcgcgcccgcctacacctcccagcggtgctcgcagtgcggctacatctgcaaggagaaccggtgcacccaggccacgttcgagtgcaagcagtgcggctacaagacgcacgcggactacaacgccgccaagaacatctcgacgtacgacatcgagaacatcatcaacaagcagctcgcggtccagagcaagctccacagcaagaagtgcatggaggagtacatcgaggagctgggctacctggactga

SEQ ID NO: 2083 - DNA, 1356 bp, Unknown
  Bacillus sp. multi
ctcggcgtgaccatcaagatcatgaagtaccagatcctctgccccatgaacgtggactggaccatcttcgagaagcacctccgcaacctcacgtaccaagtgcggacgatctccaaccgcacgatccagcagctctgggagttcgacgccctcagcttcgactacttcaaggagcgcggcacctaccccacggtccaagacctttatggctgcacccagaagaagatagacggctacatctaccacaccctccagtcgaagtaccccgacatccacaagggcaacatgagcaccaccctccagaaaatcatcaagacctggaagtcccgccggaacgagatccgcaagggcgagatgtccatcccgagcttccggaaccgcatccccatcgacctgcacaacaacagcgtggacatcacgaaggagaagaacggggactacatcgcgggcatctcgctcttcagccgcgacttccacaaggagaacgacgacgtgccgaagggcaagatattcgtcaagctggccacccagaagcagaagtcgatgaaggtgatcctggaccgcctcatcaaccagacgtactcgaagggcgcgtgcatgatccacaagtacaagaacaagtggtatttgagcatcacctacaagttcaacgccatcaaggagaacaagttcgacaaggaactcatcatgggcatcgacctcggcggcatcaacaccgtgtacttcgccttcaacgaggggttcatccgctccaacatcaagtccgacgagatcaagatgttcaacgagcgcatccgccagcgccgcatcaacctcctcaagcagagcaagtattgttccaacagccgcacggggaagggccggaccaagcggctccagcccatcgacgtgctctccaacaagatcgccaagttccgcaactcgacgaaccacaagtacgccaactacatcgtgaagcagtgcctcaagcacaactgcgggcgcatccagatggagctgctcaagggcatctccaagaacgaccgcatcctcaaggactggacgtacttcgacctccaggagaaaattaagaaccaggccgagatccacgggatcgaggtcatcaaggtcgccccggcctacacgagccagcggtgctcgcagtgcggctacatctgcaaggagaaccgctgcacccaggccacgttcgagtgcaagcagtgcggctacaagacccacgcggactacaacgccgccaagaacatcagcacgtacgacatcgagaacatcatcaacaagcagctcgcggtgcagtccaagctccactccaagaagtgcatggaggagtacatcgaggagctgggctacctggactga

SEQ ID NO: 2084 - DNA, 1356 bp, Unknown
  Bacillus sp. multi
ctcggcgtgacgatcaagatcatgaagtaccagatcctctgccccatgaacgtggactggaccatcttcgagaagcacctccggaacctgacgtaccaagttcggacgatcagcaaccggacgatccagcagctctgggagttcgacgcgctctcgttcgactacttcaaggagcgcggcacctacccgacggtccaagacctgtacggctgcacgcagaagaagattgacgggtacatctaccacacgctccagagcaagtacccggacatccacaaggggaacatgagcacgaccctccagaaaatcatcaagacctggaagtcgcgccggaacgagatccgcaagggcgagatgagcatccccagcttccggaaccgcatccccatcgacctgcacaacaacagcgtggacatcacgaaggagaagaacggggactacatcgcggggatctccctgttcagccgggacttccacaaggagaacgacgacgtgccgaagggcaagatattcgttaagctcgccacccagaagcagaagtcgatgaaggtcatcctcgaccgcctcatcaaccagacctacagcaagggcgcgtgcatgatccacaagtacaagaacaagtggtatttgtccatcacctacaagttcaacgccatcaaggagaacaagttcgacaaggagttgattatgggcatcgacctcggcggcatcaacacggtgtacttcgcgttcaacgaggggttcatccgctccaacatcaagagcgacgagatcaagatgttcaacgagcgcatccggcagcgccggatcaacctcctcaagcagtccaagtattgctcgaactcccgcacgggcaaggggcgcaccaagcggctccagcccatcgacgtcctgagcaacaagatcgccaagttccgcaactccaccaaccacaagtacgcgaactacatcgtcaagcagtgcctcaagcacaactgcgggcgcatccagatggagctgctcaagggcatcagcaagaacgaccgcatcctcaaggactggacctacttcgacctccaggagaagattaagaaccaggcggagatccacggcatcgaggtcatcaaggtcgccccggcctacaccagccagcgctgctcccagtgcgggtacatctgcaaggagaaccgctgcacccaggccaccttcgagtgcaagcagtgcggctacaagacgcacgccgactacaacgcggccaagaacatctcgacctacgacatcgagaacatcatcaacaagcagctcgcggtgcagtccaagctgcacagcaagaaatgcatggaggagtacatcgaggagctgggctacctggactag

SEQ ID NO: 2085 - DNA, 1356 bp, Unknown
  Bacillus sp. multi
ctcggggtgacgatcaagatcatgaagtaccagatcctctgccccatgaacgtggactggacgatcttcgagaagcacctccggaacctcacctaccaagtccggacgatcagcaaccgcaccatccagcagctctgggagttcgacgcgctcagcttcgactacttcaaggagcggggcacgtaccccaccgtccaagatctctacggctgcacccagaagaagatcgacggctacatctaccacaccctccagagcaagtaccccgacatccacaagggcaacatgagcaccaccctccagaagattatcaagacctggaagtccagccgcaacgagatccgcaagggcgagatgagcatcccgagcttccgcaaccgcatccccatcgacctccacaacaacagcgtggacatcacgaaggagaagaacggcgactacatcgcgggcatcagcctgttctcccgcgacttccacaaggagaacgacgacgtgccgaagggcaagatcttcgtcaagctggccacgcagaagcagaagtccatgaaggtgatcctggaccgcctcatcaaccagacctactcgaagggcgcgtgcatgatccacaagtacaagaacaagtggtatttgagtatcacctacaagttcaacgccatcaaggagaacaagttcgacaaggaactgattatgggcatcgacctcggcgggatcaacaccgtgtacttcgccttcaacgagggcttcatccggtccaacatcaagtccgacgagatcaagatgttcaacgagcgcatccgccagcgccgcatcaacctcctcaagcagtccaagtattgctccaactcccgcacgggcaaggggcgcacgaagcggctccagcccatcgacgtgctgtccaacaagatcgccaagttccgcaactccacgaaccacaagtacgccaactacatcgtgaagcagtgcctcaagcacaactgcgggcgcatccagatggagctgctcaaggggatcagcaagaacgaccgcatcctcaaggactggacgtacttcgacctccaggagaagattaagaatcaggccgagatccacgggatcgaggtcatcaaggtcgcgcccgcctacacgagccagcggtgctcgcagtgcggctacatctgcaaggagaaccgctgcacccaggccacgttcgagtgcaagcagtgcgggtacaagacgcacgccgactacaacgccgccaagaacatctcgacgtacgacatcgagaacatcatcaacaagcagctcgccgtgcagagcaagctccacagcaagaagtgtatggaggagtacatcgaggagctgggctacctcgactga

SEQ ID NO: 2086 - DNA, 1356 bp, Unknown
  Bacillus sp. multi
ctcggcgtgacgatcaagatcatgaagtaccagatcctctgcccgatgaacgtggactggaccatcttcgagaagcacctccggaacctcacgtaccaagtgcggacgatctcgaaccggaccatccagcagctctgggagttcgacgccctgagcttcgactacttcaaggagcgcggcacctacccgaccgtccaagacctctacggctgcacccagaagaaaattgacggctacatctaccacaccctccagagcaagtaccccgacatccacaagggcaacatgagcaccaccctccagaaaatcatcaagacctggaagtccagccggaacgagatccgcaagggcgagatgagcatcccgagcttccggaaccgcatccccatcgacctgcacaacaactccgtggacatcacgaaggagaagaatggcgactacatcgcgggcatctccctgttcagccgcgacttccacaaggagaacgacgacgtgccgaagggcaaaatcttcgtgaagctggccacgcagaagcagaagtcgatgaaggtgatcctcgaccggctcatcaaccagacctactcgaagggcgcgtgcatgatccacaagtacaagaacaagtggtacttgagcatcacctacaagttcaacgcgatcaaggagaacaagttcgacaaggagctgataatgggcatcgacctcggcggcatcaacaccgtgtacttcgcgttcaacgagggcttcatccgctcgaacatcaagtccgacgagatcaagatgttcaacgagcgcatccgccagcggcgcatcaacctgctcaagcagagcaagtattgttccaacagccgcacggggaaggggcggaccaagcgcctccagcccatcgacgtgctctccaacaagatcgccaagttccgcaacagcacgaaccacaagtacgccaactacatcgtcaagcagtgcctcaagcacaactgcgggcgcatccagatggagctgctcaagggcatcagcaagaacgaccgcatcctcaaggactggacgtacttcgacctccaggagaagattaagaaccaggcggagatccacggcatcgaggtcatcaaggtcgccccggcctacaccagccagcggtgctcgcagtgcgggtacatctgcaaggagaaccgctgcacccaggcgacgttcgagtgcaagcagtgcggctacaagacgcacgccgactacaacgcggccaagaacatcagcacctacgacatcgagaacatcatcaacaagcagctcgcggtgcagtccaagctccactccaagaagtgtatggaggagtacatcgaggagctgggctacctcgactga

SEQ ID NO: 2087 - DNA, 1356 bp, Unknown
  Bacillus sp. multi
ctcggcgtcacgatcaagatcatgaagtaccagatcctctgccccatgaacgtggactggaccatcttcgagaagcacctccggaacctgacctaccaagtacggacgatcagcaaccgcaccatccagcagctctgggagttcgacgccctcagcttcgactacttcaaggagcgcggcacctacccgacggtccaggacttgtacgggtgcacgcagaagaaaatcgacggctacatctaccacaccctccagtcgaagtacccggacatccacaaggggaacatgagcacgaccctccagaaaatcatcaagacctggaagtccagccgcaacgagatccggaagggcgagatgtcgatcccctccttccgcaaccgcatccccatcgacctccacaacaactccgtggacatcacgaaggagaagaatggcgactacatcgcggggatctccctgttcagccgcgacttccacaaggagaacgacgacgtgccgaagggcaaaatcttcgtgaagctggccacgcagaagcagaagtccatgaaggtgatcctggaccgcctcatcaaccagacctactcgaagggcgcgtgcatgatccacaagtacaagaacaagtggtacttgagcatcacctacaagttcaacgcgatcaaggagaacaagttcgacaaggagctgataatggggatcgacctcggcggcatcaacaccgtgtacttcgccttcaacgagggcttcatccgctccaacatcaagtccgacgagatcaagatgttcaacgagcgcatccggcagcgccggatcaacctcctcaagcagagcaagtactgttccaactcccgcacgggcaaggggcgcaccaagcgcctccagcccatcgacgtcctcagcaacaagatcgccaagttccgcaacagcaccaaccacaagtacgcgaactacatcgtcaagcagtgcctcaagcacaactgcgggcgcatccagatggagctgctcaaggggatctccaagaacgaccgcatcctcaaggactggacctacttcgacctccaggagaaaattaagaatcaggcggagatccacggcatcgaggtcatcaaggtcgcgcccgcctacaccagccagcggtgctcgcagtgcggctacatctgcaaggagaaccgctgcacccaggcgacgttcgagtgcaagcagtgcggctacaagacgcacgcggactacaacgcggccaagaacatctccacctacgacatcgagaacatcatcaacaagcagctcgccgtccagtcgaagctccacagcaagaagtgcatggaggagtacatcgaggagctgggctacctcgactag

SEQ ID NO: 2088 - DNA, 1356 bp, Unknown
  Bacillus sp. multi
ctcggcgtgacgatcaagatcatgaagtaccagatcctctgccccatgaacgtggactggaccatcttcgagaagcacctccgcaacctcacgtaccaggtgcggacgatctccaaccgcacgatccagcagctctgggagttcgacgccctcagcttcgactacttcaaggagcggggcacctacccgacggtccaggacctctacgggtgcacgcagaagaaaatcgacgggtacatctaccacacgctccagagcaagtaccccgacatccacaaggggaacatgagcaccacgctccagaaaatcatcaagacctggaagtccagccgcaacgagatccggaagggcgagatgtccatccccagcttccgcaaccgcatccccatcgacctgcacaacaacagcgtggacatcacgaaggagaagaatggcgactacatcgcgggcatctcgctgttcagccgcgacttccacaaggagaacgacgacgtgccgaagggcaaaatcttcgttaagctggcgacccagaagcagaagtccatgaaggtcatcctcgaccggctcatcaaccagacctactcgaagggcgcgtgcatgatccacaagtacaagaacaagtggtatctcagcatcacctacaagttcaacgcgatcaaggagaacaagttcgacaaggaactgataatggggatcgacctgggcgggatcaacaccgtgtacttcgccttcaacgaggggttcatccgctccaacatcaagtcggacgagatcaagatgttcaacgagcgcatccgccagcggcgcatcaacctgctcaagcagagcaagtattgttcgaactcccgcaccgggaaggggcggacgaagcggctccagcccatcgacgtcctgtccaacaagatcgccaagttccgcaactccacgaaccacaagtacgcgaactacatcgtgaagcagtgcctcaagcacaactgcgggcgcatccagatggagctgctcaaggggatctccaagaacgaccgcatcctcaaggactggacctacttcgacctccaggaaaagattaagaatcaggccgagatccacgggatcgaggtcatcaaggtcgccccggcctacaccagccagcgctgctcgcagtgcgggtacatctgcaaggagaaccgctgcacccaggcgacgttcgagtgcaagcagtgcggctacaagacccacgccgactacaacgcggccaagaacatctccacctacgacatcgagaacatcatcaacaagcagctcgcggtgcagagcaagctgcacagcaagaagtgcatggaggagtacatcgaggagctgggctacctggactag

SEQ ID NO: 2089 - DNA, 1356 bp, Unknown
  Bacillus sp. multi
ctcggcgtgaccatcaagatcatgaagtaccagatcctctgcccgatgaacgtggactggacgatcttcgagaagcacctccgcaacctgacctaccaagtccggacgatctccaaccgcaccatccagcagctctgggagttcgacgcgctgagcttcgactacttcaaggagcgcggcacctaccccaccgtccaggacttgtacggctgcacccagaagaaaatagacggctacatctaccacaccctccagagcaagtaccccgacatccacaagggcaacatgagcaccaccctccagaaaatcattaagacctggaagtccagccgcaacgagatccgcaagggcgagatgtcgatcccctccttccgcaaccgcatccccatcgacctgcacaacaacagcgtggacatcacgaaggagaagaacggggactacatcgcggggatctcgctgttctcgcgcgacttccacaaggagaacgacgacgtgccgaagggcaagatcttcgtcaagctcgccacgcagaagcagaagtccatgaaggtcatcctcgaccgcctcatcaaccagacctactcgaagggcgcgtgcatgatccacaagtacaagaacaagtggtatttgtctatcacctacaagttcaacgcgatcaaggagaacaagttcgacaaggagctcataatggggatcgacctcggcggcatcaacacggtgtacttcgccttcaacgagggcttcatccggagcaacatcaagtccgacgagatcaagatgttcaacgagcgcatccgccagcgccggatcaacctgctcaagcagagcaaatactgttccaacagccgcacggggaaggggcggaccaagcgcctccagcccatcgacgtcctcagcaacaagatcgccaagttccgcaactccaccaaccacaagtacgccaactacatcgtcaagcagtgcctcaagcacaactgcgggcgcatccagatggagctgctcaagggcatcagcaagaacgaccgcatcctcaaggactggacctacttcgacctccaggagaagattaagaaccaggccgagatccacggcatcgaggtcatcaaggtcgccccggcctacaccagccagcgctgctcccagtgcgggtacatctgcaaggagaaccgctgcacccaggcgacgttcgagtgcaagcagtgcggctacaagacgcacgccgactacaacgccgccaagaacatctccacctacgacatcgagaacatcatcaacaagcagctcgcggtgcagagcaagctgcactccaagaagtgcatggaggagtacatcgaggagctgggctacctcgactag

SEQ ID NO: 2090 - DNA, 1335 bp, Unknown
  Bacillus sp. multi
atgaagtaccagatcctctgcccgatgaacgtggactggacgatcttcgagaagcacctccgcaacctcacgtaccaagtccggacgatcagcaaccgcaccatccagcagctctgggagttcgacgcgctgtccttcgactacttcaaggcgcgcggcacgtacccgaccgtccaagacctctacggctgcacccagaagaaaatagacggctacatctaccacacgctccagagcaagtacccggacatccacaaggggaacatgagcaccacgctccagaagatcatcaagacctggaagtcccgccgcaacgagatccgcaagggcgagatgtccatcccgtccttccggaaccgcatccccatcgacctccacaacaactcggtggacatcacgaaggagaagaatggcgactacatcgcggggatctccctcttcagccgcgacttccacaaggagaacgacgacgtgccgaagggcaagatattcatcaagctggcgacgcagaagcagaagtccatgaaggtcatcctggaccgcctcatcaaccagacctactcgaagggcgcgtgcatgatccacaagtacaagaacaagtggtatctcagtattacctacaagttcaacgcgatcaaggagaacaagttcgacaaggagctgataatggggatcgacatgggcgggatcaacacggtgtacttcgccttcaacgaggggttcatccgctccaacatcaagtccgacgagatcaagacgttcaacgagcgcatccgccagcggcgcatcaacctcctcaagcagagcaaatactgctccaactcccgcaccggcaagggccggacgaagcgcctccagcccatcgacgtcctgtccaacaagatcgccaagttccgcaacagcacgaaccacaagtacgccaactacatcatcaagcagtgcctcaagcacaactgcgggcgcatccagatggagctgctcaaggggatgtccaagaacgacaaggtgctcaaggactggacctacttcgacctccaggagaagatcaagaaccaggccgagatccacgggatcgaggtcatcaagatcgccccggcctacaccagccagcgctgctcccagtgcgggtacatctgcaaggagaaccgctgcacccaggccatgttcgagtgcaagcagtgcgggtacaagacccacgcggactacaacgcggccaagaacatctccacctacgacatcgagaacatcatcaacaagcagctcgcggtgcagtccaagctgcactccaagaagtgcatggccgagtacatggaggagctgggctacctcgactga

SEQ ID NO: 2091 - DNA, 1335 bp, Unknown
  Bacillus sp. multi
atgaagtaccagatcctctgcccgatgaacgtggactggacgatcttcgagaagcacctccggaacctgacgtaccaagtacggacgatctccaaccgcacgatccagcagctctgggagttcgacgcgctcagcttcgactacttcaaggcgcgcggcacctacccgacggtccaggacctctacgggtgcacgcagaagaaaatcgacgggtacatctaccacaccctccagagcaagtaccccgacatccacaagggcaacatgagcacgacgctccagaagattattaagacctggaagtcgcgccggaacgagatccgcaagggcgagatgagcatcccgagcttccggaaccgcatccccatcgacctccacaacaacagcgtggacatcacgaaggagaagaatggcgactacatcgccgggatctccctgttcagccgggacttccacaaggagaacgacgacgtgccgaagggcaagatattcattaagctcgccacccagaagcagaagtccatgaaggtgatcctcgaccggctcatcaaccagacgtactcgaagggcgcgtgcatgatccacaagtacaagaacaagtggtacctgtcaatcacctacaagttcaacgccatcaaggagaacaagttcgacaaggagcttatcatgggcatcgacatgggcggcatcaacaccgtgtacttcgccttcaacgagggcttcatccggtccaacatcaagagcgacgagatcaagaccttcaacgagcgcatccgccagcgccgcatcaacctcctcaagcagtccaagtattgctcgaactcgcgcaccgggaaggggcgcaccaagcggctccagcccatcgacgtgctgtcgaacaagatcgccaagttccgcaacagcaccaaccacaagtacgccaactacatcatcaagcagtgcctcaagcacaactgcgggcgcatccagatggagctgctcaagggcatgagcaagaacgacaaggtgctcaaggactggacgtacttcgacctccaggagaagatcaagaaccaggcggagatccacgggatcgaggtcatcaagatcgcgcccgcctacaccagccagcgctgctcccagtgcgggtacatctgcaaggagaaccggtgcacccaggccatgttcgagtgcaagcagtgcggctacaagacccacgccgactacaacgcggccaagaacatcagcacgtacgacatcgagaacatcatcaacaagcagctcgcggtccagtcgaagctccacagcaagaagtgcatggccgagtacatggaggagctgggctacctggactga

SEQ ID NO: 2092 - DNA, 1335 bp, Unknown
  Bacillus sp. multi
atgaagtaccagatcctctgcccgatgaacgtggactggaccatcttcgagaagcacctccggaacctgacgtaccaagtccggacgatctcgaaccgcacgatccagcagctctgggagttcgacgccctcagcttcgactacttcaaggcgcggggcacctaccccacggtccaagatctatacggctgcacccagaagaaaatcgacgggtacatctaccacacgctccagagcaagtacccggacatccacaaggggaacatgagcaccacgctccagaagattatcaagacctggaagtcccgccgcaacgagatccgcaagggcgagatgtccatcccctccttccgcaaccgcatccccatcgacctgcacaacaactccgtggacatcacgaaggagaagaatggcgactacatcgcgggcatctccctgttcagccgcgacttccacaaggagaacgacgacgtgccgaagggcaaaatcttcatcaagctcgccacccagaagcagaagtccatgaaggtcatcctggaccgcctcatcaaccagacgtacagcaagggcgcgtgcatgatccacaagtacaagaacaagtggtatcttagcatcacctacaagttcaacgccatcaaggagaacaagttcgacaaggagctgatcatggggatcgacatgggcggcatcaacacggtgtacttcgcgttcaacgaggggttcatccgctccaacatcaagagcgacgagatcaagacgttcaacgagcgcatccgccagcgccgcatcaacctgctcaagcagtccaagtactgttccaacagccgcaccgggaagggccgcacgaagcgcctccagcccatcgacgtcctctccaacaagatcgccaagttccgcaacagcacgaaccacaagtacgcgaactacatcatcaagcagtgcctcaagcacaactgcgggcgcatccagatggagctgctcaagggcatgtccaagaacgacaaggtgctcaaggactggacgtacttcgacctccaggagaagatcaagaaccaggcggagatccacgggatcgaggtcatcaagatcgccccggcctacacctcgcagcggtgctcccagtgcggctacatctgcaaggagaaccggtgcacccaggcgatgttcgagtgcaagcagtgcggctacaagacccacgcggactacaacgccgccaagaacatctcgacgtacgacatcgagaacatcatcaacaagcagctcgcggtgcagtcgaagctccacagcaagaagtgcatggccgagtacatggaggagctgggctacctcgactga

SEQ ID NO: 2093 - DNA, 1335 bp, Unknown
  Bacillus sp. multi
atgaagtaccagatcctctgccccatgaacgtggactggaccatcttcgagaagcacctccgcaacctgacgtaccaagttcggacgatcagcaaccgcacgatccagcagctctgggagttcgacgccctgtccttcgactacttcaaggcgcgcggcacgtaccccacggtccaagacctctacggctgcacccagaagaagatcgacgggtacatctaccacaccctccagagcaagtacccggacatccacaaggggaacatgagcacgaccctccagaagatcatcaagacctggaaatcgcgccgcaacgagatccgcaagggcgagatgagcatcccgagcttccggaaccgcatccccatcgacctccacaacaactcggtggacatcacgaaggagaagaatggcgactacatcgcgggcatctccctgttcagccgcgacttccacaaggagaacgacgacgtgccgaagggcaaaatcttcatcaagctggcgacccagaagcagaagtccatgaaggtgatcctcgaccgcctcatcaaccagacgtactcgaagggcgcgtgcatgatccacaagtacaagaacaagtggtatctgtcaatcacctacaagttcaacgcgatcaaggagaacaagttcgacaaggagcttatcatggggatcgacatgggcggcatcaacacggtgtacttcgccttcaacgaggggttcatccggtccaacatcaagtcggacgagatcaagaccttcaacgagcgcatccgccagcgccgcatcaacctgctcaagcagagcaagtattgttcgaactcccgcacggggaagggccgcacgaagcgcctccagcccatcgacgtcctctccaacaagatcgccaagttccgcaacagcaccaaccacaagtacgccaactacatcatcaagcagtgcctcaagcacaactgcgggcgcatccagatggagctgctcaagggcatgagcaagaacgacaaggtgctcaaggactggacctacttcgacctccaggagaagatcaagaaccaggcggagatccacggcatcgaggtcatcaagatcgccccggcctacaccagccagcgctgctcgcagtgcggctacatctgcaaggagaaccggtgcacccaggccatgttcgagtgcaagcagtgcgggtacaagacgcacgcggactacaacgccgccaagaacatctccacctacgacatcgagaacatcatcaacaagcagctcgccgtgcagtccaagctccacagcaagaagtgcatggccgagtacatggaggagctgggctacctcgactag

SEQ ID NO: 2094 - DNA, 1335 bp, Unknown
  Bacillus sp. multi
atgaagtaccagatcctctgcccgatgaacgtggactggaccatcttcgagaagcacctccgcaacctgacgtaccaagttcggacgatctcgaaccgcacgatccagcagctctgggagttcgacgccctgtccttcgactacttcaaggcgcggggcacgtacccgaccgtccaagatctctacggctgcacgcagaagaaaatcgacggctacatctaccacaccctccagtcgaagtacccggacatccacaagggcaacatgagcaccaccctccagaaaatcatcaagacctggaagtcccgccgcaacgagatccggaagggcgagatgagcatccccagcttccgcaaccgcatccccatcgacctccacaacaactcggtggacatcacgaaggagaagaacggcgactacatcgcgggcatctccctgttctcgcgcgacttccacaaggagaacgacgacgtgccgaagggcaaaatcttcattaagctggccacccagaagcagaagtccatgaaggtcatcctcgaccgcctcatcaaccagacctacagcaagggcgcgtgcatgatccacaagtacaagaacaagtggtacctgagcatcacctacaagttcaacgcgatcaaggagaacaagttcgacaaggagctgataatgggcatcgacatgggcggcatcaacaccgtgtacttcgcgttcaacgagggcttcatccgcagcaacatcaagagcgacgagatcaagacgttcaacgagcgcatccggcagcgccgcatcaacctcctcaagcagtccaagtactgctcgaactcgcgcaccgggaaggggcgcaccaagcgcctccagcccatcgacgtgctctccaacaagatcgccaagttccgcaactccacgaaccacaagtacgccaactacatcatcaagcagtgcctcaagcacaactgcgggcgcatccagatggagctgctcaagggcatgtccaagaacgacaaggtgctcaaggactggacgtacttcgacctccaggagaaaatcaagaatcaggccgagatccacggcatcgaggtcatcaagatcgcgcccgcctacaccagccagcggtgcagccagtgcgggtacatctgcaaggagaaccgctgcacccaggcgatgttcgagtgcaagcagtgcgggtacaagacgcacgcggactacaacgccgccaagaacatctccacctacgacatcgagaacatcatcaacaagcagctcgccgtccagagcaagctgcacagcaagaagtgcatggccgagtacatggaggagctgggctacctggactga

SEQ ID NO: 2095 - DNA, 1335 bp, Unknown
  Bacillus sp. multi
atgaagtaccagatcctctgcccgatgaacgtggactggaccatcttcgagaagcacctccgcaacctgacctaccaagtacggacgatctccaaccggaccatccagcagctctgggagttcgacgcgctgtccttcgactacttcaaggcgcggggcacgtacccgacggtccaggatctctacggctgcacccagaagaaaatcgacgggtacatctaccacacgctccagagcaagtaccccgacatccacaagggcaacatgagcaccaccctccagaaaatcatcaagacctggaagtcccggcgcaacgagatccgcaagggcgagatgtccatcccgtcgttccgcaaccgcatccccatcgacctccacaacaactcggtggacatcacgaaggagaagaatggcgactacatcgcgggcatcagcctgttcagccgcgacttccacaaggagaacgacgacgtgccgaagggcaagatattcatcaagctggcgacccagaagcagaagtccatgaaggtgatcctcgaccggctgatgaaccagacgtacagcaagggcgcgtgcatgatccacaagtacaagaacaagtggtacttgtccatcacctacaagttcaacgccatcaaggagaacaagttcgacaaggagctaatcatggggatcgacatgggcgggatcaacaccgtgtacttcgccttcaacgagggcttcatccggagcaacatcaagagcgacgagatcaagaccttcaacgagcgcatccgccagcgccgcatcaacctcctcaagcagagcaagtattgctcgaactcccggacggggaaggggcgcacgaagcgcctccagcccatcgacgtcctctccaacaagatcgccaagttccgcaactccaccaaccacaagtacgccaactacatcatcaagcagtgcctcaagcacaactgcgggcgcatccagatggagctgctcaagggcatctccaagaacgacaaggtgctcaaggactggacgtacttcgacctccaggagaagatcaagaaccaggccgagatccacggcatcgaggtcatcaagatcgcgcccgcctacacctcccagcggtgctcccagtgcgggtacatctgcaaggagaaccgctgcacccaggccatgttcgagtgcaagcagtgcggctacaagacccacgccgactacaacgccgccaagaacatctccacgtacgacatcgagaacatcatcaacaagcagctcgccgtgcagtccaagctccacagcaagaaatgcatggccgagtacatggaggagctgggctacctcgactag

SEQ ID NO: 2096 - DNA, 1335 bp, Unknown
  Bacillus sp. multi
atgaagtaccagatcctctgcccgatgaacgtggactggacgatcttcgagaagcacctccgcaacctgacctaccaagtacggacgatctccaaccgcaccatccagcagctctgggagttcgacgccctcagcttcgactacttcaaggcgcgcggcacctacccgacggtccaggacctatacggctgcacgcagaagaaaatcgacggctacatctaccacaccctccagagcaagtacccggacatccacaagggcaacatgagcacgacgctccagaaaatcatcaagacctggaagtcccgccgcaacgagatccggaagggcgagatgagcatcccctccttccgcaaccgcatccccatcgacctgcacaacaactcggtggacatcacgaaggagaagaatggcgactacatcgcgggcatctcgctgttctcccgcgacttccacaaggagaacgacgacgtgccgaagggcaaaatcttcatcaagctggccacccagaagcagaagtccatgaaggtcatcctggaccggctgatgaaccagacgtacagcaagggcgcgtgcatgatccacaagtacaagaacaagtggtacttgagcatcacctacaagttcaacgccatcaaggagaacaagttcgacaaggagctgattatgggcatcgacatgggcggcatcaacacggtgtacttcgccttcaacgaggggttcatccggagcaacatcaagtcggacgagatcaagaccttcaacgagcgcatccggcagcgccgcatcaacctcctcaagcagagcaagtattgttccaactcccggacgggcaagggccgcaccaagcggctccagcccatcgacgtgctgtcgaacaagatcgccaagttccgcaacagcacgaaccacaagtacgcgaactacatcatcaagcagtgcctcaagcacaactgcgggcgcatccagatggagctgctcaagggcatcagcaagaacgacaaggtgctcaaggactggacctacttcgacctccaggagaagatcaagaaccaggccgagatccacggcatcgaggtcatcaagatcgcgcccgcctacacgagccagcggtgcagccagtgcggctacatctgcaaggagaaccggtgcacccaggccatgttcgagtgcaagcagtgcgggtacaagacgcacgccgactacaacgcggccaagaacatctcgacgtacgacatcgagaacatcatcaacaagcagctcgccgtgcagtccaagctgcactccaagaagtgcatggccgagtacatggaggagctgggctacctcgactga

SEQ ID NO: 2097 - DNA, 1335 bp, Unknown
  Bacillus sp. multi
atgaagtaccagatcctctgcccgatgaacgtggactggacgatcttcgagaagcacctccggaacctcacgtaccaagtccggacgatctcgaaccgcacgatccagcagctctgggagttcgacgcgctcagcttcgactacttcaaggcgcgcggcacgtacccgaccgtccaagacctatacggctgcacgcaaaagaagatcgacggctacatctaccacaccctccagagcaagtacccggacatccacaaggggaacatgagcaccacgctccagaaaatcatcaagacctggaaaagcaggcgcaacgagatccggaagggcgagatgagcatcccgtccttccgcaaccgcatccccatcgacctccacaacaactcggtggacatcacgaaggagaagaacggcgactacatcgccgggatctcgctgttcagccgggatttccacaaggagaacgacgacgtgccgaagggcaagatcttcatcaagctggccacccagaagcagaagtccatgaaggtgatcctcgaccggctcatgaaccagacctacagcaagggcgcgtgcatgatccacaagtacaagaacaagtggtatctctccatcacctacaagttcaacgccatcaaggagaacaagttcgacaaggagctgatcatggggatcgacatgggcggcatcaacaccgtgtacttcgcgttcaacgaggggttcatccgctccaacatcaagtccgacgagatcaagacgttcaacgagcgcatccggcagcggcgcatcaacctgctcaagcagagcaagtattgctccaactcccggacgggcaagggccgcaccaagcgcctccagcccatcgacgtgctgtccaacaagatcgccaagttccgcaacagcaccaaccacaagtacgccaactacatcatcaagcagtgcctcaagcacaactgcgggcgcatccagatggagctgctcaaggggatcagcaagaacgacaaggtgctcaaggactggacgtacttcgacctccaggagaaaatcaagaaccaggcggagatccacggcatcgaggtcatcaagatcgcgcccgcctacacctcgcagcggtgcagccagtgcggctacatctgcaaggagaaccggtgcacccaggcgatgttcgagtgcaagcagtgcgggtacaagacccacgcggactacaacgcggccaagaacatctccacgtacgacatcgagaacatcatcaacaagcagctcgccgtgcagtcgaagctgcacagcaagaagtgcatggccgagtacatggaggagctgggctacctcgactag

SEQ ID NO: 2098 - DNA, 1335 bp, Unknown
  Bacillus sp. multi
atgaagtaccagatcctctgcccgatgaacgtggactggaccatcttcgagaagcacctccgcaacctcacgtaccaagtacggacgatctccaaccggaccatccagcagctctgggagttcgacgcgctctcgttcgactacttcaaggcgcgcggcacgtaccccaccgtccaagacctttacggctgcacccagaagaaaatcgacgggtacatctaccacacgctccagagcaagtacccggacatccacaaggggaacatgagcacgacgctccagaagatcatcaagacctggaagtcgcgccggaacgagatccgcaagggcgagatgtcgatcccgagcttccgcaaccgcatccccatcgacctgcacaacaactccgtggacatcacgaaggagaagaacggcgactacatcgcgggcatctcgctgttcagccgggacttccacaaggagaacgacgacgtgccgaagggcaaaatcttcatcaagctggcgacccagaagcagaagtccatgaaggtcatcctggaccgcctcatgaaccagacctacagcaagggcgcgtgcatgatccacaagtacaagaacaagtggtatctgagcatcacctacaagttcaacgcgatcaaggagaacaagttcgacaaggagctgattatggggatcgacatgggcgggatcaacaccgtgtacttcgcgttcaacgagggcttcatccggtccaacatcaagtccgacgagatcaagacgttcaacgagcgcatccgccagcgccggatcaacctgctcaagcagtccaagtattgctccaactcccggacggggaaggggcggaccaagcgcctccagcccatcgacgtgctgtccaacaagatcgccaagttccgcaactcgaccaaccacaagtacgcgaactacatcatcaagcagtgcctcaagcacaactgcgggcgcatccagatggagctgctcaagggcatcagcaagaacgacaaggtgctcaaggactggacctacttcgacctccaggaaaagattaagaaccaggcggagatccacggcatcgaggtcatcaagatcgccccggcctacaccagccagcggtgctcgcagtgcggctacatctgcaaggagaaccggtgcacccaggccatgttcgagtgcaagcagtgcggctacaagacccacgcggactacaacgccgccaagaacatcagcacctacgacatcgagaacatcatcaacaagcagctcgccgtgcagtccaagctccacagcaagaagtgcatggccgagtacatggaggagctgggctacctcgactga

SEQ ID NO: 2099 - DNA, 1335 bp, Unknown
  Bacillus sp. multi
atgaagtaccagatcctctgccccatgaacgtggactggacgatcttcgagaagcacctccggaacctcacgtaccaggttcggacgatctcgaaccggaccatccagcagctctgggagttcgacgccctcagcttcgactacttcaaggcgcggggcacgtacccgacggtccaagacttgtacggctgcacgcagaagaagattgacggctacatctaccacaccctccagagcaagtaccccgacatccacaaggggaacatgagcaccacgctccagaaaatcatcaagacctggaagtcccgccgcaacgagatccgcaagggcgagatgagcatcccctccttccgcaaccgcatccccatcgacctccacaacaacagcgtggacatcacgaaggaaaagaacggcgactacatcgcgggcatctcgctgttcagccgcgacttccacaaggagaacgacgacgtgccgaagggcaaaatcttcatcaagctggccacccagaagcagaagtccatgaaggtcatcctcgaccggctcatgaaccagacctacagcaagggcgcgtgcatgatccacaagtacaagaacaagtggtatctgagcatcacctacaagttcaacgccatcaaggagaacaagttcgacaaggagttaatcatgggcatcgacatgggcgggatcaacaccgtgtacttcgccttcaacgagggcttcatccgctccaacatcaagtccgacgagatcaagaccttcaacgagcgcatccgccagcggcgcatcaacctcctcaagcagagcaagtactgctccaactcccgcaccggcaagggccgcaccaagcgcctccagcccatcgacgtgctgtccaacaagatcgccaagttccgcaacagcaccaaccacaagtacgccaactacatcatcaagcagtgcctcaagcacaactgcgggcgcatccagatggagctgctcaaggggatcagcaagaacgacaaggtgctcaaggactggacgtacttcgacctccaggagaaaatcaagaaccaggccgagatccacggcatcgaggtcatcaagatcgcgcccgcctacaccagccagcggtgcagccagtgcggctacatctgcaaggagaaccggtgcacccaggcgatgttcgagtgcaagcagtgcgggtacaagacccacgccgactacaacgcggccaagaacatctcgacctacgacatcgagaacatcatcaacaagcagctcgccgtgcagtccaagctgcactccaagaagtgcatggccgagtacatggaggagctgggctacctcgactga

SEQ ID NO: 2100 - DNA, 1356 bp, Unknown
  Bacillus sp. multi
ctcggcgtgaccatcaagatcatgaagtaccagatcctctgcccgatgaacgtggactggacgatcttcgagaagcagctccggaacctcacctaccaggtgcggacgatctccaaccggaccatccagcagctctgggagttcgacgccctcagcttcgactacttcaaggagcgcgggacgtacccgaccgtccaagacctgtacggctgcacccagaagaaaatcgacggctacatctaccacaccctccagagcaagtacccggacatccacaagggcaacatgagcaccaccctccagaaaatcatcaagacctggaagtcgcgccgcaacgagatccggaagggcgagatgtccatccccagcttccggaaccgcatccccatcgacctgcacaacaacagcgtggacatcatcaaggagaagaatggcgactacatcgcggggatcagcctgttctcgcgggacttccacaaggagaacggggacgtgccgaagggcaagatcttcgtcaagctcggcacccagaagcagaagtccatgaaggtgatcctggaccggctcatcaaccagacctacagcaagggcgcgtgcatgatccacaagtacaagaacaagtggtatttgagcatcacctacaagttcaacgccatcaaggagaacaagttcgacaaggagctaatcatggggatcgacatgggcgggatcaacaccgtgtacttcgcgttcaacgaggggttcatccgctccaacatcaagagcgacgagatcaagatgttcaacgagcgcatccgccagcgccggatcaacctcctcaagcagagcaaatactgctccaactcccgcaccggcaagggccgcaccaagcgcctccagcccatcgacgtcctcagcaacaagatcgccaagttccgcaacagcacgaaccacaagtacgccaactacatcgtgaagcagtgcctcaagcacaactgcgggcgcatccagatggagctgctcaagggcatcagcaagaacgacaaggtgctcaaggactggacgtacttcgacctccaggagaagatcaagaaccaggcggagatatacgggatcgaggtcatcaaggtggtgcccgcctacacgagccagcgctgctcccagtgcgggtacatctgcaaggagaaccgctgcacccaggccatgttcgagtgcaagcagtgcggctacaagacgcacgccgactacaacgcggccaagaacatctccacgtacgacatcgagaacatcatcaacaagcagctcgccgtgcagtccaagctccacagcaagaagtgcatggaggagtacatcgaggagctgggctacctggactag

SEQ ID NO: 2101 - DNA, 1356 bp, Unknown
  Bacillus sp. multi
ctgggcgtcaccatcaagatcatgaagtaccagatcctctgcccgatgaacgtggactggaccatcttcgagaagcagctccgcaacctgacgtaccaagtacggacgatctcgaaccggaccatccagcagctctgggagttcgacgccctgtccttcgactacttcaaggagcgcgggacgtacccgaccgtccaggacttgtacgggtgcacgcagaagaagatagacggctacatctaccacaccctccagtcgaagtaccccgacatccacaagggcaacatgagcaccaccctccagaaaatcatcaagacctggaagtcccgccgcaacgagatccgcaagggcgagatgagcatcccgtccttccgcaaccgcatccccatcgacctccacaacaactcggtggacatcatcaaggagaagaacggcgactacatcgcggggatcagcctgttctcgcgcgacttccacaaggagaacggcgacgtgccgaagggcaagatcttcgtgaagctggggacgcagaagcagaagtcgatgaaggtcatcctggaccggctcatcaaccagacgtactcgaagggcgcgtgcatgatccacaagtacaagaacaagtggtacttgagcatcacctacaagttcaacgcgatcaaggagaacaagttcgacaaggagctcatcatgggcatcgacatgggcgggatcaacacggtgtacttcgcgttcaacgaggggttcatccgctcgaacatcaagtcggacgagatcaagatgttcaacgagcgcatccgccagcggcggatcaacctgctcaagcagtccaagtattgctccaactcgcggacgggcaaggggcgcacgaagcgcctccagcccatcgacgtcctgtccaacaagatcgccaagttccgcaactcgacgaaccacaagtacgcgaactacatcgtgaagcagtgcctcaagcacaactgcgggcgcatccagatggagctgctcaaggggatctccaagaacgacaaggtgctcaaggactggacctacttcgacctccaggagaagattaagaaccaggcggagatatacggcatcgaggtcatcaaggtggtccccgcctacacctcccagcggtgctcgcagtgcggctacatctgcaaggagaaccgctgcacccaggccatgttcgagtgcaagcagtgcggctacaagacccacgcggactacaacgccgccaagaacatctcgacgtacgacatcgagaacatcatcaacaagcagctcgccgtgcagagcaagctgcacagcaagaagtgcatggaggagtacatcgaggagctgggctacctcgactga

SEQ ID NO: 2102 - DNA, 1356 bp, Unknown
  Bacillus sp. multi
ctcggcgtcaccatcaagatcatgaagtaccagatcctctgcccgatgaacgtggactggaccatcttcgagaagcagctccggaacctcacctaccaggtccggacgatctcgaaccgcacgatccagcagctctgggagttcgacgccctctcgttcgactacttcaaggagcgcggcacgtaccccaccgtccaggacttgtacggctgcacgcagaagaagattgacgggtacatctaccacaccctccagtcgaagtacccggacatccacaagggcaacatgagcaccaccctccagaaaatcatcaagacctggaagtcccggcgcaacgagatccgcaagggcgagatgtcgatcccgtccttccggaaccgcatccccatcgacctccacaacaacagcgtggacatcatcaaggagaagaacggcgactacatcgcggggatcagcctcttcagccgcgacttccacaaggagaacggcgacgtgccgaagggcaagatcttcgtcaagctcgggacgcagaagcagaagtcgatgaaggtgatcctggaccggctcatcaaccagacctacagcaagggcgcgtgcatgatccacaagtacaagaacaagtggtacctttccatcacctacaagttcaacgccatcaaggagaacaagttcgacaaggagctgattatgggcatcgacatgggcggcatcaacaccgtgtacttcgccttcaacgagggcttcatccggtccaacatcaagtccgacgagatcaagatgttcaacgagcgcatccgccagcgccggatcaacctcctcaagcagagcaaatactgttccaactcccgcacgggcaagggccgcacgaagcgcctccagcccatcgacgtgctgagcaacaagatcgccaagttccgcaacagcaccaaccacaagtacgccaactacatcgtgaagcagtgcctcaagcacaactgcgggcgcatccagatggagctgctcaagggcatcagcaagaacgacaaggtgctcaaggactggacctacttcgacctccaggagaagatcaagaaccaggcggagatatatggcatcgaggtcatcaaggtggtcccggcctacaccagccagcggtgctcccagtgcggctacatctgcaaggagaaccggtgcacccaggcgatgttcgagtgcaagcagtgcggctacaagacccacgccgactacaacgccgccaagaacatctccacctacgacatcgagaacatcatcaacaagcagctcgcggtgcagagcaagctccactccaagaagtgcatggaggagtacatcgaggagctgggctacctcgactga

SEQ ID NO: 2103 - DNA, 1356 bp, Unknown
  Bacillus sp. multi
ctcggcgtcaccatcaagatcatgaagtaccagatcctctgcccgatgaacgtggactggaccatcttcgagaagcagctccgcaacctgacgtaccaggtgcggacgatctccaaccgcacgatccagcagctctgggagttcgacgcgctctccttcgactacttcaaggagcgcggcacctaccccaccgtccaagacctttacggctgcacccagaagaagattgacggctacatctaccacaccctccagagcaagtaccccgacatccacaaggggaacatgagcacgaccctccagaaaatcatcaagacctggaagtcccgccggaacgagatccgcaagggcgagatgagcatcccgtccttccgcaaccgcatccccatcgacctgcacaacaacagcgtggacatcatcaaggagaagaacggcgactacatcgccgggatcagcctgttcagccgcgacttccacaaggagaacggcgacgtgccgaagggcaagatcttcgtgaagctcggcacccagaagcagaagtccatgaaggtgatcctcgaccggctcatcaaccagacgtactcgaagggcgcgtgcatgatccacaagtacaagaacaagtggtacttgagcatcacctacaagttcaacgcgatcaaggagaacaagttcgacaaggagctaatcatgggcatcgacatgggcggcatcaacacggtgtacttcgcgttcaacgagggcttcatccgcagcaacatcaagagcgacgagatcaagatgttcaacgagcgcatccgccagcggcgcatcaacctgctcaagcagagcaagtattgctccaacagccggacgggcaagggccgcacgaagcgcctccagcccatcgacgtcctctcgaacaagatcgccaagttccgcaactcgaccaaccacaagtacgcgaactacatcgtgaagcagtgcctcaagcacaactgcgggcgcatccagatggagctgctcaaggggatcagcaagaacgacaaggtgctcaaggactggacctacttcgacctccaggaaaagatcaagaaccaggcggaaatctacggcatcgaggtcatcaaggtggtgcccgcctacaccagccagcggtgcagccagtgcggctacatctgcaaggagaaccggtgcacccaggcgatgttcgagtgcaagcagtgcggctacaagacgcacgccgactacaacgccgccaagaacatctcgacgtacgacatcgagaacatcatcaacaagcagctcgccgtccagtcgaagctccacagcaagaagtgcatggaggagtacatcgaggagctgggctacctcgactag

SEQ ID NO: 2104 - DNA, 1356 bp, Unknown
  Bacillus sp. multi
ctcggggtcaccatcaagatcatgaagtaccagatcctctgccccatgaacgtggactggaccatcttcgagaagcagctccggaacctcacgtaccaagtgcggacgatctccaaccggacgatccagcagctctgggagttcgacgccctgtccttcgactacttcaaggagcggggcacgtaccccacggtccaggatctgtacggctgcacccagaagaagatagacggctacatctaccacaccctccagagcaagtaccccgacatccacaagggcaacatgagcacgacgctccagaaaatcatcaagacctggaagtcccgccgcaacgagatccgcaagggcgagatgagcatcccgtccttccgcaaccgcatccccatcgacctccacaacaactcggtggacatcatcaaggagaagaatggggactacatcgcggggatctccctgttctcccgcgacttccacaaggagaacggcgacgtcccgaagggcaagatattcgtcaagctgggcacccagaagcagaagtccatgaaggtgatcctcgaccgcctcatcaaccagacctacagcaagggcgcgtgcatgatccacaagtacaagaacaagtggtacctgagcatcacctacaagttcaacgcgatcaaggagaacaagttcgacaaggagcttatcatgggcatcgacatgggcgggatcaacaccgtgtacttcgccttcaacgagggcttcatccggtccaacatcaagagcgacgagatcaagatgttcaacgagcgcatccggcagcggcgcatcaacctgctcaagcagtccaagtactgttccaactcccgcacggggaaggggcgcaccaagcgcctccagcccatcgacgtcctgtccaacaagatcgccaagttccgcaacagcaccaaccacaagtacgccaactacatcgtgaagcagtgcctcaagcacaactgcgggcgcatccagatggagctgctcaagggcatcagcaagaacgacaaggtgctcaaggactggacgtacttcgacctccaggagaagattaagaaccaggccgagatctacggcatcgaggtcatcaaggtcgtgcccgcctacacctcccagcggtgctcgcagtgcggctacatctgcaaggagaaccgctgcacccaggccatgttcgagtgcaagcagtgcgggtacaagacccacgccgactacaacgccgccaagaacatctccacctacgacatcgagaacatcatcaacaagcagctcgccgtccagagcaagctgcactccaagaagtgcatggaggagtacatcgaggagctgggctacctcgactag

SEQ ID NO: 2105 - DNA, 1335 bp, Unknown
  Bacillus sp. multi
atgaagtaccagatcctctgccccatgaacgtggactggaccatcttcgagaagcacctccgcaacctgacgtaccaggtgcggacgatcagcaaccggacgatccagcagctctgggagttcgacgcgctctccttcgactacttcaaggagcgcggcacgtaccccaccgtccaggatctctacgggtgcacgcagaagaagatcgacggctacatctaccacaccctccagagcaagtacccggacatccacaagggcaacatgagcacgacgctccagaaaatcatcaagacctggaagtcccggcggaacgagatccgcaagggcgagatgtccatcccgagcttccggaaccgcatccccatcgacctgcacaacaacagcgtggacatcatcaaggagaagaacggggactacatcgccgggatctccctcttcagccgcgacttccacaaggagaacggcgacgtcccgaagggcaaaatcttcgttaagctgggcacccagaagcagaagtccatgaaggtgatcctcgaccggctcatcaaccagacgtactcgaagggcgcgtgcatgatccacaagtacaagaacaagtggtacctgagcatcacctacaagttcaacgccatcaaggagaacaagttcgacaaggagcttatcatgggcatcgacatgggcggcatcaacacggtgtacttcgccttcaacgagggcttcatccggagcaacatcaagagcgacgagatcaagatgttcaacgagcgcatccggcagcgccggatcaacctgctcaagcagtccaaatactgctccaactcgcgcaccggcaagggccgcaccaagcgcctccagcccatcgacgtgctcagcaacaagatcgccaagttccgcaacagcacgaaccacaagtacgcgaactacatcgtgaagcagtgcctcaagcacaactgcgggcgcatccagatggagctgctcaaggggatctccaagaacgacaaggtgctcaaggactggacctacttcgacctccaggagaaaatcaagaatcaggcggaaatctacggcatcgaggtcatcaaggtcgtcccggcctacacctcccagcggtgctcccagtgcggctacatctgcaaggagaaccgctgcacccaggccatgttcgagtgcaagcagtgcggctacaagacgcacgcggactacaacgcggccaagaacatcagcacctacgacatcgagaacatcatcaacaagcagctcgcggtgcagtccaagctgcactccaagaagtgcatggaggagtacatcgaggagctgggctacctggactga

SEQ ID NO: 2106 - DNA, 1335 bp, Unknown
  Bacillus sp. multi
atgaagtaccagatcctctgccccatgaacgtggactggacgatcttcgagaagcacctccgcaacctgacgtaccaagtgcggacgatctcgaaccgcaccatccagcagctctgggagttcgacgccctcagcttcgactacttcaaggagcgcggcacgtacccgacggtccaggatctgtacggctgcacgcagaagaaaatcgacggctacatctaccacaccctccagagcaagtacccggacatccacaagggcaacatgagcaccaccctccagaaaatcatcaagacctggaagtcccgccggaacgagatccggaagggcgagatgtcgatcccgtccttccgcaaccgcatccccatcgacctccacaacaactcggtggacatcatcaaggagaagaacggcgactacatcgcggggatctcgctgttcagccgcgacttccacaaggagaacggcgacgtgccgaagggcaaaatcttcgtgaagctcggcacgcagaagcagaagtccatgaaggtgatcctggaccggctcatcaaccagacctactcgaagggcgcgtgcatgatccacaagtacaagaacaagtggtacttgagcatcacctacaagttcaacgccatcaaggagaacaagttcgacaaggagctgatcatgggcatcgacatgggcgggatcaacacggtgtacttcgcgttcaacgaggggttcatccggagcaacatcaagagcgacgagatcaagatgttcaacgagcgcatccgccagcgccggatcaacctcctcaagcagagcaaatactgctccaactcgcgcaccggcaagggccggaccaagcggctccagcccatcgacgtgctctcgaacaagatcgccaagttccgcaacagcaccaaccacaagtacgccaactacatcgtgaagcagtgcctcaagcacaactgcgggcgcatccagatggagctgctcaagggcatcagcaagaacgacaaggtgctcaaggactggacctacttcgacctccaggagaaaatcaagaaccaggcggaaatctacggcatcgaggtcatcaaggtcgtcccggcctacaccagccagcgctgctcgcagtgcggctacatctgcaaggagaaccgctgcacccaggcgatgttcgagtgcaagcagtgcggctacaagacgcacgcggactacaacgcggccaagaacatcagcacctacgacatcgagaacatcatcaacaagcagctcgccgtgcagagcaagctccacagcaagaagtgcatggaggagtacatcgaggagctgggctacctggactga

SEQ ID NO: 2107 - DNA, 1335 bp, Unknown
  Bacillus sp. multi
atgaagtaccagatcctctgccccatgaacgtggactggaccatcttcgagaagcacctccgcaacctcacgtaccaagtgcggacgatctccaaccgcaccatccagcagctctgggagttcgacgccctgagcttcgactacttcaaggagcggggcacgtacccgacggtccaggacctgtacgggtgcacgcagaagaagatcgacggctacatctaccacacgctccagagcaagtaccccgacatccacaaggggaacatgagcacgaccctccagaagattatcaagacctggaagtcgcgccggaacgagatccgcaagggcgagatgtccatcccgagcttccgcaaccgcatccccatcgacctgcacaacaactcggtggacatcatcaaggagaagaacggggactacatcgcggggatcagcctgttcagccgggacttccacaaggagaacggcgacgtgccgaagggcaagatattcgtcaagctgggcacccagaagcagaagtccatgaaggtgatcctcgaccgcctcatcaaccagacgtacagcaagggcgcgtgcatgatccacaagtacaagaacaagtggtatctttccatcacctacaagttcaacgccatcaaggagaacaagttcgacaaggagctaatcatgggcatcgacatgggcggcatcaacacggtgtacttcgccttcaacgagggcttcatccggagcaacatcaagtcggacgagatcaagatgttcaacgagcgcatccgccagcgccggatcaacctgctcaagcagtccaaatactgctccaactcgcgcaccgggaagggccgcacgaagcgcctccagcccatcgacgtgctgtcgaacaagatcgccaagttccgcaactccaccaaccacaagtacgccaactacatcgtcaagcagtgcctcaagcacaactgcgggcgcatccagatggagctgctcaagggcatcagcaagaacgacaaggtgctcaaggactggacctacttcgacctccaggagaagattaagaaccaggcggagatatacgggatcgaggtcatcaaggtcgtccccgcctacacctcccagcgctgctcccagtgcggctacatctgcaaggagaaccggtgcacccaggcgatgttcgagtgcaagcagtgcggctacaagacgcacgccgactacaacgccgccaagaacatctccacgtacgacatcgagaacatcatcaacaagcagctcgccgtccagtcgaagctgcacagcaagaagtgcatggaggagtacatcgaggagctgggctacctcgactag

SEQ ID NO: 2108 - DNA, 1335 bp, Unknown
  Bacillus sp. multi
atgaagtaccagatcctctgcccgatgaacgtggactggaccatcttcgagaagcacctccgcaacctgacctaccaagttcggacgatctccaaccggaccatccagcagctctgggagttcgacgcgctcagcttcgactacttcaaggagcgcggcacgtacccgaccgtccaagacctctacgggtgcacgcagaagaagatcgacggctacatctaccacacgctccagtcgaagtaccccgacatccacaaggggaacatgagcacgaccctccagaaaatcatcaagacctggaagtcgcgccgcaacgagatccgcaagggcgagatgtccatcccctcgttccgcaaccgcatccccatcgacctgcacaacaactccgtggacatcatcaaggagaagaacggcgactacatcgccgggatctcgctcttcagccgggacttccacaaggagaacggcgacgtcccgaagggcaagatcttcgtcaagctgggcacgcagaagcagaagtcgatgaaggtgatcctggaccggctcatcaaccagacctacagcaagggcgcgtgcatgatccacaagtacaagaacaagtggtatctcagcatcacctacaagttcaacgccatcaaggagaacaagttcgacaaggagctcataatggggatcgacatgggcggcatcaacacggtgtacttcgccttcaacgagggcttcatccggtccaacatcaagagcgacgagatcaagatgttcaacgagcgcatccgccagcggcgcatcaacctcctcaagcagtccaaatactgttcgaactcccggacgggcaaggggcggaccaagcgcctccagcccatcgacgtgctgtccaacaagatcgccaagttccgcaacagcaccaaccacaagtacgcgaactacatcgtgaagcagtgcctcaagcacaactgcgggcgcatccagatggagctgctcaagggcatcagcaagaacgacaaggtgctcaaggactggacctacttcgacctccaggaaaagatcaagaaccaggccgagatctacggcatcgaggtcatcaaggtcgtgcccgcctacacgagccagcgctgctcccagtgcgggtacatctgcaaggagaaccggtgcacccaggccatgttcgagtgcaagcagtgcggctacaagacgcacgccgactacaacgccgccaagaacatctccacctacgacatcgagaacatcatcaacaagcagctcgcggtccagagcaagctgcacagcaagaagtgcatggaggagtacatcgaggagctgggctacctggactga

SEQ ID NO: 2109 - DNA, 1335 bp, Unknown
  Bacillus sp. multi
atgaagtaccagatcctctgccccatgaacgtggactggacgatcttcgagaagcacctccgcaacctcacgtaccaggtccggacgatctcgaaccggacgatccagcagctctgggagttcgacgcgctctccttcgactacttcaaggagcggggcacctaccccaccgtccaagacctctacggctgcacgcagaagaagattgacgggtacatctaccacaccctccagtcgaagtaccccgacatccacaagggcaacatgagcacgacgctccagaaaatcatcaagacctggaagtcccgccggaacgagatccgcaagggcgagatgagcatccccagcttccggaaccgcatccccatcgacctccacaacaactccgtggacatcatcaaggagaagaacggggactacatcgcgggcatctcgctgttctcccgcgacttccacaaggagaacggcgacgtgccgaagggcaagatattcgtgaagctcggcacgcagaagcagaagtccatgaaggtcatcctggaccgcctcatcaaccagacgtacagcaagggcgcgtgcatgatccacaagtacaagaacaagtggtatctctccatcacctacaagttcaacgccatcaaggagaacaagttcgacaaggagttgataatggggatcgacatgggcggcatcaacaccgtgtacttcgccttcaacgagggcttcatccggagcaacatcaagtccgacgagatcaagatgttcaacgagcgcatccggcagcgccggatcaacctgctcaagcagagcaagtactgctcgaactcccgcaccggcaagggccgcacgaagcgcctccagcccatcgacgtgctgtccaacaagatcgccaagttccgcaacagcaccaaccacaagtacgcgaactacatcgtgaagcagtgcctcaagcacaactgcgggcgcatccagatggagctgctcaagggcatctccaagaacgacaaggtgctcaaggactggacctacttcgacctccaggagaagatcaagaaccaggccgagatctatggcatcgaggtcatcaaggtcgtcccggcctacacgagccagcgctgctcgcagtgcgggtacatctgcaaggagaaccgctgcacccaggcgatgttcgagtgcaagcagtgcgggtacaagacccacgccgactacaacgccgccaagaacatcagcacctacgacatcgagaacatcatcaacaagcagctcgccgtgcagagcaagctgcacagcaagaaatgcatggaggagtacatcgaggagctgggctacctggactga

SEQ ID NO: 2110 - DNA, 1326 bp, Unknown
  Bacillus sp. multi
atgaagtaccagatcctctgcccgatgaacgtggactggatcatcttcgagaagcacctccgcaacctgacctaccaagttcggacgatctccaaccgcaccatccagcagctctgggagttcgacgccctctcgttcgactacttcaaggtgcgcggcacgtacccgaccgtccaagatctgtacggctgcacccagaagaagatcgacggctacatctaccacaccctccagagcaagtaccccgacatccacaagggcaacatgagcaccaccctccagaaaatcatcaagacctggaagtcgcgccggaacgagatccgcaagggcgagatgagcatcccgtccttccgcaaccgcatccccatcgacatccacaacaactccgtggacatcacgaaggagaagaacggcgactacatcgccgggatctcgctcttcagccgggacttccacaaggagaacggcgacgtcccgaagggcaagatattcgtcaagctggccacccagaagcagaagtccatgaaggtcatcctcgaccgcctcatcaaccagacctacagcaagggcgcgtgcatgatccacaagtacaagaacaagtggtacctctcaatcacctacaagttcaacgccctcaaggagaacaagttcgacaaggagcttatcatggggatcgacatgggcgggatcaacacggtgtacttcgccttcaacgaggggttcatccgcaacaacatcaagtccgaggagatcaagatgttcaacgagcgcatccgccagcgccggatcaacctcctcaagcagagcacctactgctccaacagccgcacgggcaaggggcgcaccaagcgcctccagcccatcgacgtgctctccaacaagatcgccaagttccgcaactcgaccaaccacaagtacgccaactacatcatcaagcagtgcctcaagcacaactgcgggcgcatccagatggagctgctcaaggggatcagcaagaacgacaaggtgctcaaggactggacgtacttcgacctccaggaaaagattaagaatcaggcggagatccacggcatcgaggtcatcaaggtcgcgcccgcctacacgagccagcgctgctcgcagtgcggctacatctgcaaggagaaccgctgcacccaggccatgttcgagtgcaagcagtgcgggtacaagacccacgccgactacaacgcggccaagaacatcgccacgtacgacatcgagaacatcatcaacaagcagctcgccgtgcagagcaagctccactccaagaagtgcatggaggagtacatcgaggagctgggctag

SEQ ID NO: 2111 - DNA, 1326 bp, Unknown
  Bacillus sp. multi
atgaagtaccagatcctctgccccatgaacgtggactggatcatcttcgagaagcacctccggaacctcacctaccaagtgcggacgatctccaaccggacgatccagcagctctgggagttcgacgcgctgagcttcgactacttcaaggtgcgcggcacctaccccaccgtccaagacctgtacggctgcacgcagaagaagatagacggctacatctaccacaccctccagtcgaagtacccggacatccacaagggcaacatgagcaccacgctccagaagattatcaagacctggaagtcccggcgcaacgagatccgcaagggcgagatgagcatccccagcttccgcaaccgcatccccatcgacatccacaacaactccgtggacatcacgaaggagaagaatggcgactacatcgccgggatcagcctgttcagccgcgacttccacaaggagaacggggacgtgccgaagggcaagatattcgttaagctggcgacgcagaagcagaagtccatgaaggtcatcctggaccgcctcatcaaccagacctacagcaagggcgcgtgcatgatccacaagtacaagaacaagtggtacttgagcatcacctacaagttcaacgccctcaaggagaacaagttcgacaaggagcttatcatgggcatcgacatgggcgggatcaacacggtgtacttcgccttcaacgaggggttcatccgcaacaacatcaagtcggaggagatcaagatgttcaacgagcgcatccgccagcgccgcatcaacctgctcaagcagagcacctactgctcgaacagccgcacggggaaggggcggaccaagcggctccagcccatcgacgtgctctccaacaagatcgccaagttccgcaacagcacgaaccacaagtacgcgaactacatcatcaagcagtgcctcaagcacaactgcgggcgcatccagatggagctgctcaagggcatctccaagaacgacaaggtgctcaaggactggacgtacttcgacctccaggagaagattaagaaccaggccgagatccacggcatcgaggtcatcaaggtcgcgcccgcctacaccagccagcggtgctcgcagtgcggctacatctgcaaggagaaccgctgcacccaggccatgttcgagtgcaagcagtgcggctacaagacccacgccgactacaacgccgccaagaacatcgccacctacgacatcgagaacatcatcaacaagcagctcgcggtccagtcgaagctgcacagcaagaaatgcatggaggagtacatcgaggagctggggtga

SEQ ID NO: 2112 - DNA, 1326 bp, Unknown
  Bacillus sp. multi
atgaagtaccagatcctctgccccatgaacgtggactggatcatcttcgagaagcacctccgcaacctcacctaccaggtgcggacgatctcgaaccgcacgatccagcagctctgggagttcgacgccctgagcttcgactacttcaaggtgcggggcacgtacccgaccgtccaggacctgtacggctgcacgcagaagaaaatcgacgggtacatctaccacaccctccagtcgaagtaccccgacatccacaagggcaacatgagcacgaccctccagaaaatcatcaagacctggaagtcacgccggaacgagatccggaagggcgagatgagcatcccgagcttccgcaaccgcatccccatcgacatccacaacaacagcgtggacatcacgaaggagaagaatggggactacatcgccgggatctcgctgttcagccgggacttccacaaggagaacggggacgtgccgaagggcaaaatcttcgtcaagctcgccacgcagaagcagaagtccatgaaggtcatcctggaccgcctcatcaaccagacctactcgaagggcgcgtgcatgatccacaagtacaagaacaagtggtatcttagcatcacctacaagttcaacgccctcaaggagaacaagttcgacaaggagttgatcatggggatcgacatgggcgggatcaacacggtgtacttcgccttcaacgaggggttcatccgcaacaacatcaagtccgaggagatcaagatgttcaacgagcgcatccgccagcgccgcatcaacctgctcaagcagtccacctactgctccaacagccgcacggggaagggccgcaccaagcgcctccagcccatcgacgtgctgtccaacaagatcgccaagttccgcaacagcacgaaccacaagtacgccaactacatcatcaagcagtgcctcaagcacaactgcgggcgcatccagatggagctgctcaagggcatcagcaagaacgacaaggtgctcaaggactggacgtacttcgacctccaggaaaagattaagaaccaggccgagatccacgggatcgaggtcatcaaggtcgcgcccgcctacaccagccagcgctgctcccagtgcgggtacatctgcaaggagaaccgctgcacccaggccatgttcgagtgcaagcagtgcggctacaagacgcacgcggactacaacgccgccaagaacatcgccacctacgacatcgagaacatcatcaacaagcagctcgccgtgcagtcgaagctccacagcaagaaatgcatggaggagtacatcgaggagctggggtga

SEQ ID NO: 2113 - DNA, 1326 bp, Unknown
  Bacillus sp. multi
atgaagtaccagatcctctgcccgatgaacgtggactggatcatcttcgagaagcacctccgcaacctcacgtaccaagtccggacgatcagcaaccggacgatccagcagctctgggagttcgacgccctgagcttcgactacttcaaggtgcgcggcacgtacccgaccgtccaagatctttacggctgcacgcagaagaagatcgacggctacatctaccacaccctccagtcgaagtacccggacatccacaagggcaacatgagcaccaccctccagaaaatcatcaagacctggaagtcccggcgcaacgagatccgcaagggcgagatgtccatcccgagcttccggaaccgcatccccatcgacatccacaacaactccgtggacatcacgaaggagaagaatggggactacatcgcgggcatcagcctgttcagccgcgacttccacaaggagaacggcgacgtgccgaagggcaaaatcttcgtcaagctggcgacgcagaagcagaagtcgatgaaggtcatcctggaccggctcatcaaccagacctacagcaagggcgcgtgcatgatccacaagtacaagaacaagtggtatttgagcatcacctacaagttcaacgcgctcaaggagaacaagttcgacaaggagcttatcatggggatcgacatgggcgggatcaacacggtgtacttcgccttcaacgagggcttcatccgcaacaacatcaagtcggaggagatcaagatgttcaacgagcgcatccggcagcggcggatcaacctcctcaagcagtccacctactgctcgaactcgcgcacgggcaagggccgcacgaagcggctccagcccatcgacgtgctgagcaacaagatcgccaagttccgcaactccacgaaccacaagtacgccaactacatcatcaagcagtgcctcaagcacaactgcgggcgcatccagatggagctgctcaaggggatcagcaagaacgacaaggtgctcaaggactggacgtacttcgacctccaggagaagatcaagaaccaggcggagatccacgggatcgaggtcatcaaggtcgccccggcctacacgagccagcggtgctcgcagtgcggctacatctgcaaggagaaccgctgcacccaggccatgttcgagtgcaagcagtgcgggtacaagacccacgcggactacaacgccgccaagaacatcgccacctacgacatcgagaacatcatcaacaagcagctcgccgtgcagtcgaagctccacagcaagaaatgcatggaggagtacatcgaggagctggggtga

SEQ ID NO: 2114 - DNA, 1326 bp, Unknown
  Bacillus sp. multi
atgaagtaccagatcctctgccccatgaacgtggactggatcatcttcgagaagcacctccgcaacctgacctaccaagtgcggacgatcagcaaccgcaccatccagcagctctgggagttcgacgcgctgtcgttcgactacttcaaggtgcggggcacgtaccccaccgtccaagacctgtacggctgcacgcagaagaagatagacggctacatctaccacacgctccagagcaagtacccggacatccacaagggcaacatgagcaccaccctccagaagattattaagacctggaagtcccgccgcaacgagatccgcaagggcgagatgtccatcccgtccttccggaaccgcatccccatcgacatccacaacaacagcgtggacatcacgaaggagaagaatggcgactacatcgcggggatctccctgttctcccgcgacttccacaaggagaacggggacgtgccgaagggcaaaatcttcgttaagctggcgacgcagaagcagaagtcgatgaaggtgatcctggaccgcctcatcaaccagacgtacagcaagggcgcgtgcatgatccacaagtacaagaacaagtggtatctgagcatcacctacaagttcaacgccctcaaggagaacaagttcgacaaggaattgatcatgggcatcgacatgggcggcatcaacacggtgtacttcgccttcaacgaggggttcatccggaacaacatcaagtccgaggagatcaagatgttcaacgagcgcatccggcagcgccgcatcaacctcctcaagcagtccacgtactgctcgaactcgcgcaccggcaaggggcggaccaagcgcctccagcccatcgacgtgctgtcgaacaagatcgccaagttccgcaacagcaccaaccacaagtacgccaactacatcatcaagcagtgcctcaagcacaactgcgggcgcatccagatggagctgctcaaggggatcagcaagaacgacaaggtgctcaaggactggacgtacttcgacctccaggagaagatcaagaaccaggccgagatccacggcatcgaggtcatcaaggtcgccccggcctacaccagccagcggtgctcccagtgcggctacatctgcaaggagaaccgctgcacccaggccatgttcgagtgcaagcagtgcgggtacaagacccacgcggactacaacgccgccaagaacatcgccacctacgacatcgagaacatcatcaacaagcagctcgcggtgcagtccaagctgcacagcaagaagtgcatggaggagtacatcgaggagctggggtag

SEQ ID NO: 2115 - DNA, 1356 bp, Unknown
  Bacillus sp. multi
ctcggggtgacgatcaagatcatgaagtaccagatcctctgcccgatgaacgtggactggaccatcttcgagaagcacctccgcaacctcacctaccaagtgcggacgatcagcaaccggaccatccagcagctctgggagttcgacgccctcagcttcgactacttcaaggagcgcggcacgtacccgaccgtccaagatctgtatggctgcacgcagaagaagatcgacggctacatctaccacacgctccagagcaagtacccggacatccacaagggcaacatgagcacgaccctccagaaaatcatcaagacctggaagtcccgccgcaacgagatccgcaagggcaagatgtcgatccccagcttccggaaccgcatccccatcgacctgcacaacaactcggtggacatcacgaaggagaagaatggggactacatcgcggggatcagcctgttcagccgcgacttccacaaggagaacgacgacgtgccgaagggcaagatattcgtgaagctggccacccagaagcagaagtcgatgaaggtgatcctcgaccgcctcatcaaccagacctactcgaagggcgcgtgcatgatccacaagtacaagaacaagtggtatctgtccatcacctacaagttcaacgccatcaaggagaacaagttcgacaaggagcttatcatgggcatcgacctgggcgggatcaacaccgtgtacttcgccttcaacgagggcttcatccggtcgaacatcaagtccgacgagatcaagatgttcaacgagcgcatccgccagcgccggatcaacctcctcaagcagagcaaatactgctccaacagccgcacggggaagggccggaccaagcgcctccagcccatcgacgtgctctccaacaagatcgccaagttccgcaactccacgaaccacaagtacgccaactacatcgtgaagcagtgcctcaagcacaactgcgggcgcatccagatggagctgctcaaggggatcagcaagaacgaccgcatcctcaaggactggacctacttcgacctccaggagaaaattaagaaccaggcggagatccacggcatcgaggtcatcaaggtcgcgcccgcctacaccagccagcggtgcagccagtgcggctacatctgcaaggagaaccggtgcacccaggccaccttcgagtgcaagcagtgcggctacaagacgcacgccgactacaacgcggccaagaacatctccacctacgacatcgagaacatcatcaacaagcagctcgccgtccagagcaagctccacagcaagaagtgtatggaggagtacatcgaggagctgggctacctggactga

SEQ ID NO: 2116 - DNA, 1356 bp, Unknown
  Bacillus sp. multi
ctcggggtgaccatcaagatcatgaagtaccagatcctctgcccgatgaacgtggactggacgatcttcgagaagcacctccggaacctgacctaccaagttcggacgatcagcaaccgcacgatccagcagctctgggagttcgacgccctgagcttcgactacttcaaggagcgcggcacctacccgaccgtccaagacttgtacggctgcacgcagaagaaaatcgacgggtacatctaccacaccctccagagcaagtaccccgacatccacaagggcaacatgagcaccaccctccagaaaattatcaagacctggaagtcccgccgcaacgagatccgcaaggggaagatgtcgatcccgagcttccggaaccgcatccccatcgacctgcacaacaactccgtggacatcacgaaggagaagaacggggactacatcgcggggatctcgctgttcagccgcgacttccacaaggagaacgacgacgtgccgaagggcaagatattcgtcaagctggccacccagaagcagaagtccatgaaggtcatcctcgaccggctcatcaaccagacgtacagcaagggcgcgtgcatgatccacaagtacaagaacaagtggtacttgagcatcacctacaagttcaacgcgatcaaggagaacaagttcgacaaggagctaatcatgggcatcgacctgggcggcatcaacacggtgtacttcgccttcaacgagggcttcatccggtcgaacatcaagtcggacgagatcaagatgttcaacgagcgcatccggcagcgccggatcaacctcctcaagcagagcaagtattgctccaactcgcgcacgggcaaggggcgcaccaagcggctccagcccatcgacgtgctctccaacaagatcgccaagttccgcaacagcaccaaccacaagtacgcgaactacatcgtcaagcagtgcctcaagcacaactgcgggcgcatccagatggagctgctcaagggcatcagcaagaacgaccgcatcctcaaggactggacctacttcgacctccaggagaagattaagaaccaggccgagatccacggcatcgaggtcatcaaggtcgcgcccgcctacacctcccagcggtgctcccagtgcggctacatctgcaaggagaaccggtgcacccaggccaccttcgagtgcaagcagtgcggctacaagacgcacgcggactacaacgccgccaagaacatcagcacctacgacatcgagaacatcatcaacaagcagctcgccgtgcagagcaagctgcacagcaagaaatgcatggaggagtacatcgaggagctgggctacctcgactga

SEQ ID NO: 2117 - DNA, 1356 bp, Unknown
  Bacillus sp. multi
ctcggcgtcacgatcaagatcatgaagtaccagatcctctgcccgatgaacgtggactggaccatcttcgagaagcacctccgcaacctcacgtaccaagtccggacgatctccaaccgcaccatccagcagctctgggagttcgacgcgctgagcttcgactacttcaaggagcgcggcacgtacccgaccgtccaagacctgtacggctgcacgcagaagaagatagacggctacatctaccacaccctccagtcgaagtacccggacatccacaagggcaacatgagcaccaccctccagaaaatcatcaagacctggaagtcccggcgcaacgagatccgcaagggcaagatgagcatcccgagcttccgcaaccgcatccccatcgacctgcacaacaactccgtggacatcacgaaggagaagaatggggactacatcgcggggatctccctgttctcccgcgacttccacaaggagaacgacgacgtgccgaagggcaagatcttcgtgaagctggcgacccagaagcagaagtcgatgaaggtcatcctcgaccgcctcatcaaccagacgtactcgaagggcgcgtgcatgatccacaagtacaagaacaagtggtacttgagtataacctacaagttcaacgccatcaaggagaacaagttcgacaaggagttgatcatgggcatcgacctgggcgggatcaacaccgtgtacttcgccttcaacgaggggttcatccgcagcaacatcaagtccgacgagatcaagatgttcaacgagcgcatccgccagcgccggatcaacctgctcaagcagagcaaatactgttccaactcccgcaccggcaagggccgcacgaagcgcctccagcccatcgacgtgctgagcaacaagatcgccaagttccgcaacagcacgaaccacaagtacgccaactacatcgtcaagcagtgcctcaagcacaactgcgggcgcatccagatggagctgctcaagggcatcagcaagaacgaccgcatcctcaaggactggacctacttcgacctccaggagaagattaagaaccaggccgagatccacggcatcgaggtcatcaaggtggccccggcctacacctcccagcgctgctcccagtgcggctacatctgcaaggagaaccgctgcacccaggcgacgttcgagtgcaagcagtgcggctacaagacccacgcggactacaacgcggccaagaacatctcgacctacgacatcgagaacatcatcaacaagcagctcgcggtccagagcaagctccactccaagaaatgcatggaggagtacatcgaggagctgggctacctggactga

SEQ ID NO: 2118 - DNA, 1356 bp, Unknown
  Bacillus sp. multi
ctcggcgtgaccatcaagatcatgaagtaccagatcctctgccccatgaacgtggactggaccatcttcgagaagcacctccgcaacctcacgtaccaggtccggacgatcagcaaccggacgatccagcagctctgggagttcgacgccctcagcttcgactacttcaaggagcgcggcacgtaccccacggtccaggatctttacggctgcacccagaagaaaattgacggctacatctaccacaccctccagagcaagtacccggacatccacaagggcaacatgagcaccaccctccagaaaatcatcaagacctggaagtccagacgcaacgagatccggaagggcaagatgagcatcccgtccttccgcaaccgcatccccatcgacctccacaacaacagcgtggacatcacgaaggaaaagaatggcgactacatcgcgggcatcagcctgttctcccgcgacttccacaaggagaacgacgacgtgccgaagggcaaaatcttcgtcaagctggccacccagaagcagaagtcgatgaaggtgatcctggaccggctcatcaaccagacctacagcaagggcgcgtgcatgatccacaagtacaagaacaagtggtacttgagcatcacctacaagttcaacgcgatcaaggagaacaagttcgacaaggagctgatcatgggcatcgacctcggcggcatcaacacggtgtacttcgccttcaacgaggggttcatccggtccaacatcaagtccgacgagatcaagatgttcaacgagcgcatccggcagcggcggatcaacctcctcaagcagtccaaatactgctcgaactcgcgcacgggcaagggccgcaccaagcgcctccagcccatcgacgtgctgtccaacaagatcgccaagttccgcaacagcaccaaccacaagtacgccaactacatcgtgaagcagtgcctcaagcacaactgcgggcgcatccagatggagctgctcaaggggatctccaagaacgaccgcatcctcaaggactggacctacttcgacctccaggagaaaatcaagaaccaggccgagatccacggcatcgaggtcatcaaggtggccccggcctacacgagccagcgctgctcgcagtgcgggtacatctgcaaggagaaccggtgcacccaggccacgttcgagtgcaagcagtgcggctacaagacccacgcggactacaacgccgccaagaacatctccacgtacgacatcgagaacatcatcaacaagcagctcgccgtgcagtccaagctccacagcaagaagtgcatggaggagtacatcgaggagctgggctacctggactga

SEQ ID NO: 2119 - DNA, 1356 bp, Unknown
  Bacillus sp. multi
ctcggcgtgaccatcaagatcatgaagtaccagatcctctgccccatgaacgtggactggaccatcttcgagaagcacctccggaacctgacctaccaagtccggacgatctccaaccggacgatccagcagctctgggagttcgacgccctctcgttcgactacttcaaggagcgcgggacgtacccgaccgtccaagatctttacggctgcacgcagaagaagatcgacggctacatctaccacaccctccagagcaagtacccggacatccacaaggggaacatgagcacgacgctccagaaaatcatcaagacctggaagtcgcgccggaacgagatccggaaggggaagatgagcatccccagcttccgcaaccgcatccccatcgacctgcacaacaacagcgtggacatcacgaaggagaagaatggggactacatcgcgggcatcagcctgttcagccgggacttccacaaggagaacgacgacgtgccgaagggcaaaatcttcgtgaagctcgccacgcagaagcagaagtcgatgaaggtcatcctggaccgcctcatcaaccagacctactcgaagggcgcgtgcatgatccacaagtacaagaacaagtggtatctcagcatcacctacaagttcaacgcgatcaaggagaacaagttcgacaaggagctgataatggggatcgacctcggcggcatcaacacggtgtacttcgcgttcaacgagggcttcatccgctccaacatcaagagcgacgagatcaagatgttcaacgagcgcatccgccagcgccggatcaacctgctcaagcagagcaagtattgctcgaactcgcgcaccggcaagggccgcaccaagcggctccagcccatcgacgtcctctcgaacaagatcgccaagttccgcaacagcaccaaccacaagtacgccaactacatcgtcaagcagtgcctcaagcacaactgcgggcgcatccagatggagctgctcaaggggatctccaagaacgaccgcatcctcaaggactggacctacttcgacctccaggagaagattaagaatcaggccgagatccacggcatcgaggtcatcaaggtcgcgcccgcctacacctcccagcggtgcagccagtgcgggtacatctgcaaggagaaccgctgcacccaggcgacgttcgagtgcaagcagtgcggctacaagacgcacgccgactacaacgcggccaagaacatcagcacgtacgacatcgagaacatcatcaacaagcagctcgccgtccagtcgaagctgcacagcaagaagtgtatggaggagtacatcgaggagctgggctacctggactag

SEQ ID NO: 2120 - DNA, 1356 bp, Unknown
  Bacillus sp. multi
ctcggcgtcacgatcaagatcatgaagtaccagatcctctgcccgatgaacgtggactggacgatcttcgagaagcacctccgcaacctgacctaccaggtgcggacgatctccaaccgcaccatccagcagctctgggagttcgacgcgctcagcttcgactacttcaaggagcgcggcacctaccccacggtccaggatctctacggctgcacgcagaagaagatagacggctacatctaccacacgctccagagcaagtacccggacatccacaaggggaacatgagcaccacgctccagaagatcatcaagacctggaagtcccgccggaacgagatccgcaagggcgagatgagcatcccgtccttccgcaaccgcatccccatcgacctccacaacaactccgtggacatcatcaaggagaagaacggcgactacatcgcggggatcagcctgttctcgcgcgacttccacaaggagaacggcgacgtgccgaagggcaagatattcgtcaagctgggcacgcagaagcagaagtccatgaaggtgatcctcgaccgcctcatcaaccagacctactcgaagggcgcgtgcatgatccacaagtacaagaacaagtggtatcttagcatcacctacaagttcaacgccatcaaggagaacaagttcgacaaggagctaatcatggggatcgacatgggcggcatcaacacggtgtacttcgccttcaacgagggcttcatccgcagcaacatcaagtccgacgagatcaagatgttcaacgagcgcatccgccagcggcgcatcaacctgctcaagcagagcaagtattgctcgaactcccggacgggcaaggggcggaccaagcgcctccagcccatcgacgtgctgagcaacaagatcgccaagttccgcaacagcaccaaccacaagtacgccaactacatcgtgaagcagtgcctcaagcacaactgcgggcgcatccagatggagctgctcaaggggatcagcaagaacgacaaggtgctcaaggactggacctacttcgacctccaggagaagatcaagaaccaggccgaaatctatgggatcgaggtcatcaaggtggtcccggcctacacgagccagcgctgctcgcagtgcgggtacatctgcaaggagaaccgctgcacccaggccatgttcgagtgcaagcagtgcggctacaagacgcacgcggactacaacgcggccaagaacatctccacctacgacatcgagaacatcatcaacaagcagctcgcggtgcagtccaagctgcacagcaagaagtgcatggaggagtacatcgaggagctgggctacctggactga

SEQ ID NO: 2121 - DNA, 1356 bp, Unknown
  Bacillus sp. multi
ctgggcgtgaccatcaagatcatgaagtaccagatcctctgccccatgaacgtggactggaccatcttcgagaagcacctccgcaacctgacctaccaggtccggacgatctcgaaccgcacgatccagcagctctgggagttcgacgcgctgtccttcgactacttcaaggagcgcggcacgtaccccacggtccaggatctctacggctgcacgcagaagaaaatcgacgggtacatctaccacaccctccagtcgaagtacccggacatccacaagggcaacatgagcaccaccctccagaagatcatcaagacctggaagtcccgccgcaacgagatccgcaagggcgagatgagcatcccgtccttccgcaaccgcatccccatcgacctccacaacaacagcgtggacatcatcaaggagaagaacggcgactacatcgcggggatctccctgttctcccgcgacttccacaaggagaacggcgacgtgccgaagggcaagatattcgtaaagctggggacgcagaagcagaagtcgatgaaggtcatcctcgaccggctcatcaaccagacgtacagcaagggcgcgtgcatgatccacaagtacaagaacaagtggtatctgagcatcacctacaagttcaacgccatcaaggagaacaagttcgacaaggagttaatcatgggcatcgacatgggcggcatcaacacggtgtacttcgccttcaacgaggggttcatccggagcaacatcaagagcgacgagatcaagatgttcaacgagcgcatccgccagcggcgcatcaacctgctcaagcagtccaagtactgctccaactcgcggacgggcaagggccggacgaagcgcctccagcccatcgacgtgctctcgaacaagatcgccaagttccgcaactccaccaaccacaagtacgccaactacatcgtgaagcagtgcctcaagcacaactgcgggcgcatccagatggagctgctcaaggggatcagcaagaacgacaaggtgctcaaggactggacctacttcgacctccaggagaagattaagaaccaggcggagatatacgggatcgaggtcatcaaggtggtgcccgcctacaccagccagcgctgctcccagtgcgggtacatctgcaaggagaaccgctgcacccaggcgatgttcgagtgcaagcagtgcggctacaagacccacgcggactacaacgccgccaagaacatctcgacctacgacatcgagaacatcatcaacaagcagctcgcggtgcagtccaagctccacagcaagaagtgcatggaggagtacatcgaggagctgggctacctggactga

SEQ ID NO: 2122 - DNA, 1356 bp, Unknown
  Bacillus sp. multi
ctcggcgtgacgatcaagatcatgaagtaccagatcctctgccccatgaacgtggactggaccatcttcgagaagcacctccgcaacctcacctaccaagtgcggacgatctcgaaccgcaccatccagcagctctgggagttcgacgcgctgtcgttcgactacttcaaggagcgcggcacgtacccgaccgtccaagacctctacggctgcacccagaagaaaatagacggctacatctaccacaccctccagtcgaagtaccccgacatccacaagggcaacatgagcaccacgctccagaaaatcatcaagacctggaagtcccgccgcaacgagatccgcaagggcgagatgagcatcccctccttccgcaaccgcatccccatcgacctgcacaacaacagcgtggacatcatcaaggagaagaacggggactacatcgcgggcatctcgctgttcagccgcgacttccacaaggagaacggcgacgtcccgaagggcaagatcttcgtcaagctgggcacgcagaagcagaagtccatgaaggtgatcctcgaccgcctcatcaaccagacgtacagcaagggcgcgtgcatgatccacaagtacaagaacaagtggtatttgagcatcacctacaagttcaacgccatcaaggagaacaagttcgacaaggagctaatcatgggcatcgacatgggcggcatcaacaccgtgtacttcgccttcaacgagggcttcatccggagcaacatcaagagcgacgagatcaagatgttcaacgagcgcatccgccagcgccggatcaacctcctcaagcagtccaaatactgctccaactcccgcaccggcaaggggcgcaccaagcgcctccagcccatcgacgtcctcagcaacaagatcgccaagttccgcaactcgaccaaccacaagtacgccaactacatcgtgaagcagtgcctcaagcacaactgcgggcgcatccagatggagctgctcaagggcatcagcaagaacgacaaggtgctcaaggactggacctacttcgacctccaggagaagatcaagaaccaggccgagatctacggcatcgaggtcatcaaggtcgtccccgcctacacgagccagcggtgcagccagtgcggctacatctgcaaggagaaccggtgcacccaggcgatgttcgagtgcaagcagtgcggctacaagacgcacgccgactacaacgcggccaagaacatctccacctacgacatcgagaacatcatcaacaagcagctcgccgtgcagtccaagctgcactccaagaagtgcatggaggagtacatcgaggagctgggctacctcgactag

SEQ ID NO: 2123 - DNA, 1356 bp, Unknown
  Bacillus sp. multi
ctcggcgtcacgatcaagatcatgaagtaccagatcctctgccccatgaacgtggactggaccatcttcgagaagcacctccgcaacctcacctaccaagtgcggacgatctccaaccgcaccatccagcagctctgggagttcgacgcgctctccttcgactacttcaaggagcgcggcacctaccccacggtccaagatctgtacggctgcacccagaagaaaatcgacggctacatctaccacaccctccagagcaagtaccccgacatccacaaggggaacatgagcacgacgctccagaaaatcatcaagacctggaagtcccgccgcaacgagatccggaagggcgagatgagcatcccctccttccgcaaccgcatccccatcgacctgcacaacaactccgtggacatcatcaaggagaagaatggggactacatcgcgggcatctccctgttctcccgcgacttccacaaggagaacggcgacgtgccgaagggcaagatattcgtcaagctcggcacccagaagcagaagtccatgaaggtgatcctggaccggctcatcaaccagacctacagcaagggcgcgtgcatgatccacaagtacaagaacaagtggtacctctccatcacctacaagttcaacgcgatcaaggagaacaagttcgacaaggagctgattatggggatcgacatgggcggcatcaacaccgtgtacttcgcgttcaacgagggcttcatccggtccaacatcaagagcgacgagatcaagatgttcaacgagcgcatccgccagcgccgcatcaacctcctcaagcagtccaagtattgctccaactcccgcaccggcaagggccgcaccaagcgcctccagcccatcgacgtgctgtcgaacaagatcgccaagttccgcaactcgaccaaccacaagtacgccaactacatcgtcaagcagtgcctcaagcacaactgcgggcgcatccagatggagctgctcaagggcatcagcaagaacgacaaggtgctcaaggactggacctacttcgacctccaggagaagatcaagaaccaggcggagatctacggcatcgaggtcatcaaggtggtcccggcctacacctcgcagcggtgctcccagtgcgggtacatctgcaaggagaaccgctgcacccaggcgatgttcgagtgcaagcagtgcggctacaagacccacgccgactacaacgccgccaagaacatctcgacctacgacatcgagaacatcatcaacaagcagctcgcggtgcagtccaagctccacagcaagaagtgcatggaggagtacatcgaggagctgggctacctcgactga

SEQ ID NO: 2124 - DNA, 1356 bp, Unknown
  Bacillus sp. multi
ctgggcgtgacgatcaagatcatgaagtaccagatcctctgccccatgaacgtggactggaccatcttcgagaagcacctccgcaacctcacctaccaagtgcggacgatctcgaaccgcacgatccagcagctctgggagttcgacgcgctcagcttcgactacttcaaggagcgcggcacgtaccccaccgtccaggatctatacgggtgcacgcagaagaagatcgacgggtacatctaccacaccctccagtcgaagtaccccgacatccacaaggggaacatgagcacgaccctccagaagatcatcaagacctggaagtcccgccgcaacgagatccgcaagggcgagatgagcatcccgagcttccggaaccgcatccccatcgacctgcacaacaactcggtggacatcatcaaggagaagaacggcgactacatcgccgggatctcgctgttcagccgcgacttccacaaggagaacggcgacgtcccgaagggcaagatattcgtgaagctggggacgcagaagcagaagtccatgaaggtcatcctggaccgcctcatcaaccagacctactcgaagggcgcgtgcatgatccacaagtacaagaacaagtggtacctctccatcacctacaagttcaacgccatcaaggagaacaagttcgacaaggagctaatcatggggatcgacatgggcggcatcaacaccgtgtacttcgccttcaacgagggcttcatccgcagcaacatcaagtccgacgagatcaagatgttcaacgagcgcatccgccagcgccggatcaacctgctcaagcagtccaagtattgctccaacagccgcacgggcaagggccgcaccaagcgcctccagcccatcgacgtcctgtcgaacaagatcgccaagttccgcaactccaccaaccacaagtacgcgaactacatcgtgaagcagtgcctcaagcacaactgcgggcgcatccagatggagctgctcaaggggatctccaagaacgacaaggtgctcaaggactggacgtacttcgacctccaggagaagattaagaaccaggcggagatatacggcatcgaggtcatcaaggtggtgcccgcctacacgagccagcggtgcagccagtgcgggtacatctgcaaggagaaccggtgcacccaggcgatgttcgagtgcaagcagtgcgggtacaagacccacgcggactacaacgccgccaagaacatctccacctacgacatcgagaacatcatcaacaagcagctcgccgtgcagtccaagctccacagcaagaagtgtatggaggagtacatcgaggagctgggctacctcgactga

SEQ ID NO: 2125 - DNA, 1356 bp, Unknown
  Bacillus sp. multi
ctcggcgtgacgatcaagatcatgaagtaccagatcctctgcccgatgaacgtggactggaccatcttcgagaagcacctccgcaacctcacctaccaagtccggacgatctccaaccggaccatccagcagctctgggagttcgacgccctcagcttcgactacttcaaggagcgcggcacctacccgaccgaccaagacctatacgggtgcacgcagaagaagatcgacgggtacatctaccacacgctccagagcaagtacccggacatccacaagggcaacatgagcaccaccctccagaagatcattaaaacttggaagtcccggcggaacgagatccgcaagggcgagatgagcatcccgagcttccgcaaccgcatccccatcgacctgcacaacaacagcgtggacatcacgaaggagaagaatggggactacatcgcggggatcagcctgttcagccgcgacttccacaaggagaacgacgacgtgccgaagggcaaaatcttcgtgaagctggccacccagaagcagaagtccatgaaggtcatcctggaccggctcatcaaccagacgtactcgaagggcgcgtgcatgatccacaagtacaagaacaagtggtacctctcgatcacctacaagttcaacgccatcaaggagaacaagttcgacaaggagttgataatgggcatcgacctcggcggcatcaacacggtgtacttcgccttcaacgagggcttcatccggtccaacatcaagtcggacgagatcaagatgttcaacgagcgcatccggcagcgccgcatcaacctcctcaagcagagcaaatactgctcgaactcccgcacgggcaaggggcgcaccaagcgcctccagcccatcgacgtcctgtccaacaagatcgccaagttccagaacagcaccaaccacaagtacgcgaactacatcgtgaagcagtgcctcaagcacaactgcgggcgcatccagatggagctgctcaaggggatcagcaagaacgaccgcatcctcaaggactggacgtacttcgacctccaggagaagattaagaaccaggccgagatccacggcatcgaggtcatcaaggtcgcgcccgcctacaccagccagcggtgcagccagtgcggctacatctgcaaggagaaccggtgcacccaggccaccttcgagtgcaagcagtgcggctacaagacgcacgcggactacaacgcggccaagaacatctcgacgtacgacatcgagaacatcatcaacaagcagctcgccgtgcagagcaagctgcacagcaagaaatgcatggaggagtacatcgaggagctgggctacctcgactag

SEQ ID NO: 2126 - DNA, 1356 bp, Unknown
  Bacillus sp. multi
ctcggcgtcaccatcaagatcatgaagtaccagatcctctgccccatgaacgtggactggacgatcttcgagaagcacctccggaacctcacgtaccaagtacggacgatctccaaccgcacgatccagcagctctgggagttcgacgcgctgtcgttcgactacttcaaggagcgcggcacctaccccaccgaccaagatctctacggctgcacgcagaagaaaattgacgggtacatctaccacacgctccagtcgaagtacccggacatccacaagggcaacatgagcaccaccctccagaagatcatcaagacctggaagtcccgccggaacgagatccgcaagggcgagatgtccatcccctccttccgcaaccgcatccccatcgacctgcacaacaactcggtggacatcacgaaggagaagaacggcgactacatcgccgggatcagcctgttctcccgcgacttccacaaggagaacgacgacgtgccgaagggcaaaatcttcgtgaagctggccacccagaagcagaagtcgatgaaggtgatcctcgaccggctcatcaaccagacgtacagcaagggcgcgtgcatgatccacaagtacaagaacaagtggtacttatccatcacctacaagttcaacgccatcaaggagaacaagttcgacaaggagctgattatgggcatcgacctcggcgggatcaacaccgtgtacttcgcgttcaacgagggcttcatccgcagcaacatcaagagcgacgagatcaagatgttcaacgagcgcatccgccagcggcggatcaacctgctcaagcagagcaagtattgttcgaactcgcggacgggcaagggccgcaccaagcgcctccagcccatcgacgtcctgagcaacaagatcgccaagttccagaactcgacgaaccacaagtacgcgaactacatcgtgaagcagtgcctcaagcacaactgcgggcgcatccagatggagctgctcaagggcatctccaagaacgaccgcatcctcaaggactggacctacttcgacctccaggagaaaatcaagaaccaggcggagatccacggcatcgaggtcatcaaggtcgccccggcctacacgagccagcggtgcagccagtgcgggtacatctgcaaggagaaccgctgcacccaggcgacgttcgagtgcaagcagtgcgggtacaagacccacgccgactacaacgccgccaagaacatctcgacgtacgacatcgagaacatcatcaacaagcagctcgcggtgcagtccaagctccactccaagaagtgcatggaggagtacatcgaggagctgggctacctcgactag

SEQ ID NO: 2127 - DNA, 1356 bp, Unknown
  Bacillus sp. multi
ctgggcgtcacgatcaagatcatgaagtaccagatcctctgcccgatgaacgtggactggacgatcttcgagaagcacctccgcaacctcacgtaccaagtccggacgatctccaaccgcaccatccagcagctctgggagttcgacgcgctgtcgttcgactacttcaaggagcgcggcacctacccgacggaccaagacctgtacgggtgcacgcagaagaaaatagacggctacatctaccacaccctccagagcaagtaccccgacatccacaaggggaacatgagcacgacgctccagaagatcattaagacctggaagtcccggcggaacgagatccgcaagggcgagatgtccatcccgagcttccgcaaccgcatccccatcgacctccacaacaactcggtggacatcacgaaggagaagaatggcgactacatcgcgggcatctccctgttctcccgcgacttccacaaggagaacgacgacgtgccgaagggcaagatattcgtgaagctcgccacccagaagcagaagtcgatgaaggtgatcctggaccgcctcatcaaccagacctactcgaagggcgcgtgcatgatccacaagtacaagaacaagtggtatctttcaatcacgtacaagttcaacgcgatcaaggagaacaagttcgacaaggaactgattatggggatcgacctcggcgggatcaacaccgtgtacttcgccttcaacgagggcttcatccggagcaacatcaagagcgacgagatcaagatgttcaacgagcgcatccggcagcgccggatcaacctcctcaagcagtccaagtactgctccaactcccgcaccgggaagggccgcaccaagcggctccagcccatcgacgtgctgtccaacaagatcgccaagttccagaactcgaccaaccacaagtacgcgaactacatcgtgaagcagtgcctcaagcacaactgcgggcgcatccagatggagctgctcaagggcatctccaagaacgaccgcatcctcaaggactggacgtacttcgacctccaggagaagatcaagaatcaggccgagatccacggcatcgaggtcatcaaggtcgccccggcctacaccagccagcgctgctcccagtgcgggtacatctgcaaggagaaccgctgcacccaggcgacgttcgagtgcaagcagtgcggctacaagacccacgcggactacaacgcggccaagaacatctcgacgtacgacatcgagaacatcatcaacaagcagctcgccgtgcagtccaagctgcactccaagaagtgcatggaggagtacatcgaggagctgggctacctggactga

SEQ ID NO: 2128 - DNA, 1356 bp, Unknown
  Bacillus sp. multi
ctgggcgtgacgatcaagatcatgaagtaccagatcctctgccccatgaacgtggactggaccatcttcgagaagcacctccgcaacctgacctaccaggtgcggacgatctccaaccgcacgatccagcagctctgggagttcgacgccctctcgttcgactacttcaaggagcgcgggacgtaccccaccgaccaagacctctacgggtgcacgcagaagaaaattgacgggtacatctaccacacgctccagtcgaagtaccccgacatccacaagggcaacatgagcaccaccctccagaaaatcatcaagacttggaagtcccgccgcaacgagatccggaagggcgagatgtcgatccccagcttccgcaaccgcatccccatcgacctgcacaacaactcggtggacatcacgaaggagaagaacggggactacatcgcgggcatctcgctgttcagccgcgacttccacaaggagaacgacgacgtgccgaagggcaagatattcgtcaagctggccacgcagaagcagaagtcgatgaaggtgatcctggaccggctcatcaaccagacctactcgaagggcgcgtgcatgatccacaagtacaagaacaagtggtatctcagcatcacctacaagttcaacgccatcaaggagaacaagttcgacaaggagcttatcatgggcatcgacctgggcgggatcaacaccgtgtacttcgcgttcaacgaggggttcatccgctccaacatcaagtcggacgagatcaagatgttcaacgagcgcatccggcagcgccggatcaacctgctcaagcagagcaaatactgttcgaactcgcggacggggaagggccgcaccaagcggctccagcccatcgacgtcctgtcgaacaagatcgccaagttccagaacagcacgaaccacaagtacgccaactacatcgtgaagcagtgcctcaagcacaactgcgggcgcatccagatggagctgctcaagggcatctccaagaacgaccgcatcctcaaggactggacgtacttcgacctccaggagaaaattaagaatcaggcggagatccacgggatcgaggtcatcaaggtcgccccggcctacaccagccagcgctgctcgcagtgcggctacatctgcaaggagaaccgctgcacccaggccaccttcgagtgcaagcagtgcgggtacaagacgcacgccgactacaacgccgccaagaacatcagcacgtacgacatcgagaacatcatcaacaagcagctcgcggtccagagcaagctgcacagcaagaagtgcatggaggagtacatcgaggagctgggctacctggactga

SEQ ID NO: 2129 - DNA, 1356 bp, Unknown
  Bacillus sp. multi
ctgggcgtcacgatcaagatcatgaagtaccagatcctctgccccatgaacgtggactggaccatcttcgagaagcacctccgcaacctgacgtaccaggtgcggacgatcagcaaccgcaccatccagcagctctgggagttcgacgcgctctcgttcgactacttcaaggagcggggcacctacccgaccgaccaagacctctatggctgcacccagaagaagatcgacggctacatctaccacaccctccagagcaagtacccggacatccacaagggcaacatgagcacgaccctccagaaaatcatcaagacatggaagtcccgccggaacgagatccggaagggcgagatgtccatccccagcttccggaaccgcatccccatcgacctgcacaacaactccgtggacatcacgaaggagaagaacggggactacatcgcgggcatctcgctgttcagccgcgacttccacaaggagaacgacgacgtgccgaagggcaaaatcttcgtgaagctggcgacgcagaagcagaagtccatgaaggtgatcctggaccggctcatcaaccagacgtactcgaagggcgcgtgcatgatccacaagtacaagaacaagtggtacttgagcatcacctacaagttcaacgccatcaaggagaacaagttcgacaaggaactcataatggggatcgacctcggcggcatcaacacggtgtacttcgcgttcaacgaggggttcatccgcagcaacatcaagtcggacgagatcaagatgttcaacgagcgcatccggcagcggcggatcaacctgctcaagcagtccaaatactgctccaacagccgcacgggcaagggccggacgaagcggctccagcccatcgacgtgctgtccaacaagatcgccaagttccagaactccaccaaccacaagtacgcgaactacatcgtcaagcagtgcctcaagcacaactgcgggcgcatccagatggagctgctcaagggcatcagcaagaacgaccgcatcctcaaggactggacctacttcgacctccaggaaaagattaagaatcaggcggagatccacgggatcgaggtcatcaaggtcgccccggcctacacctcgcagcggtgcagccagtgcgggtacatctgcaaggagaaccggtgcacccaggccaccttcgagtgcaagcagtgcggctacaagacccacgccgactacaacgcggccaagaacatcagcacgtacgacatcgagaacatcatcaacaagcagctcgccgtgcagagcaagctgcacagcaagaaatgcatggaggagtacatcgaggagctgggctacctggactga

SEQ ID NO: 2130 - DNA, 1356 bp, Unknown
  Bacillus sp. multi
ctgggcgtcacgatcaagatcatgaagtaccagatcctctgcccgatgaacgtggactggaccatcttcgagaagcacctccgcaacctcacctaccaggtccggacgatctcgaaccgcacgatccagcagctctgggagttcgacgccctgagcttcgactacttcaaggagcgcgggacgtacccgaccgtccaagacctctatgggtgcacgcagaagaagatcgacgggtacatctaccacaccctccagagcaagtacccggacatccacaagggcaacatgagcaccaccctccagaaaatcatcaagacctggaagtcccggcgcaacgagatccgcaagggcgagatgtccatcccgtccttccgcaaccgcatccccatcgacctccacaacaactccgtggacatcatcaaggagaagaatggcgactacatcgcggggatcagcctgttcagccgcgacttccacaaggagaacggggacgtgccgaagggcaagatattcgtcaagctcggcacgcagaagcagaagtccatgaaggtgatcctcgaccggctcatcaaccagacctacagcaagggcgcgtgcatgatccacaagtacaagaacaagtggtatctctccatcacctacaagttcaacgcgatcaaggagaacaagttcgacaaggaactgataatgggcatcgacatgggcggcatcaacacggtgtacttcgccttcaacgagggcttcatccggagcaacatcaagtccgacgagatcaagatgttcaacgagcgcatccggcagcgccggatcaacctgctcaagcagtccaaatactgctccaacagccgcaccggcaaggggcgcatgaagcggctccagcccatcgacgtcctctccaacaagatcgccaagttccgcaacagcaccaaccacaagtacgccaactacatcgtcaagcagtgcctcaagcacaactgcgggcgcatccagatggagctgctcaagggcatcagcaagaacgacaagatcctcaaggactggacgtacttcgacctccaggagaagatcaagaaccaggccgagatccacgggatcgaggtcatcaaggtcgccccggcctacaccagccagcggtgctcccagtgcggctacatctgcaaggagaaccgctgcacccaggccacgttcgagtgcaagcagtgcggctacaagacccacgccgactacaacgcggccaagaacatcagcacgtacgacatcgagaacatcatcaacaagcagctcgccgtgcagtcgaagctccacagcaagaagtgtatggaggagtacatcgaggagctgggctacctcgactga

SEQ ID NO: 2131 - DNA, 1356 bp, Unknown
  Bacillus sp. multi
ctcggcgtcacgatcaagatcatgaagtaccagatcctctgccccatgaacgtggactggaccatcttcgagaagcacctccggaacctcacctaccaagttcggacgatctccaaccggacgatccagcagctctgggagttcgacgcgctctccttcgactacttcaaggagcgcggcacgtacccgacggtccaagacctgtacggctgcacgcagaagaagatcgacggctacatctaccacaccctccagagcaagtacccggacatccacaagggcaacatgagcaccaccctccagaaaatcattaagacctggaagtcccggcgcaacgagatccgcaagggcgagatgtccatccccagcttccgcaaccgcatccccatcgacctgcacaacaactcggtggacatcatcaaggagaagaatggggactacatcgccgggatctccctgttctcgcgcgacttccacaaggagaacggggacgtgccgaagggcaagatattcgtcaagctcggcacgcagaagcagaagtcgatgaaggtcatcctggaccgcctcatcaaccagacgtacagcaagggcgcgtgcatgatccacaagtacaagaacaagtggtacctctcgatcacctacaagttcaacgcgatcaaggagaacaagttcgacaaggagcttatcatgggcatcgacatgggcggcatcaacaccgtgtacttcgcgttcaacgaggggttcatccggagcaacatcaagtccgacgagatcaagatgttcaacgagcgcatccggcagcgccgcatcaacctcctcaagcagagcaagtactgttccaacagccgcaccgggaaggggcgcatgaagcggctccagcccatcgacgtgctgagcaacaagatcgccaagttccgcaacagcaccaaccacaagtacgccaactacatcgtcaagcagtgcctcaagcacaactgcgggcgcatccagatggagctgctcaaggggatcagcaagaacgacaagatcctcaaggactggacgtacttcgacctccaggagaaaatcaagaaccaggcggagatccacgggatcgaggtcatcaaggtcgccccggcctacaccagccagcggtgcagccagtgcgggtacatctgcaaggagaaccgctgcacccaggcgacgttcgagtgcaagcagtgcgggtacaagacccacgccgactacaacgcggccaagaacatcagcacctacgacatcgagaacatcatcaacaagcagctcgcggtgcagagcaagctccactccaagaagtgcatggaggagtacatcgaggagctgggctacctggactag

SEQ ID NO: 2132 - DNA, 1356 bp, Unknown
  Bacillus sp. multi
ctcggcgtgacgatcaagatcatgaagtaccagatcctctgcccgatgaacgtggactggacgatcttcgagaagcacctccgcaacctgacgtaccaggttcggacgatctccaaccggaccatccagcagctctgggagttcgacgcgctctcgttcgactacttcaaggagcgcggcacgtaccccacggtccaggacttgtacgggtgcacgcagaagaaaatcgacggctacatctaccacaccctccagtcgaagtacccggacatccacaagggcaacatgagcaccacgctccagaagattatcaagacctggaagtcccggcgcaacgagatccggaagggcgagatgagcatcccctccttccgcaaccgcatccccatcgacctccacaacaactcggtggacatcatcaaggagaagaacggggactacatcgccgggatctcgctgttctcgcgcgacttccacaaggagaacggcgacgtcccgaagggcaagatattcgtcaagctcggcacccagaagcagaagtcgatgaaggtcatcctggaccggctcatcaaccagacgtacagcaagggcgcgtgcatgatccacaagtacaagaacaagtggtatttgagcatcacctacaagttcaacgcgatcaaggagaacaagttcgacaaggagcttatcatgggcatcgacatgggcggcatcaacaccgtgtacttcgccttcaacgaggggttcatccgcagcaacatcaagtcggacgagatcaagatgttcaacgagcgcatccgccagcgccggatcaacctgctcaagcagagcaagtattgctcgaactcgcggacgggcaagggccggatgaagcggctccagcccatcgacgtgctcagcaacaagatcgccaagttccgcaactcgaccaaccacaagtacgcgaactacatcgtcaagcagtgcctcaagcacaactgcgggcgcatccagatggagctgctcaaggggatcagcaagaacgacaagatcctcaaggactggacctacttcgacctccaggagaagattaagaaccaggccgagatccacggcatcgaggtcatcaaggtcgcgcccgcctacacgagccagcgctgctcgcagtgcgggtacatctgcaaggagaaccgctgcacccaggcgacgttcgagtgcaagcagtgcggctacaagacgcacgccgactacaacgccgccaagaacatcagcacctacgacatcgagaacatcatcaacaagcagctcgcggtgcagtcgaagctccacagcaagaagtgcatggaggagtacatcgaggagctgggctacctggactag

SEQ ID NO: 2133 - DNA, 1356 bp, Unknown
  Bacillus sp. multi
ctcggcgtgacgatcaagatcatgaagtaccagatcctctgcccgatgaacgtggactggaccatcttcgagaagcacctccgcaacctgacgtaccaagttcggacgatctcgaaccgcaccatccagcagctctgggagttcgacgcgctctcgttcgactacttcaaggagcgcggcacctacccgaccgtccaagacctgtacgggtgcacgcaaaagaagatagacggctacatctaccacaccctccagagcaagtacccggacatccacaagggcaacatgagcaccaccctccagaaaatcatcaagacctggaagtcccggcgcaacgagatccggaagggcgagatgagcatcccgagcttccggaaccgcatccccatcgacctccacaacaacagcgtggacatcatcaaggagaagaacggcgactacatcgcggggatctcgctgttctcgcgcgacttccacaaggagaacggcgacgtcccgaagggcaagatcttcgtgaagctgggcacgcagaagcagaagtccatgaaggtcatcctggaccggctcatcaaccagacgtacagcaagggcgcgtgcatgatccacaagtacaagaacaagtggtacttgtccatcacctacaagttcaacgccatcaaggagaacaagttcgacaaggagctaatcatgggcatcgacatgggcgggatcaacaccgtgtacttcgccttcaacgaggggttcatccggagcaacatcaagagcgacgagatcaagatgttcaacgagcgcatccgccagcggcgcatcaacctcctcaagcagagcaaatactgctccaactcccgcaccgggaagggccgcatgaagcgcctccagcccatcgacgtgctgtccaacaagatcgccaagttccgcaacagcaccaaccacaagtacgccaactacatcgtgaagcagtgcctcaagcacaactgcgggcgcatccagatggagctgctcaagggcatcagcaagaacgacaagatcctcaaggactggacctacttcgacctccaggagaagattaagaaccaggccgagatccacggcatcgaggtcatcaaggtcgcgcccgcctacacgagccagcgctgctcgcagtgcggctacatctgcaaggagaaccggtgcacccaggccacgttcgagtgcaagcagtgcgggtacaagacccacgccgactacaacgcggccaagaacatctccacctacgacatcgagaacatcatcaacaagcagctcgccgtgcagtcgaagctgcactccaagaagtgcatggaggagtacatcgaggagctgggctacctggactga

SEQ ID NO: 2134 - DNA, 1356 bp, Unknown
  Bacillus sp. multi
ctcggcgtcaccatcaagatcatgaagtaccagatcctctgccccatgaacgtggactggaccatcttcgagaagcacctccgcaacctcacctaccaagtgcggacgatctccaaccggacgatccagcagctctgggagttcgacgccctgtcgttcgactacttcaaggagcggggcacctacccgaccgtccaagacctatacggctgcacccagaagaagatcgacgggtacatctaccacaccctccagtcgaagtacccggacatccacaagggcaacatgagcacgaccctccagaaaatcatcaagacctggaagtcccgccgcaacgagatccggaagggcgagatgtccatccccagcttccgcaaccgcatccccatcgacctgcacaacaacagcgtggacatcatcaaggagaagaacggcgactacatcgcggggatcagcctgttctcccgcgacttccacaaggagaacggcgacgtgccgaagggcaaaatcttcgttaagctcggcacgcagaagcagaagtccatgaaggtcatcctggaccgcctcatcaaccagacgtacagcaagggcgcgtgcatgatccacaagtacaagaacaagtggtatctgtccatcacctacaagttcaacgccatcaaggagaacaagttcgacaaggagttgattatggggatcgacatgggcgggatcaacaccgtgtacttcgcgttcaacgagggcttcatccggagcaacatcaagtcggacgagatcaagatgttcaacgagcgcatccggcagcggcggatcaacctgctcaagcagtccaagtactgctcgaactcccgcacggggaagggccgcatgaagcgcctccagcccatcgacgtcctctccaacaagatcgccaagttccgcaacagcacgaaccacaagtacgccaactacatcgtgaagcagtgcctcaagcacaactgcgggcgcatccagatggagctgctcaaggggatctccaagaacgacaagatcctcaaggactggacctacttcgacctccaggagaagattaagaaccaggcggagatccacggcatcgaggtcatcaaggtcgcgcccgcctacaccagccagcggtgctcgcagtgcgggtacatctgcaaggagaaccggtgcacccaggccaccttcgagtgcaagcagtgcggctacaagacccacgcggactacaacgccgccaagaacatctccacgtacgacatcgagaacatcatcaacaagcagctcgcggtgcagtccaagctccactccaagaagtgcatggaggagtacatcgaggagctgggctacctcgactga

SEQ ID NO: 2135 - DNA, 1335 bp, Unknown
  Bacillus sp. multi
atgaagtaccagatcctctgccccatgaacgtggactggacgatcttcgagaagcacctccgcaacctcacgtaccaagtccggacgatctcgaaccgcacgatccagcagctctgggagttcgacgccctgtccttcgactacttcaaggcgcgcggcacgtacccgacggtccaagatctctacggctgcacccagaagaaaattgacggctacatctaccacaagctccagagcaagtacccggacatccacaagggcaacatgagcaccaccctccagaaaatcatcaagacctggaagtcgcgccggaacgagatccgcaagggcgagatgagcatcccctccttccggaaccgcatccccatcgacctccacaacaacagcgtggacatcacgaaggagaagaatggcgactacatcgcgggcatctccctgttcagccgggacttccacaaggagaacggcgacgtgccgaagggcaagatcttcgtcaagctcgggaccaagaaacagaagtcgatgaaggtcatcctggaccgcctcatgaaccagacctacagcaagggcgcgtgcatgatccacaagtacaagaacaagtggtacttgagcatcacctacaagtgcaacgccctcaaggagaacaagttcgacaaggaactgataatggggatcgacatgggcggcatcaacacggtgtacttcgcgttcaacgagggcttcatccggaacaacatcaagtccgacgagatcaaggcgttcaacgagcgcatccgccagcgccgcatcaacctgctcaaccagtccaaatactgttcgaactcccgcacgggcaagggccggaccaagcgcctccagcccatcgacgtgctgtccaacaagatcgccaagttccgcaacagcaccaaccacaagtacgcgaactacatcatcaagcagtgcctcaagtacaactgcgggcgcatccagatggagctgctcaagggcatcagcaagaacgacaaggtgctcaaggactggacgtacttcgacctccaggagaaaatcaagaaccaggccgagatccggggcatcgagatcatcaaggtcgcgcccgcctacaccagccagcgctgctcccagtgcgggtacatctgcaaggagaaccgctgcacccaggccatgttcgagtgcaagcagtgcggctacaagacgcacgccgactacaacgcggccaagaacatcgccacctacgacatcgagaacatcatcaacaagcagctcgcggcccagtccaagctccactccaagaagtgcatggaggagtacatcgaggagctgggctacctggactga

SEQ ID NO: 2136 - DNA, 1335 bp, Unknown
  Bacillus sp. multi
atgaagtaccagatcctctgccccatgaacgtggactggacgatcttcgagaagcacctccgcaacctcacctaccaagtgcggacgatctcgaaccggaccatccagcagctctgggagttcgacgccctgagcttcgactacttcaaggcgcgcgggacgtacccgacggtccaggatctgtacggctgcacccagaagaaaatagacgggtacatctaccacaagctccagagcaagtacccggacatccacaaggggaacatgagcacgaccctccagaaaatcatcaagacctggaagtcccgccggaacgagatccgcaagggcgagatgtcgatcccgtccttccgcaaccgcatccccatcgacctccacaacaacagcgtggacatcacgaaggagaagaacggcgactacatcgcggggatcagcctgttctcccgcgacttccacaaggagaacggcgacgtgccgaagggcaaaatcttcgtgaagctcggcaccaagaaacagaagtccatgaaggtcatcctcgaccggctgatgaaccagacgtactcgaagggcgcgtgcatgatccacaagtacaagaacaagtggtatctctctattacctacaagtgcaacgccctcaaggagaacaagttcgacaaggagctgattatggggatcgacatgggcgggatcaacacggtgtacttcgccttcaacgaggggttcatccgcaacaacatcaagagcgacgagatcaaggcgttcaacgagcgcatccgccagcgccgcatcaacctgctcaaccagtccaagtattgctccaactcccggacgggcaaggggcggaccaagcgcctccagcccatcgacgtgctgagcaacaagatcgccaagttccgcaactccacgaaccacaagtacgccaactacatcatcaagcagtgcctcaagtacaactgcgggcgcatccagatggagctgctcaagggcatcagcaagaacgacaaggtgctcaaggactggacctacttcgacctccaggagaaaatcaagaaccaggcggagatccggggcatcgagatcatcaaggtggccccggcctacaccagccagcgctgctcgcagtgcgggtacatctgcaaggagaaccggtgcacccaggccatgttcgagtgcaagcagtgcggctacaagacccacgccgactacaacgcggccaagaacatcgccacgtacgacatcgagaacatcatcaacaagcagctcgccgcccagagcaagctccactccaagaaatgcatggaggagtacatcgaggagctgggctacctcgactag

SEQ ID NO: 2137 - DNA, 1335 bp, Unknown
  Bacillus sp. multi
atgaagtaccagatcctctgcccgatgaacgtggactggaccatcttcgagaagcacctccggaacctcacgtaccaagtgcggacgatctcgaaccggaccatccagcagctctgggagttcgacgccctcagcttcgactacttcaaggcgcgcggcacgtaccccaccgtccaagacctctatgggtgcacgcagaagaagatagacggctacatctaccacaagctccagtcgaagtaccccgacatccacaaggggaacatgagcacgaccctccagaaaatcatcaagacctggaagtcccgccggaacgagatccgcaagggcgagatgagcatcccgtccttccgcaaccgcatccccatcgacctgcacaacaacagcgtggacatcacgaaggagaagaatggcgactacatcgcgggcatcagcctgttcagccgcgacttccacaaggagaacggggacgtgccgaagggcaaaatcttcgtcaagctgggcaccaagaagcagaagtccatgaaggtcatcctcgaccgcctcatgaaccagacctacagcaagggcgcgtgcatgatccacaagtacaagaacaagtggtatctgtcgatcacctacaagtgcaacgcgctcaaggagaacaagttcgacaaggagcttattatggggatcgacatgggcgggatcaacaccgtgtacttcgccttcaacgaggggttcatccggaacaacatcaagtccgacgagatcaaggcgttcaacgagcgcatccgccagcggcgcatcaacctcctcaaccagagcaaatactgctccaactcccgcacgggcaaggggcgcaccaagcgcctccagcccatcgacgtgctgtccaacaagatcgccaagttccgcaactccacgaaccacaagtacgcgaactacatcatcaagcagtgcctcaagtacaactgcgggcgcatccagatggagctgctcaagggcatcagcaagaacgacaaggtgctcaaggactggacgtacttcgacctccaggagaaaattaagaatcaggccgagatccggggcatcgagatcatcaaggtcgccccggcctacaccagccagcggtgctcgcagtgcggctacatctgcaaggagaaccgctgcacccaggccatgttcgagtgcaagcagtgcgggtacaagacgcacgcggactacaacgcggccaagaacatcgccacgtacgacatcgagaacatcatcaacaagcagctcgccgcgcagtccaagctccactccaagaagtgcatggaggagtacatcgaggagctgggctacctggactag

SEQ ID NO: 2138 - DNA, 1335 bp, Unknown
  Bacillus sp. multi
atgaagtaccagatcctctgcccgatgaacgtggactggaccatcttcgagaagcacctccggaacctgacctaccaagtgcggacgatcagcaaccgcacgatccagcagctctgggagttcgacgccctcagcttcgactacttcaaggcgcgcggcacctacccgacggtccaggatctctacgggtgcacgcagaagaagattgacgggtacatctaccacaagctccagtcgaagtaccccgacatccacaagggcaacatgagcaccacgctccagaagatcatcaagacctggaaatctaggcgcaacgagatccgcaagggcgagatgtccatcccgtccttccggaaccgcatccccatcgacctccacaacaacagcgtggacatcacgaaggagaagaatggcgactacatcgcgggcatcagcctgttcagccgcgactttcataaggagaacggggacgtgccgaagggcaagatcttcgtcaagctgggcaccaagaaacagaagtccatgaaggtgatcctggaccggctcatgaaccagacctacagcaagggcgcgtgcatgatccacaagtacaagaacaagtggtacctgagcatcacctacaagtgcaacgcgctcaaggagaacaagttcgacaaggaactcatcatgggcatcgacatgggcggcatcaacaccgtgtacttcgcgttcaacgagggcttcatccgcaacaacatcaagagcgacgagatcaaggcgttcaacgagcgcatccgccagcgccgcatcaacctgctcaaccagtccaagtactgctccaactcccgcaccggcaaggggcggaccaagcgcctccagcccatcgacgtcctgtcgaacaagatcgccaagttccgcaactccaccaaccacaagtacgcgaactacatcatcaagcagtgcctcaagtacaactgcgggcgcatccagatggagctgctcaagggcatcagcaagaacgacaaggtgctcaaggactggacgtacttcgacctccaggagaagattaagaatcaggccgagatccggggcatcgagatcatcaaggtggccccggcctacacctcccagcgctgctcgcagtgcggctacatctgcaaggagaaccgctgcacccaggccatgttcgagtgcaagcagtgcgggtacaagacccacgcggactacaacgcggccaagaacatcgccacgtacgacatcgagaacatcatcaacaagcagctcgccgcccagtcgaagctgcactccaagaaatgcatggaggagtacatcgaggagctgggctacctggactag

SEQ ID NO: 2139 - DNA, 1335 bp, Unknown
  Bacillus sp. multi
atgaagtaccagatcctctgccccatgaacgtggactggacgatcttcgagaagcacctccgcaacctcacgtaccaagtgcggacgatctcgaaccgcacgatccagcagctctgggagttcgacgcgctgagcttcgactacttcaaggcgcgcgggacgtacccgaccgtccaggatctgtacggctgcacccaaaagaaaatcgacgggtacatctaccacaagctccagagcaagtacccggacatccacaaggggaacatgagcaccaccctccagaaaatcatcaagacctggaagtcccgccgcaacgagatccgcaagggcgagatgagcatcccgagcttccgcaaccgcatccccatcgacctgcacaacaactccgtggacatcacgaaggagaagaatggcgactacatcgccgggatctccctgttctcccgcgacttccacaaggagaacggcgacgtgccgaagggcaaaatcttcgttaagctgggcaccaagaagcagaagtccatgaaggtgatcctggaccgcctcatgaaccagacgtacagcaagggcgcgtgcatgatccacaagtacaagaacaagtggtatctcagcatcacgtacaagtgcaacgcgctcaaggagaacaagttcgacaaggagctaatcatgggcatcgacatgggcgggatcaacacggtgtacttcgcgttcaacgagggcttcatccggaacaacatcaagtccgacgagatcaaggcgttcaacgagcgcatccgccagcggcgcatcaacctgctcaaccagagcaagtattgctccaacagccggacggggaaggggcgcacgaagcggctccagcccatcgacgtgctgagcaacaagatcgccaagttccgcaacagcacgaaccacaagtacgcgaactacatcatcaagcagtgcctcaagtacaactgcgggcgcatccagatggagctgctcaaggggatcagcaagaacgacaaggtgctcaaggactggacctacttcgacctccaggaaaagattaagaaccaggcggagatccggggcatcgagatcatcaaggtcgcgcccgcctacaccagccagcggtgctcccagtgcggctacatctgcaaggagaaccgctgcacccaggccatgttcgagtgcaagcagtgcgggtacaagacgcacgcggactacaacgcggccaagaacatcgccacgtacgacatcgagaacatcatcaacaagcagctcgccgcgcagtcgaagctccactccaagaaatgcatggaggagtacatcgaggagctgggctacctcgactga

SEQ ID NO: 2140 - DNA, 1356 bp, Unknown
  Bacillus sp. multi
ctgggcgtcacgatcaagatcatgaagtaccagatcctctgcccgatgaacgtggactggaccatcttcgagaagcacctccgcaacctcacctaccaggtccggacgatcagcaaccggaccatccagcagctctgggagttcgacgcgctctccttcgactacttcaaggagcgcggcacgtaccccacggtccaagacctctacggctgcacccagaagaagatcgacggctacatctaccacacgctccagagcaagtaccccgacatccacaagggcaacatgagcacgacgctccagaagatcatcaagacctggaagtcccggcggaacgagatccgcaagggcgagatgtccatcccctccttccgcaaccgcatccccatcgacctgcacaacaactcggtggacatcatcaaggagaagaatggcgactacatcgccgggatctccctcttcagccgcgacttccacaaggagaacggcgacgtcccgaagggcaagatcttcgtgaagctcggcacgcagaagcagaagtccatgaaggtgatcctggaccgcctcatcaaccagacctactcgaagggcgcgtgcatgatccacaagtacaagaacaagtggtaccttagcatcacctacaagttcaacgccatcaaggagaacaagttcgacaaggagttgataatgggcatcgacatgggcgggatcaacaccgtgtacttcgcgttcaacgaggggttcatccgctccaacatcaagtcggacgagatcaagatgttcaacgagcgcatccgccagcgccggatcaacctcctcaagcagtccaaatactgctccaactcgcggacgggcaagggccgcacgaagcgcctccagcccatcgacgtgctgtccaacaagatcgccaagttccgcaactccacgaaccacaagtacgccaactacatcgtgaagcagtgcctcaagcacaactgcgggcgcatccagatggagctgctcaagggcatctccaagaacgacaaggtgctcaaggactggacctacttcgacctccaggagaagattaagaaccaggcggagatatacgggatcgaggtcatcaaggtcgtgcccgcctacaccagccagcggtgctcccagtgcggctacatctgcaaggagaaccgctgcacccaggccatgttcgagtgcaagcagtgcggctacaagacgcacgccgactacaacacggccaagaacatctccacctacgacatcgagaacatcatcaacaagcagctcgcggtgcagtccaagctccacagcaagaagtgcatggaggagtacatcgaggagctgggctacctggactga

SEQ ID NO: 2141 - DNA, 1356 bp, Unknown
  Bacillus sp. multi
ctcggcgtcaccatcaagatcatgaagtaccagatcctctgccccatgaacgtggactggacgatcttcgagaagcacctccgcaacctcacctaccaagtgcggacgatctcgaaccggacgatccagcagctctgggagttcgacgccctgtcgttcgactacttcaaggagcgcggcacctacccgaccgtccaagacctctacggctgcacccagaagaagatcgacggctacatctaccacacgctccagagcaagtaccccgacatccacaagggcaacatgagcacgaccctccagaaaatcatcaagacctggaagtcccgccgcaacgagatccggaagggcgagatgtccatccccagcttccgcaaccgcatccccatcgacctgcacaacaactccgtggacatcatcaaggagaagaacggggactacatcgccgggatctccctgttctcgcgcgacttccacaaggagaacggcgacgtcccgaagggcaagatattcgtcaagctcggcacgcagaagcagaagtccatgaaggtgatcctcgaccggctcatcaaccagacctacagcaagggcgcgtgcatgatccacaagtacaagaacaagtggtatcttagcatcacctacaagttcaacgcgatcaaggagaacaagttcgacaaggagctcatcatggggatcgacatgggcggcatcaacaccgtgtacttcgcgttcaacgagggcttcatccgcagcaacatcaagagcgacgagatcaagatgttcaacgagcgcatccgccagcgccggatcaacctcctcaagcagtccaagtattgctccaactcccgcacgggcaagggccgcaccaagcgcctccagcccatcgacgtcctcagcaacaagatcgccaagttccgcaactccacgaaccacaagtacgccaactacatcgtgaagcagtgcctcaagcacaactgcgggcgcatccagatggagctgctcaagggcatctccaagaacgacaaggtgctcaaggactggacctacttcgacctccaggagaagatcaagaaccaggccgagatctatggcatcgaggtcatcaaggtggtcccggcctacacgagccagcggtgctcgcagtgcgggtacatctgcaaggagaaccgctgcacccaggccatgttcgagtgcaagcagtgcggctacaagacgcacgccgactacaacacggccaagaacatctcgacctacgacatcgagaacatcatcaacaagcagctcgccgtccagagcaagctccactccaagaagtgcatggaggagtacatcgaggagctgggctacctggactag

SEQ ID NO: 2142 - DNA, 1356 bp, Unknown
  Bacillus sp. multi
ctcggggtcacgatcaagatcatgaagtaccagatcctctgccccatgaacgtggactggaccatcttcgagaagcacctccgcaacctcacctaccaggtgcggacgatcagcaaccggacgatccagcagctctgggagttcgacgccctctccttcgactacttcaaggagcgcggcacgtaccccaccgtccaggatctctacggctgcacgcagaagaagatagacggctacatctaccacaccctccagagcaagtaccccgacatccacaaggggaacatgagcaccaccctccagaaaatcatcaagacctggaagtcccggcgcaacgagatccgcaagggcgagatgagcatcccgtccttccgcaaccgcatccccatcgacctccacaacaactccgtggacatcatcaaggagaagaatggcgactacatcgcggggatctccctgttcagccgcgacttccacaaggagaacggcgacgtgccgaagggcaaaatcttcgtgaagctggggacgcagaagcagaagtcgatgaaggtgatcctggaccgcctcatcaaccagacctactcgaagggcgcgtgcatgatccacaagtacaagaacaagtggtacctgtccatcacctacaagttcaacgcgatcaaggagaacaagttcgacaaggagctgataatggggatcgacatgggcgggatcaacaccgtgtacttcgccttcaacgagggcttcatccggtccaacatcaagagcgacgagatcaagatgttcaacgagcgcatccgccagcggcgcatcaacctgctcaagcagagcaagtactgttcgaactcccgcacgggcaagggccgcaccaagcggctccagcccatcgacgtgctgagcaacaagatcgccaagttccgcaacagcacgaaccacaagtacgcgaactacatcgtgaagcagtgcctcaagcacaactgcgggcgcatccagatggagctgctcaagggcatctccaagaacgacaaggtgctcaaggactggacctacttcgacctccaggagaagattaagaaccaggccgagatctacgggatcgaggtcatcaaggtcgtccccgcctacacctcgcagcggtgcagccagtgcggctacatctgcaaggagaaccgctgcacccaggccatgttcgagtgcaagcagtgcgggtacaagacgcacgccgactacaacaccgccaagaacatctccacctacgacatcgagaacatcatcaacaagcagctcgccgtgcagagcaagctccactccaagaagtgcatggaggagtacatcgaggagctgggctacctggactag

SEQ ID NO: 2143 - DNA, 1356 bp, Unknown
  Bacillus sp. multi
ctcggcgtgacgatcaagatcatgaagtaccagatcctctgccccatgaacgtggactggacgatcttcgagaagcacctccgcaacctcacctaccaagtgcggacgatctccaaccggaccatccagcagctctgggagttcgacgccctcagcttcgactacttcaaggagcgcggcacctaccccaccgtccaagacttgtacgggtgcacgcagaagaagatcgacggctacatctaccacaccctccagagcaagtacccggacatccacaagggcaacatgagcaccaccctccagaaaatcatcaagacctggaagtcgcggcggaacgagatccggaagggcgagatgagcatcccctccttccgcaaccgcatccccatcgacctccacaacaacagcgtggacatcatcaaggagaagaacggcgactacatcgcggggatcagcctgttcagccgggacttccacaaggagaacggcgacgtcccgaagggcaagatcttcgtcaagctgggcacccagaagcagaagtcgatgaaggtcatcctcgaccggctcatcaaccagacgtacagcaagggcgcgtgcatgatccacaagtacaagaacaagtggtatctcagcatcacgtacaagttcaacgcgatcaaggagaacaagttcgacaaggagctcatcatgggcatcgacatgggcgggatcaacaccgtgtacttcgcgttcaacgaggggttcatccgctcgaacatcaagagcgacgagatcaagatgttcaacgagcgcatccgccagcgccggatcaacctcctcaagcagtccaagtattgttcgaactcgcgcacgggcaagggccgcaccaagcgcctccagcccatcgacgtgctctcgaacaagatcgccaagttccgcaactccacgaaccacaagtacgcgaactacatcgtgaagcagtgcctcaagcacaactgcgggcgcatccagatggagctgctcaaggggatcagcaagaacgacaaggtgctcaaggactggacctacttcgacctccaggagaagatcaagaatcaggccgagatctacggcatcgaggtcatcaaggtcgtccccgcctacacctcccagcggtgctcgcagtgcggctacatctgcaaggagaaccgctgcacccaggccatgttcgagtgcaagcagtgcgggtacaagacccacgcggactacaacacggccaagaacatctccacctacgacatcgagaacatcatcaacaagcagctcgccgtgcagtcgaagctccactccaagaagtgcatggaggagtacatcgaggagctgggctacctcgactga

SEQ ID NO: 2144 - DNA, 1356 bp, Unknown
  Bacillus sp. multi
ctcggggtgacgatcaagatcatgaagtaccagatcctctgccccatgaacgtggactggacgatcttcgagaagcacctccggaacctcacgtaccaagtgcggacgatctccaaccggacgatccagcagctctgggagttcgacgcgctgtcgttcgactacttcaaggagcgcggcacctaccccacggtccaagacctctacgggtgcacgcagaagaagatcgacgggtacatctaccacaccctccagagcaagtacccggacatccacaaggggaacatgagcaccaccctccagaaaatcattaagacctggaagtcgcgccgcaacgagatccgcaagggcgagatgtcgatcccgtccttccgcaaccgcatccccatcgacctgcacaacaacagcgtggacatcatcaaggagaagaacggcgactacatcgccgggatctccctgttctcgcgggacttccacaaggagaacggcgacgtcccgaagggcaagatcttcgtgaagctcgggacgcagaagcagaagtccatgaaggtcatcctcgaccgcctcatcaaccagacctactcgaagggcgcgtgcatgatccacaagtacaagaacaagtggtatctctccatcacctacaagttcaacgccatcaaggagaacaagttcgacaaggagcttatcatgggcatcgacatgggcgggatcaacacggtgtacttcgcgttcaacgaggggttcatccggtccaacatcaagtcggacgagatcaagatgttcaacgagcgcatccggcagcggcgcatcaacctgctcaagcagtccaaatactgttccaactcccgcaccgggaaggggcgcaccaagcgcctccagcccatcgacgtgctcagcaacaagatcgccaagttccgcaactcgaccaaccacaagtacgccaactacatcgtcaagcagtgcctcaagcacaactgcgggcgcatccagatggagctgctcaagggcatcagcaagaacgacaaggtgctcaaggactggacgtacttcgacctccaggagaagatcaagaaccaggccgagatctacgggatcgaggtcatcaaggtggtccccgcctacaccagccagcgctgctcgcagtgcggctacatctgcaaggagaaccgctgcacccaggcgatgttcgagtgcaagcagtgcgggtacaagacccacgcggactacaacaccgccaagaacatcagcacctacgacatcgagaacatcatcaacaagcagctcgcggtccagagcaagctccactccaagaagtgcatggaggagtacatcgaggagctgggctacctcgactga

SEQ ID NO: 2145 - DNA, 1335 bp, Unknown
  Bacillus sp. multi
atgaagtaccagatcctctgccccatgaacgtggactggaccatcttcgagaagcacctccgcaacctcacctaccaagtccggacgatcagcaaccgcaccatccagcagctctgggagttcgacgcgctcagcttcgactacttcaaggagcgcgggacgtaccccaccgtccaggatctctacggctgcacgcagaagaagatcgacggctacatctaccacaccctccagagcaagtaccccgacatccacaagggcaacatgagcacgaccctccaaaagattatcaagacctggaagtctcggcgtaacgagatccggaagggcgagatgagcatcccgagcttccggaaccgcatccccatcgacctccacaacaacagcgtggacatcacgaaggagaagaacggggcgtacatcgcgggcatctcgttcttcagccgtgactttcataaggagaacggggacgtgccgaagggcaaaatcttcgtgaagctctccacgcagaagcagaagtccatgaaggtcatcctggaccgcctcatgaaccagacgtacagcaagggcgcgtgcatgatccacaagtacaagaacaagtggtacctgagcatcacctacaagttcaacgcgatcaaggagaacaagttcgacaaggagctaatcatgggcatcgacatgggcggcatcaacaccgtgtacttcgcgttcaacgaggggttcatccgcagcaacatcaagagcgacgagatcaaggcgttcaacgagcgcatccggcagcggcgcatcaacctcctcaagcagagcaagtactgctcgaactcccgcacgggcaaggggcggacgaagcgcctccagcccatcgacgtgctgtcgaacaagatcgccaagttccgcaacagcaccaaccacaagtacgccaactacatcgtcaagcagtgcctcaagcacaactgcgggcgcatccagatggagctgctcaagggcatctccaagaacgacaagatcctcaaggactggacctacttcgacctccaggaaaagatcaagaaccaggccgagatccacggcatcgaggtcatcaaggtcgcgcccgcctacacctcccagcgctgctcgcagtgcggctacatctgcaaggagaaccggtgcacccaggccatgttcgagtgcaagcagtgcgggtacaagacgcacgccgactacaacgcggccaagaacatctccacctacgacatcgagaacatcatcaacaagcagctcgcggtgcagtccaagctccacagcaagaagtgcatggaggagtacatcgaggagctgggctacctcgactga

SEQ ID NO: 2146 - DNA, 1335 bp, Unknown
  Bacillus sp. multi
atgaagtaccagatcctctgccccatgaacgtggactggaccatcttcgagaagcacctccggaacctgacctaccaagtccggacgatcagcaaccgcacgatccagcagctctgggagttcgacgccctgtccttcgactacttcaaggagcgcggcacctacccgaccgtccaagacctctacggctgcacccagaagaaaatcgacggctacatctaccacaccctccagagcaagtacccggacatccacaagggcaacatgagcaccacgctccagaagatcatcaagacctggaagtcccggcgcaacgagatccgcaagggcgagatgagcatcccctccttccgcaaccgcatccccatcgacctgcacaacaacagcgtggacatcacgaaggagaagaatggggcgtacatcgcgggcatctcattcttcagccgcgatttccacaaggagaacggcgacgtgccgaagggcaaaatcttcgtgaagctcagcacccagaagcagaagtccatgaaggtcatcctggaccgcctgatgaaccagacctactcgaagggcgcgtgcatgatccacaagtacaagaacaagtggtatcttagcatcacctacaagttcaacgccatcaaggagaacaagttcgacaaggagcttattatgggcatcgacatgggcggcatcaacaccgtgtacttcgccttcaacgagggcttcatccgcagcaacatcaagtcggacgagatcaaggcgttcaacgagcgcatccgccagcggcgcatcaacctcctcaagcagagcaagtactgctccaacagccgcacggggaagggccggacgaagcgcctccagcccatcgacgtcctctcgaacaagatcgccaagttccgcaacagcaccaaccacaagtacgcgaactacatcgtgaagcagtgcctcaagcacaactgcgggcgcatccagatggagctgctcaagggcatcagcaagaacgacaagatcctcaaggactggacgtacttcgacctccaggaaaagatcaagaaccaggccgagatccacggcatcgaggtcatcaaggtcgccccggcctacacgagccagcgctgctcgcagtgcggctacatctgcaaggagaaccggtgcacccaggcgatgttcgagtgcaagcagtgcggctacaagacccacgcggactacaacgcggccaagaacatctccacgtacgacatcgagaacatcatcaacaagcagctcgccgtgcagagcaagctgcacagcaagaagtgcatggaggagtacatcgaggagctgggctacctggactga

SEQ ID NO: 2147 - DNA, 1335 bp, Unknown
  Bacillus sp. multi
atgaagtaccagatcctctgccccatgaacgtggactggacgatcttcgagaagcacctccgcaacctcacctaccaagtccggacgatcagcaaccgcacgatccagcagctctgggagttcgacgcgctgagcttcgactacttcaaggagcgcggcacctacccgaccgtccaggacttgtacggctgcacgcagaagaagattgacggctacatctaccacaccctccagagcaagtaccccgacatccacaagggcaacatgagcacgacgctccaaaagattatcaagacctggaagtcgcggcgcaacgagatccgcaagggcgagatgtccatcccctccttccgcaaccgcatccccatcgacctgcacaacaactccgtggacatcacgaaggagaagaacggggcgtacatcgcgggaatcagcttcttcagccgggacttccacaaggagaacggggacgtgccgaagggcaagatcttcgtgaagctctccacccagaagcagaagtccatgaaggtcatcctcgaccgcctgatgaaccagacctacagcaagggcgcgtgcatgatccacaagtacaagaacaagtggtacttgagcatcacctacaagttcaacgccatcaaggagaacaagttcgacaaggagttaatcatgggcatcgacatgggcggcatcaacaccgtgtacttcgccttcaacgaggggttcatccgcagcaacatcaagtccgacgagatcaaggcgttcaacgagcgcatccggcagcggcggatcaacctgctcaagcagagcaaatactgttcgaactcccgcaccggcaagggccggaccaagcggctccagcccatcgacgtgctctccaacaagatcgccaagttccgcaactcgacgaaccacaagtacgcgaactacatcgtgaagcagtgcctcaagcacaactgcgggcgcatccagatggagctgctcaagggcatcagcaagaacgacaagatcctcaaggactggacctacttcgacctccaggaaaagatcaagaaccaggccgagatccacggcatcgaggtcatcaaggtcgccccggcctacaccagccagcgctgctcccagtgcggctacatctgcaaggagaaccgctgcacccaggcgatgttcgagtgcaagcagtgcggctacaagacccacgcggactacaacgccgccaagaacatctcgacctacgacatcgagaacatcatcaacaagcagctcgcggtgcagtcgaagctccacagcaagaagtgcatggaggagtacatcgaggagctgggctacctcgactag

SEQ ID NO: 2148 - DNA, 1335 bp, Unknown
  Bacillus sp. multi
atgaagtaccagatcctctgcccgatgaacgtggactggaccatcttcgagaagcacctccgcaacctcacctaccaagtacggacgatctcgaaccgcaccatccagcagctctgggagttcgacgccctcagcttcgactacttcaaggagcgcggcacctacccgaccgtccaggatctctacgggtgcacgcagaagaagatcgacgggtacatctaccacaccctccagtcgaagtaccccgacatccacaaggggaacatgagcacgaccctccagaaaatcatcaagacctggaagtcccgccggaacgagatccggaagggcgagatgagcatccccagcttccgcaaccgcatccccatcgacctgcacaacaactccgtggacatcacgaaggagaagaatggggcgtacatcgcggggatcagcttcttcagcagggatttccataaggagaacggcgacgtcccgaagggcaagatcttcgtgaagctcagcacccagaagcagaagtcgatgaaggtgatcctcgaccggctgatgaaccagacctactcgaagggcgcgtgcatgatccacaagtacaagaacaagtggtacttgagcatcacctacaagttcaacgcgatcaaggagaacaagttcgacaaggagttgatcatggggatcgacatgggcggcatcaacacggtgtacttcgccttcaacgagggcttcatccggtcgaacatcaagtcggacgagatcaaggcgttcaacgagcgcatccggcagcggcggatcaacctcctcaagcagagcaaatactgctcgaactcccgcacgggcaaggggcggaccaagcgcctccagcccatcgacgtgctgtccaacaagatcgccaagttccgcaactccacgaaccacaagtacgccaactacatcgtgaagcagtgcctcaagcacaactgcgggcgcatccagatggagctgctcaaggggatctccaagaacgacaagatcctcaaggactggacctacttcgacctccaggaaaagatcaagaaccaggccgagatccacgggatcgaggtcatcaaggtcgccccggcctacaccagccagcggtgcagccagtgcgggtacatctgcaaggagaaccgctgcacccaggccatgttcgagtgcaagcagtgcgggtacaagacccacgccgactacaacgcggccaagaacatctccacctacgacatcgagaacatcatcaacaagcagctcgccgtgcagagcaagctccacagcaagaagtgcatggaggagtacatcgaggagctgggctacctcgactga

SEQ ID NO: 2149 - DNA, 1335 bp, Unknown
  Bacillus sp. multi
atgaagtaccagatcctctgcccgatgaacgtggactggacgatcttcgagaagcacctccgcaacctcacctaccaagtgcggacgatctcgaaccgcacgatccagcagctctgggagttcgacgcgctcagcttcgactacttcaaggagcgcggcacctacccgaccgtccaagacctgtacggctgcacccagaagaagatcgacgggtacatctaccacacgctccagagcaagtacccggacatccacaagggcaacatgagcaccacgctccagaaaatcatcaagacctggaagtcccgccgcaacgagatccgcaagggcgagatgtccatcccctccttccgcaaccgcatccccatcgacctccacaacaactccgtggacatcacgaaggagaagaacggcgcgtacatcgcgggcatctcattctttagccgcgacttccacaaggagaacggcgacgtgccgaagggcaagatattcgtgaagctctcgacccagaagcagaagtcgatgaaggtgatcctggaccggctcatgaaccagacgtactcgaagggcgcgtgcatgatccacaagtacaagaacaagtggtacttgagcatcacctacaagttcaacgccatcaaggagaacaagttcgacaaggagcttattatgggcatcgacatgggcgggatcaacacggtgtacttcgcgttcaacgaggggttcatccgctccaacatcaagtccgacgagatcaaggcgttcaacgagcgcatccgccagcggcgcatcaacctcctcaagcagagcaagtattgctccaactcgcgcacggggaagggccggacgaagcgcctccagcccatcgacgtcctctcgaacaagatcgccaagttccgcaactccaccaaccacaagtacgccaactacatcgtcaagcagtgcctcaagcacaactgcgggcgcatccagatggagctgctcaaggggatcagcaagaacgacaagatcctcaaggactggacctacttcgacctccaggaaaagatcaagaaccaggccgagatccacggcatcgaggtcatcaaggtcgccccggcctacacctcccagcggtgctcgcagtgcgggtacatctgcaaggagaaccgctgcacccaggccatgttcgagtgcaagcagtgcgggtacaagacccacgcggactacaacgcggccaagaacatcagcacctacgacatcgagaacatcatcaacaagcagctcgccgtgcagtccaagctccacagcaagaagtgtatggaggagtacatcgaggagctgggctacctggactag

SEQ ID NO: 2150 - DNA, 1335 bp, Unknown
  Bacillus sp. multi
atgaagtaccagatcctctgcccgatgaacgtggactggacgatcttcgagaagcacctccgcaacctcacctaccaagtccggacgatcagcaaccggacgatccagcagctctgggagttcgacgccctgtcgttcgactacttcaaggagcggggcacctaccccaccgtccaagacctatacggctgcacccagaagaagatcgacgggtacatctaccacaccctccagtcgaagtaccccgacatccacaaggggaacatgagcacgaccctccagaagatcatcaagacctggaagtcccggcgcaacgagatccggaagggcgagatgtccatcccgagcttccgcaaccgcatccccatcgacctgcacaacaacagcgtggacatcacgaaggagaagaacggggactacatcgcgggcatcagcctgttcagccgcgatttccacaaggagaacggcgacgtcccgaagggcaagatcttcgtcaagctggcgacgcagaagcagaagtccatgaaggtcatcctggaccggctcatgaaccagacctacagcaagggcgcgtgcatgatccacaagtacaagaacaagtggtatctgtccatcacctacaagttcaacgccctcaaggagaacaagttcgacaaggagctgattatgggcatcgacatgggcggcatcaacaccgtgtacttcgcgttcaacaaggggttcatccgcagcaacatcaagagcgacgagatcaagacgttcaacgagcgcatccggcagcggcgcatcaacctgctcaaccagagcaaatactgttcgaactcccgcaccgggaagggccggacgaagcggctccagcccatcgacgtgctcagcaacaagatcgccaagttccgcaacagcaccaaccacaagtacgcgaactacatcatcaagcagtgcctcaagcacaactgcgggcgcatccagatggagctgctcaaggggatctccaagaacgacaaggtgctcaaggactggacgtacttcgacctccaggagaagattaagaaccaggccgagatccacggcatcgaggtcatcaagatcgcgcccgcctacacctcccagcgctgctcgcagtgcggctacatctgcaaggagaaccggtgcacccaggatatgttcgagtgcaagcagtgcgggtacaagacgcacgcggactacaacgcggccaagaacatcagcacgtacgggatcgagaacatcatcaacaagcagctcgccgtgcagagcaagctccactccaagaagtgcatggaggagtacatcgagaagctcggctacctggactag

SEQ ID NO: 2151 - DNA, 1335 bp, Unknown
  Bacillus sp. multi
atgaagtaccagatcctctgccccatgaacgtggactggaccatcttcgagaagcacctccggaacctcacctaccaagtgcggacgatctccaaccggaccatccagcagctctgggagttcgacgccctgtccttcgactacttcaaggagcgcggcacctaccccacggtccaggatctgtacggctgcacgcaaaagaagattgacggctacatctaccacaccctccagtcgaagtaccccgacatccacaagggcaacatgagcacgacgctccagaaaatcatcaagacctggaagtcccgccgcaacgagatccggaagggcgagatgtccatccccagcttccggaaccgcatccccatcgacctccacaacaactccgtggacatcacgaaggagaagaacggcgactacatcgccgggatcagcctgttcagccgcgacttccacaaggagaacggcgacgtcccgaagggcaaaatcttcgtgaagctggccacccagaagcagaagtccatgaaggtgatcctcgaccgcctcatgaaccagacctactcgaagggcgcgtgcatgatccacaagtacaagaacaagtggtacttgagcatcacctacaagttcaacgcgctcaaggagaacaagttcgacaaggagcttatcatgggcatcgacatgggcgggatcaacaccgtgtacttcgccttcaacaagggcttcatccgcagcaacatcaagagcgacgagatcaagaccttcaacgagcgcatccgccagcgccgcatcaacctcctgaaccagtccaaatactgctccaactcccgcaccgggaagggccgcaccaagcgcctccagcccatcgacgtgctgagcaacaagatcgccaagttccgcaacagcacgaaccacaagtacgcgaactacatcatcaagcagtgcctcaagcacaactgcgggcgcatccagatggagctgctcaaggggatctccaagaacgacaaggtgctcaaggactggacgtacttcgacctccaggagaagattaagaaccaggcggagatccacgggatcgaggtcatcaagatcgcgcccgcctacacctcgcagcggtgcagccagtgcgggtacatctgcaaggagaaccgctgcacccaggacatgttcgagtgcaagcagtgcgggtacaagacccacgccgactacaacgcggccaagaacatctcgacctacggcatcgagaacatcatcaacaagcagctcgcggtccagtcgaagctgcactccaagaagtgcatggaggagtacatcgagaagctgggctacctcgactag

SEQ ID NO: 2152 - DNA, 1335 bp, Unknown
  Bacillus sp. multi
atgaagtaccagatcctctgccccatgaacgtggactggaccatcttcgagaagcacctccgcaacctcacgtaccaagtccggacgatcagcaaccggacgatccagcagctctgggagttcgacgccctgagcttcgactacttcaaggagcgcgggacgtaccccacggtccaagacctgtacgggtgcacgcagaagaagattgacgggtacatctaccacaccctccagagcaagtacccggacatccacaagggcaacatgagcaccacgctccagaaaatcatcaagacctggaagtcgcgccgcaacgagatccggaagggcgagatgtccatccccagcttccggaaccgcatccccatcgacctgcacaacaactcggtggacatcacgaaggagaagaacggcgactacatcgccgggatcagcctgttcagccgggacttccacaaggagaacggcgacgtgccgaagggcaagatcttcgtcaagctcgccacccagaagcagaagtccatgaaggtcatcctcgaccgcctcatgaaccagacctacagcaagggcgcgtgcatgatccacaagtacaagaacaagtggtacctctcgataacctacaagttcaacgcgctcaaggagaacaagttcgacaaggagcttatcatgggcatcgacatgggcggcatcaacacggtgtacttcgcgttcaacaagggcttcatccgcagcaacatcaagtccgacgagatcaagacgttcaacgagcgcatccgccagcggcggatcaacctcctgaaccagagcaagtattgctccaactcgcgcacgggcaagggccgcaccaagcgcctccagcccatcgacgtcctctcgaacaagatcgccaagttccgcaactccacgaaccacaagtacgccaactacatcatcaagcagtgcctcaagcacaactgcgggcgcatccagatggagctgctcaagggcatctccaagaacgacaaggtgctcaaggactggacctacttcgacctccaggagaagatcaagaaccaggcggagatccacggcatcgaggtcatcaagatcgccccggcctacaccagccagcgctgctcccagtgcgggtacatctgcaaggagaaccgctgcacccaggatatgtttgagtgcaagcagtgcggctacaagacgcacgccgactacaacgcggccaagaacatctcgacctacgggatcgagaacatcatcaacaagcagctcgcggtgcagtccaagctccacagcaagaaatgcatggaggagtacatcgagaagctcggctacctcgactga

SEQ ID NO: 2153 - DNA, 1335 bp, Unknown
  Bacillus sp. multi
atgaagtaccagatcctctgcccgatgaacgtggactggaccatcttcgagaagcacctccggaacctcacctaccaagtgcggacgatcagcaaccgcaccatccagcagctctgggagttcgacgccctgtccttcgactacttcaaggagcgcgggacgtacccgaccgtccaggacttgtacggctgcacgcagaagaaaatcgacggctacatctaccacaccctccagtcgaagtaccccgacatccacaagggcaacatgagcaccaccctccagaaaatcatcaagacctggaagtcccgccgcaacgagatccggaagggcgagatgtccatcccgtcgttccgcaaccgcatccccatcgacctgcacaacaactcggtggacatcacgaaggagaagaatggggactacatcgcgggcatcagcctgttcagccgcgacttccacaaggagaacggcgacgtcccgaagggcaagattttcgtgaagctggcgacccagaagcagaagtccatgaaggtcatcctcgaccgcctcatgaaccagacgtactcgaagggcgcgtgcatgatccacaagtacaagaacaagtggtacttgtccatcacctacaagttcaacgccctcaaggagaacaagttcgacaaggaacttatcatggggatcgacatgggcgggatcaacaccgtgtacttcgcgttcaacaaggggttcatccggagcaacatcaagagcgacgagatcaagaccttcaacgagcgcatccgccagcgccgcatcaacctgctcaaccagagcaagtactgctccaactcgcgcaccggcaaggggcggacgaagcgcctccagcccatcgacgtgctgtcgaacaagatcgccaagttccgcaacagcacgaaccacaagtacgccaactacatcatcaagcagtgcctcaagcacaactgcgggcgcatccagatggagctgctcaagggcatcagcaagaacgacaaggtgctcaaggactggacgtacttcgacctccaggagaagatcaagaaccaggcggagatccacggcatcgaggtcatcaagatcgccccggcctacacgagccagcggtgctcccagtgcgggtacatctgcaaggagaaccgctgcacccaggatatgttcgagtgcaagcagtgcggctacaagacccacgcggactacaacgccgccaagaacatctccacgtacggcatcgagaacatcatcaacaagcagctcgccgtgcagagcaagctgcactccaagaagtgcatggaggagtacatcgagaagctcggctacctggactga

SEQ ID NO: 2154 - DNA, 1335 bp, Unknown
  Bacillus sp. multi
atgaagtaccagatcctctgcccgatgaacgtggactggaccatcttcgagaagcacctccgcaacctcacctaccaggtgcggacgatctccaaccgcaccatccagcagctctgggagttcgacgccctgtcgttcgactacttcaaggagcgcggcacctacccgacggtccaggacctgtacggctgcacccagaagaaaatcgacggctacatctaccacaccctccagagcaagtaccccgacatccacaaggggaacatgagcaccaccctccagaaaatcatcaagacctggaagtcccgccggaacgagatccggaagggcgagatgtccatcccgagcttccgcaaccgcatccccatcgacctccacaacaactccgtggacatcacgaaggagaagaacggcgactacatcgcgggcatcagcctgttcagccgcgacttccacaaggagaacggcgacgtgccgaagggcaaaatcttcgttaagctggccacccagaagcagaagtccatgaaggtcatcctcgaccggctgatgaaccagacctactcgaagggcgcgtgcatgatccacaagtacaagaacaagtggtacttgtccatcacctacaagttcaacgcgctcaaggagaacaagttcgacaaggaactgataatgggcatcgacatgggcgggatcaacaccgtgtacttcgcgttcaacaagggcttcatccggtcgaacatcaagagcgacgagatcaagacgttcaacgagcgcatccggcagcgccgcatcaacctgctcaaccagagcaagtattgctccaactcccgcaccggcaagggccggaccaagcggctccagcccatcgacgtgctctccaacaagatcgccaagttccgcaactcgacgaaccacaagtacgccaactacatcatcaagcagtgcctcaagcacaactgcgggcgcatccagatggagctgctcaagggcatcagcaagaacgacaaggtgctcaaggactggacctacttcgacctccaggagaagatcaagaaccaggcggagatccacggcatcgaggtcatcaagatcgcgcccgcctacacctcccagcggtgctcgcagtgcggctacatctgcaaggagaaccggtgcacccaggatatgttcgaatgcaagcagtgcggctacaagacgcacgccgactacaacgccgccaagaacatcagcacctacgggatcgagaacatcatcaacaagcagctcgccgtgcagtccaagctccacagcaagaagtgcatggaggagtacatcgagaagctgggctacctggactag

SEQ ID NO: 2155 - DNA, 1356 bp, Unknown
  Bacillus sp. multi
ctcggcgtgaccatcaagatcatgaagtaccagatcctctgccccatgaacgtggactggaccatcttcgagaagcacctccgcaacctcacctaccaagttcggacgatctcgaaccgcacgatccagcagctctgggagttcgacgccctgtccttcgactacttcaaggagcgcggcacgtaccccaccgtccaagacctctacggctgcacccagaagaaaattgacggctacatctaccacacgctccagagcaagtacccggacatccacaagggcaacatgagcaccaccctccagaaaatcatcaagacctggaagtcccgccgcaacgagatccgcaagggcaagatgagcatcccgagcttccgcaaccgcatccccatcgacctgcacaacaacagcgtggacatcacgaaggagaagaacggcgactacatcgccgggatctccctgttctcccgcgacttccacaaggagaacgacgacgtgccgaagggcaagattttcgtcaagctggccacccagaagcagaagtcgatgaaggtcatcctcgaccggctcatcaaccagacgtacagcaagggcgcgtgcatgatccacaagtacaagaacaagtggtatctcagcatcacctacaagttcaacgcgatcaaggagaacaagttcgacaaggagctgattatgggcatcgacctgggcggcatcaacaccgtgtacttcgcgttcaacgagggcttcatccgctccaacatcaagagcgacgagatcaagatgttcaacgagcgcatccgccagcggcggatcaacctgctcaagcagagcaagtattgctccaacggccgcacgggcaagggccgcaccaagcgcctccagcccatcgacgtgctgtcgaacaagatcgccaagttccgcaacagcacgaaccacaagtacgcgaactacatcgtcaagcagtgcctcaagcacaactgcgggcgcatccagatggagctgctcaagggcatctccaagaacgaccgcatcctcaaggactggacctacttcgacctccaggaaaagattaagaatcaggccgagatccacggcatcgaggtcatcaaggtcgcgcccgcctacaccagccagcggtgctcccagtgcggctacatctgcaaggagaaccggtgcacccaggcgaccttcgagtgcaagcagtgcgggtacaagacgcacgcggactacaacgcggccaagaacatcagcacgtacgacatcgagaacatcatcaacaagcagctcgcggtgcagagcaagctccactccaagaaatgcatggaggagtacatcgaggagctgggctacctggactga

SEQ ID NO: 2156 - DNA, 1356 bp, Unknown
  Bacillus sp. multi
ctcggcgtgaccatcaagatcatgaagtaccagatcctctgcccgatgaacgtggactggaccatcttcgagaagcacctccgcaacctgacctaccaagtgcggacgatctccaaccgcaccatccagcagctctgggagttcgacgcgctgtccttcgactacttcaaggagcgcggcacctacccgaccgtccaagacctctacgggtgcacgcagaagaaaattgacggctacatctaccacacgctccagtcgaagtaccccgacatccacaagggcaacatgagcacgacgctccagaaaatcatcaagacctggaagtcccgccggaacgagatccgcaagggcaagatgagcatccccagcttccggaaccgcatccccatcgacctccacaacaactccgtggacatcacgaaggagaagaatggcgactacatcgccgggatctccctgttctcgcgcgacttccacaaggagaacgacgacgtgccgaagggcaaaatcttcgtcaagctggcgacgcagaagcagaagtccatgaaggtgatcctcgaccggctcatcaaccagacctacagcaagggcgcgtgcatgatccacaagtacaagaacaagtggtatctgagcatcacctacaagttcaacgccatcaaggagaacaagttcgacaaggagctaatcatggggatcgacctcggcggcatcaacacggtgtacttcgccttcaacgagggcttcatccgcagcaacatcaagtccgacgagatcaagatgttcaacgagcgcatccgccagcggcgcatcaacctgctcaagcagagcaagtattgctccaacggccgcaccggcaagggccggacgaagcgcctccagcccatcgacgtgctctccaacaagatcgccaagttccgcaactccaccaaccacaagtacgccaactacatcgtgaagcagtgcctcaagcacaactgcgggcgcatccagatggagctgctcaagggcatcagcaagaacgaccgcatcctcaaggactggacctacttcgacctccaggaaaagattaagaatcaggcggagatccacgggatcgaggtcatcaaggtcgccccggcctacacgagccagcggtgcagccagtgcggctacatctgcaaggagaaccgctgcacccaggcgacgttcgagtgcaagcagtgcggctacaagacccacgcggactacaacgccgccaagaacatcagcacctacgacatcgagaacatcatcaacaagcagctcgcggtccagagcaagctgcactccaagaaatgcatggaggagtacatcgaggagctgggctacctcgactag

SEQ ID NO: 2157 - DNA, 1356 bp, Unknown
  Bacillus sp. multi
ctcggcgtgaccatcaagatcatgaagtaccagatcctctgcccgatgaacgtggactggacgatcttcgagaagcacctccgcaacctgacctaccaagtacggacgatctcgaaccggaccatccagcagctctgggagttcgacgcgctctcgttcgactacttcaaggagcggggcacgtacccgaccgtccaggacttgtacggctgcacccagaagaaaatcgacggctacatctaccacaccctccagagcaagtaccccgacatccacaagggcaacatgagcacgaccctccagaaaatcatcaagacctggaagtcccgccgcaacgagatccgcaagggcaagatgtccatcccgagcttccgcaaccgcatccccatcgacctccacaacaactccgtggacatcacgaaggagaagaacggcgactacatcgcggggatcagcctgttctcccgcgacttccacaaggagaacgacgacgtgccgaagggcaaaatcttcgtcaagctggccacccagaagcagaagtccatgaaggtgatcctggaccggctcatcaaccagacctactcgaagggcgcgtgcatgatccacaagtacaagaacaagtggtatctttctatcacctacaagttcaacgccatcaaggagaacaagttcgacaaggagctcatcatgggcatcgacctgggcggcatcaacacggtgtacttcgcgttcaacgaggggttcatccggagcaacatcaagtccgacgagatcaagatgttcaacgagcgcatccgccagcgccgcatcaacctgctcaagcagagcaaatactgttccaacggccgcacgggcaaggggcgcacgaagcgcctccagcccatcgacgtgctctcgaacaagatcgccaagttccgcaactccacgaaccacaagtacgcgaactacatcgtcaagcagtgcctcaagcacaactgcgggcgcatccagatggagctgctcaaggggatcagcaagaacgaccgcatcctcaaggactggacctacttcgacctccaggagaagattaagaatcaggccgagatccacggcatcgaggtcatcaaggtcgcgcccgcctacaccagccagcggtgctcccagtgcggctacatctgcaaggagaaccggtgcacccaggcgacgttcgagtgcaagcagtgcggctacaagacgcacgcggactacaacgccgccaagaacatctcgacctacgacatcgagaacatcatcaacaagcagctcgcggtgcagagcaagctccacagcaagaagtgtatggaggagtacatcgaggagctgggctacctggactag

SEQ ID NO: 2158 - DNA, 1356 bp, Unknown
  Bacillus sp. multi
ctcggcgtgacgatcaagatcatgaagtaccagatcctctgccccatgaacgtggactggacgatcttcgagaagcacctccgcaacctgacgtaccaagttcggacgatctcgaaccgcaccatccagcagctctgggagttcgacgcgctgagcttcgactacttcaaggagcggggcacgtaccccaccgtccaagatctctacggctgcacccagaagaagatcgacggctacatctaccacaccctccagagcaagtaccccgacatccacaaggggaacatgagcaccaccctccagaaaatcattaagacctggaagtcccgccgcaacgagatccggaagggcaagatgagcatcccgagcttccgcaaccgcatccccatcgacctgcacaacaactcggtggacatcacgaaggagaagaatggcgactacatcgcggggatcagcctcttcagccgcgacttccacaaggagaacgacgacgtgccgaagggcaaaatcttcgtgaagctcgccacccagaagcagaagtccatgaaggtgatcctcgaccggctcatcaaccagacctacagcaagggcgcgtgcatgatccacaagtacaagaacaagtggtacttgtcgatcacctacaagttcaacgcgatcaaggagaacaagttcgacaaggagcttatcatgggcatcgacctcggcggcatcaacaccgtgtacttcgccttcaacgagggcttcatccgcagcaacatcaagtcggacgagatcaagatgttcaacgagcgcatccgccagcgccgcatcaacctcctcaagcagtccaagtattgttccaacgggcgcacggggaaggggcgcacgaagcggctccagcccatcgacgtgctgtccaacaagatcgccaagttccgcaacagcacgaaccacaagtacgccaactacatcgtgaagcagtgcctcaagcacaactgcgggcgcatccagatggagctgctcaagggcatctccaagaacgaccgcatcctcaaggactggacctacttcgacctccaggagaagataaagaatcaggccgagatccacggcatcgaggtcatcaaggtcgccccggcctacaccagccagcggtgctcccagtgcggctacatctgcaaggagaaccgctgcacccaggccaccttcgagtgcaagcagtgcgggtacaagacccacgccgactacaacgccgccaagaacatctcgacgtacgacatcgagaacatcatcaacaagcagctcgcggtccagagcaagctgcactccaagaagtgcatggaggagtacatcgaggagctgggctacctggactag

SEQ ID NO: 2159 - DNA, 1356 bp, Unknown
  Bacillus sp. multi
ctcggcgtcaccatcaagatcatgaagtaccagatcctctgccccatgaacgtggactggaccatcttcgagaagcacctccggaacctcacgtaccaagtccggacgatctcgaaccgcaccatccagcagctctgggagttcgacgcgctcagcttcgactacttcaaggagcggggcacctacccgacggtccaggatctctacggctgcacccagaagaaaatcgacgggtacatctaccacaccctccagtcgaagtaccccgacatccacaagggcaacatgagcaccaccctccagaagattatcaagacctggaagtcccgccgcaacgagatccggaagggcaagatgtccatcccgagcttccgcaaccgcatccccatcgacctccacaacaacagcgtggacatcacgaaggagaagaatggcgactacatcgcgggcatcagcctcttcagccgcgacttccacaaggagaacgacgacgtgccgaagggcaagatattcgtaaagctggcgacccagaagcagaagtcgatgaaggtcatcctcgaccgcctcatcaaccagacgtacagcaagggcgcgtgcatgatccacaagtacaagaacaagtggtatctatccatcacctacaagttcaacgcgatcaaggagaacaagttcgacaaggagctgattatggggatcgacctcggcgggatcaacaccgtgtacttcgccttcaacgagggcttcatccggtccaacatcaagagcgacgagatcaagatgttcaacgagcgcatccgccagcggcgcatcaacctcctcaagcagagcaagtattgctcgaacggccgcacgggcaaggggcgcaccaagcgcctccagcccatcgacgtgctcagcaacaagatcgccaagttccgcaactccaccaaccacaagtacgccaactacatcgtcaagcagtgcctcaagcacaactgcgggcgcatccagatggagctgctcaagggcatcagcaagaacgaccgcatcctcaaggactggacctacttcgacctccaggaaaagatcaagaatcaggcggagatccacggcatcgaggtcatcaaggtcgccccggcctacaccagccagcggtgctcccagtgcggctacatctgcaaggagaaccgctgcacccaggccacgttcgagtgcaagcagtgcggctacaagacccacgccgactacaacgccgccaagaacatcagcacctacgacatcgagaacatcatcaacaagcagctcgcggtgcagtcgaagctccactccaagaagtgtatggaggagtacatcgaggagctgggctacctcgactga

SEQ ID NO: 2160 - DNA, 1335 bp, Unknown
  Bacillus sp. multi
atgaagtaccagatcctctgccccatgaacgtggactggaccatcttcgagaagcacctccggaacctcacctaccaagtgcggacgatctccaaccgcacgatccagcagctctgggagttcgacgccctctccttcgaatacttcaaggagcggggcacgtacccgaccgtccaggacttgtacggctgcacgcagaagaagatcgacggctacatctaccacaccctccagagcaagtaccccgacatccacaagggcaacatgagcaccaccctccagaaaatcattaagacctggaagtcccgccggaacgagatccgcaagggcgagatgagcatcccctccttccgcaaccgcatccccatcgacctccacaacaacagcgtggacatcatcaaggagaagaacggggactacatcgcggggatctccctcttcagccgcgacttccacaaggagaacggggacgtgccgaagggcaagatattcgtcaagctggccacgcagaagcagaagtccatgaaggtgatcctcgaccgcctcatcaaccagacctacagcaagggcgcgtgcatgatccacaagtacaagaacaagtggtacttgagcatcacctacaagttcaacgccatcaaggagaacaagttcgacaaggaattgattatgggcatcgacatgggcgggatcaacaccgtgtacttcgcgttcaacgagggcttcatccggagcaacatcaagtccgacgagatcaagatgttcaacgagcgcatccgccagcgccgcatcaacctcctcaagcagagcaagtactgctcgaactcgcgcaccgggaaggggcgcacgaagcgcctccagcccatcgacgtgctgagcaacaagatcgccaagttccgcaacagcaccaaccacaagtacgccaactacatcgtgaagcagtgcctcaagcacaactgcgggcgcatccagatggagctgctcaagggcatctccaagaacgacaagatcctcaaggactggacctacttcgacctccaggagaagatcaagaaccaggccgagatccacggcatcgaggtcatcaaggtggtcccggcctacacctcccagcgctgctcccagtgcggctacatctgcaaggagaaccgctgcacccaggccaccttcgagtgcaagcagtgcgggtacaagacccacgccgactacaacgccgccaagaacctcagcacgtacgacatcgagaacatcatcaacaagcagctcgccgtccagtcgaagctccacagcaagaaatgcatggaggagtacatcgaggagctgggctacctggactag

SEQ ID NO: 2161 - DNA, 1335 bp, Unknown
  Bacillus sp. multi
atgaagtaccagatcctctgccccatgaacgtggactggacgatcttcgagaagcacctccgcaacctcacgtaccaagtccggacgatctccaaccgcaccatccagcagctctgggagttcgacgccctgagcttcgagtatttcaaggagcgcggcacctaccccaccgtccaggacctctacgggtgcacgcagaagaaaatcgacgggtacatctaccacaccctccagagcaagtacccggacatccacaagggcaacatgagcaccaccctccagaaaatcatcaagacctggaagtcccgccgcaacgagatccggaagggcgagatgagcatcccgagcttccgcaaccgcatccccatcgacctccacaacaacagcgtggacatcatcaaggagaagaatggcgactacatcgcgggcatctcgctgttctcgcgcgacttccacaaggagaacggcgacgtgccgaagggcaaaatcttcgtgaagctggccacccagaagcagaagtccatgaaggtcatcctggaccgcctcatcaaccagacgtactcgaagggcgcgtgcatgatccacaagtacaagaacaagtggtatctaagcatcacctacaagttcaacgcgatcaaggagaacaagttcgacaaggagcttatcatgggcatcgacatgggcggcatcaacacggtgtacttcgcgttcaacgagggcttcatccgcagcaacatcaagagcgacgagatcaagatgttcaacgagcgcatccggcagcgccggatcaacctcctcaagcagtccaagtattgttccaactcccgcacgggcaaggggcgcaccaagcgcctccagcccatcgacgtcctgtccaacaagatcgccaagttccgcaacagcacgaaccacaagtacgcgaactacatcgtgaagcagtgcctcaagcacaactgcgggcgcatccagatggagctgctcaagggcatctccaagaacgacaagatcctcaaggactggacgtacttcgacctccaggagaagatcaagaaccaggcggagatccacggcatcgaggtcatcaaggtggtgcccgcctacaccagccagcggtgcagccagtgcgggtacatctgcaaggagaaccgctgcacccaggcgacgttcgagtgcaagcagtgcggctacaagacgcacgcggactacaacgccgccaagaacctgagcacgtacgacatcgagaacatcatcaacaagcagctcgccgtccagagcaagctgcactccaagaagtgcatggaggagtacatcgaggagctgggctacctcgactga

SEQ ID NO: 2162 - DNA, 1335 bp, Unknown
  Bacillus sp. multi
atgaagtaccagatcctctgcccgatgaacgtggactggaccatcttcgagaagcacctccgcaacctcacgtaccaagtgcggacgatctcgaaccggacgatccagcagctctgggagttcgacgcgctgagcttcgaatacttcaaggagcgcggcacgtaccccaccgtccaggatctttacggctgcacgcagaagaaaatcgacggctacatctaccacacgctccagagcaagtaccccgacatccacaagggcaacatgagcaccacgctccagaagatcatcaagacctggaagtcccgccggaacgagatccggaagggcgagatgtcgatcccctccttccgcaaccgcatccccatcgacctgcacaacaacagcgtggacatcatcaaggagaagaatggcgactacatcgcggggatctccctgttcagccgcgacttccacaaggagaacggcgacgtgccgaagggcaagatattcgtcaagctggcgacccagaagcagaagtcgatgaaggtgatcctcgaccgcctcatcaaccagacgtactcgaagggcgcgtgcatgatccacaagtacaagaacaagtggtacctcagcatcacctacaagttcaacgccatcaaggagaacaagttcgacaaggagttaatcatggggatcgacatgggcgggatcaacaccgtgtacttcgcgttcaacgagggcttcatccggtcgaacatcaagtcggacgagatcaagatgttcaacgagcgcatccgccagcgccggatcaacctcctcaagcagagcaagtactgttccaactcccgcacggggaagggccggaccaagcggctccagcccatcgacgtgctgtccaacaagatcgccaagttccgcaacagcacgaaccacaagtacgcgaactacatcgtgaagcagtgcctcaagcacaactgcgggcgcatccagatggagctgctcaagggcatctccaagaacgacaagatcctcaaggactggacctacttcgacctccaggagaagatcaagaaccaggcggagatccacggcatcgaggtcatcaaggtcgtgcccgcctacacgagccagcggtgcagccagtgcggctacatctgcaaggagaaccgctgcacccaggcgaccttcgagtgcaagcagtgcggctacaagacgcacgccgactacaacgccgccaagaacctctccacctacgacatcgagaacatcatcaacaagcagctcgcggtccagagcaagctccacagcaagaagtgtatggaggagtacatcgaggagctgggctacctggactga

SEQ ID NO: 2163 - DNA, 1335 bp, Unknown
  Bacillus sp. multi
atgaagtaccagatcctctgccccatgaacgtggactggacgatcttcgagaagcacctccggaacctcacctaccaagtccggacgatctccaaccgcacgatccagcagctctgggagttcgacgccctcagcttcgagtactttaaggagcgcggcacgtaccccaccgtccaagacctttatggctgcacgcagaagaagattgacgggtacatctaccacaccctccagagcaagtaccccgacatccacaagggcaacatgagcacgaccctccagaagatcatcaagacctggaagtcgcggcgcaacgagatccggaagggcgagatgagcatccccagcttccggaaccgcatccccatcgacctccacaacaacagcgtggacatcatcaaggagaagaacggggactacatcgcggggatcagcctgttctcgcgggacttccacaaggagaacggcgacgtgccgaagggcaagatcttcgtgaagctcgccacccagaagcagaagtcgatgaaggtcatcctggaccgcctcatcaaccagacgtactcgaagggcgcgtgcatgatccacaagtacaagaacaagtggtatctctccatcacctacaagttcaacgccatcaaggagaacaagttcgacaaggagctgattatggggatcgacatgggcggcatcaacacggtgtacttcgccttcaacgagggcttcatccggagcaacatcaagagcgacgagatcaagatgttcaacgagcgcatccgccagcggcggatcaacctgctcaagcagagcaagtattgctccaacagccgcaccgggaagggccgcacgaagcggctccagcccatcgacgtgctgtccaacaagatcgccaagttccgcaacagcacgaaccacaagtacgccaactacatcgtcaagcagtgcctcaagcacaactgcgggcgcatccagatggagctgctcaagggcatcagcaagaacgacaagatcctcaaggactggacctacttcgacctccaggagaaaatcaagaatcaggcggagatccacgggatcgaggtcatcaaggtggtccccgcctacaccagccagcggtgctcccagtgcggctacatctgcaaggagaaccggtgcacccaggcgaccttcgagtgcaagcagtgcggctacaagacgcacgccgactacaacgccgccaagaacctgagcacgtacgacatcgagaacatcatcaacaagcagctcgcggtgcagtccaagctgcactccaagaagtgcatggaggagtacatcgaggagctgggctacctcgactag

SEQ ID NO: 2164 - DNA, 1335 bp, Unknown
  Bacillus sp. multi
atgaagtaccagatcctctgccccatgaacgtggactggaccatcttcgagaagcacctccgcaacctcacctaccaagtgcggacgatctccaaccgcaccatccagcagctctgggagttcgacgcgctgtcgttcgaatacttcaaggagcgcggcacgtaccccaccgtccaggatctgtacgggtgcacgcagaagaagatcgacgggtacatctaccacacgctccagtcgaagtaccccgacatccacaaggggaacatgagcacgacgctccagaagataattaagacctggaagtcccgccgcaacgagatccgcaagggcgagatgagcatcccctccttccgcaaccgcatccccatcgacctccacaacaacagcgtggacatcatcaaggagaagaatggcgactacatcgccgggatctccctgttcagccgcgacttccacaaggagaacggcgacgtcccgaagggcaagatattcgtgaagctggccacgcagaagcagaagtccatgaaggtgatcctcgaccggctcatcaaccagacgtacagcaagggcgcgtgcatgatccacaagtacaagaacaagtggtatctatccatcacctacaagttcaacgcgatcaaggagaacaagttcgacaaggagcttatcatgggcatcgacatgggcggcatcaacaccgtgtacttcgccttcaacgagggcttcatccggtccaacatcaagtccgacgagatcaagatgttcaacgagcgcatccgccagcggcggatcaacctcctcaagcagtccaagtattgctccaacagccggacggggaagggccggaccaagcggctccagcccatcgacgtgctgtccaacaagatcgccaagttccgcaacagcaccaaccacaagtacgccaactacatcgtcaagcagtgcctcaagcacaactgcgggcgcatccagatggagctgctcaaggggatcagcaagaacgacaagatcctcaaggactggacctacttcgacctccaggagaagatcaagaaccaggccgagatccacgggatcgaggtcatcaaggtggtcccggcctacacgagccagcgctgctcccagtgcgggtacatctgcaaggagaaccgctgcacccaggccacgttcgagtgcaagcagtgcgggtacaagacccacgcggactacaacgcggccaagaacctgagcacgtacgacatcgagaacatcatcaacaagcagctcgccgtgcagagcaagctgcactccaagaagtgcatggaggagtacatcgaggagctgggctacctggactag

SEQ ID NO: 2165 - DNA, 1356 bp, Unknown
  Bacillus sp. multi
ctcggggtcaccatcaagatcatgaagtaccagatcctctgcccgatgaacgtggactgggcgatcttcgagaagcacctccgctccctcacgtaccaagttcggacgatctcgaaccggaccatccagcagctctgggagttcgacgccctctcgttcgactacttcaaggagaccgggacgagcccgacggtccaagacctttacgggtgcacgcagaagaaaatcgacgggtacatctaccacaccctccagtccaagtacccggacatccacaaggggaacatgagcaccacgctccaaaagatcatcaagacctggaagtcccgccgcaacgagatccgcaagggcgagatgagcatccccagcttccgcaaccgcatccccatcgacctgcacaacaactccgtggacatcacgaaggagaagaacggcgactacatcgcgggcatcagcctgttcagccgcgacttccacaaggagaactccgacgtcccgaagggcaagatcttcgtcaagctcgccacccagaagcagaagtccatgaaggtgatcctggaccgcctcatcaaccagacctacagcaagggcgcgtgcatgatccacaagtacaagaacaagtggtacctgtccatcacgtacaagttcaacgccatcaaggagaacaagttcgacaaggagcttatcatggggatcgacatgggcgggatcaacaccgtgtacttcgccttcaacgagggcttcatccggtccaacatcaagagcgacgagatcaagaccttcaacgagcgcatccggcagcgccgcatcaacctgctcaagcagagcaaatactgttcgaactcccggatcggcaagggccgcaccaagcgcctccagcccatcgacgtgctctccaacaagatcgccaagttccgcaactcgaccaaccacaagtacgccaactacatcatcaagcagtgcctcaagcacaactgcgggcgcatccagatggagctgctcaagggcatcctcaagaacgacaaggtgctcaagaactggacctacttcgacctccaggagaagatcaagaaccaggcgaagatccacgggatcgaggtcatcaagatcgcgcccgcctacaccagccagcgctgctcccagtgcggctacatctgcaaggagaaccgctgcacccaggcgatgttcgagtgcaagcagtgcgggtacaagacccacgccgactacaacgccgccaagaacatctcgacctacgacatcgagaacatcatcaacaagcagctcgccgtgcagtccaagctgcacagcaagaagtgcatggaggagtacatcgaggagctgggctacctggactag

SEQ ID NO: 2166 - DNA, 1356 bp, Unknown
  Bacillus sp. multi
ctcggcgtgacgatcaagatcatgaagtaccagatcctctgccccatgaacgtggactgggccatcttcgagaagcacctccgctcgctcacctaccaagtccggacgatctccaaccgcacgatccagcagctctgggagttcgacgcgctgtccttcgactacttcaaggagacgggcacctccccgacggtccaagacttgtacggctgcacgcagaagaagatcgacggctacatctaccacaccctccagtcgaagtaccccgacatccacaagggcaacatgagcacgacgctccagaagatcatcaagacctggaagtcgcgccgcaacgagatccgcaagggcgagatgtccatcccgtccttccggaaccgcatccccatcgacctgcacaacaacagcgtggacatcacgaaggagaagaacggggactacatcgcgggcatctccctgttcagccgggacttccacaaggagaactcggacgtgccgaagggcaagatattcgtgaagctggccacgcagaagcagaagtccatgaaggtcatcctcgaccgcctcatcaaccagacgtacagcaagggcgcgtgcatgatccacaagtacaagaacaagtggtacttgagcatcacctacaagttcaacgccatcaaggagaacaagttcgacaaggagctcattatgggcatcgacatgggcgggatcaacaccgtgtacttcgccttcaacgaggggttcatccggagcaacatcaagtcggacgagatcaagacgttcaacgagcgcatccgccagcgccgcatcaacctgctcaagcagagcaaatactgttcgaactcccggatcggcaaggggcgcaccaagcgcctccagcccatcgacgtgctcagcaacaagatcgccaagttccgcaacagcacgaaccacaagtacgccaactacatcatcaagcagtgcctcaagcacaactgcgggcgcatccagatggagctgctcaagggcatcctcaagaacgacaaggtgctcaagaactggacgtacttcgacctccaggagaaaatcaagaaccaggccaagatccacgggatcgaggtcatcaagatcgccccggcctacaccagccagcggtgcagccagtgcggctacatctgcaaggagaaccggtgcacccaggccatgttcgagtgcaagcagtgcgggtacaagacccacgcggactacaacgcggccaagaacatcagcacctacgacatcgagaacatcatcaacaagcagctcgccgtccagagcaagctccacagcaagaagtgcatggaggagtacatcgaggagctgggctacctggactga

SEQ ID NO: 2167 - DNA, 1356 bp, Unknown
  Bacillus sp. multi
ctgggcgtgaccatcaagatcatgaagtaccagatcctctgccccatgaacgtggactgggcgatcttcgagaagcacctccgctccctcacgtaccaagtgcggacgatcagcaaccgcacgatccagcagctctgggagttcgacgccctcagcttcgactacttcaaggagacggggaccagccccacggtccaagacctttacggctgcacgcagaagaagatcgacggctacatctaccacacgctccagagcaagtaccccgacatccacaagggcaacatgagcacgaccctccagaagatcatcaagacctggaagtcccgccggaacgagatccgcaagggcgagatgtccatcccgagcttccgcaaccgcatccccatcgacctccacaacaactcggtggacatcacgaaggagaagaacggcgactacatcgcggggatctccctgttcagccgcgacttccacaaggagaacagcgacgtgccgaagggcaagatattcgtcaagctcgccacgcagaagcagaagtccatgaaggtcatcctggaccgcctcatcaaccagacgtactcgaagggcgcgtgcatgatccacaagtacaagaacaagtggtacttgagcatcacctacaagttcaacgcgatcaaggagaacaagttcgacaaggagttaatcatgggcatcgacatgggcggcatcaacaccgtgtacttcgccttcaacgagggcttcatccgcagcaacatcaagtccgacgagatcaagaccttcaacgagcgcatccgccagcgccgcatcaacctcctcaagcagtccaagtactgctccaactcccggatcgggaagggccggacgaagcgcctccagcccatcgacgtcctctccaacaagatcgccaagttccgcaacagcacgaaccacaagtacgccaactacatcatcaagcagtgcctcaagcacaactgcgggcgcatccagatggagctgctcaagggcatcctcaagaacgacaaggtgctcaagaactggacctacttcgacctccaggagaagattaagaaccaggccaagatccacggcatcgaggtcatcaagatcgcgcccgcctacaccagccagcggtgctcgcagtgcgggtacatctgcaaggagaaccggtgcacccaggccatgttcgagtgcaagcagtgcggctacaagacgcacgcggactacaacgccgccaagaacatctccacctacgacatcgagaacatcatcaacaagcagctcgccgtccagtccaagctgcacagcaagaaatgcatggaggagtacatcgaggagctgggctacctcgactag

SEQ ID NO: 2168 - DNA, 1356 bp, Unknown
  Bacillus sp. multi
ctcggcgtgaccatcaagatcatgaagtaccagatcctctgccccatgaacgtggactgggccatcttcgagaagcacctccgctccctcacgtaccaagtgcggacgatctccaaccgcaccatccagcagctctgggagttcgacgcgctgtccttcgactacttcaaggagacgggcacctccccgaccgtccaggacttgtacggctgcacccagaagaagatcgacggctacatctaccacaccctccagtcgaagtacccggacatccacaaggggaacatgagcacgacgctccagaaaatcatcaagacctggaagtcccggcggaacgagatccggaagggcgagatgtcgatcccctccttccgcaaccgcatccccatcgacctgcacaacaacagcgtggacatcacgaaggagaagaatggggactacatcgcgggcatctccctgttctcccgcgacttccacaaggagaactccgacgtgccgaagggcaagatattcgtcaagctcgccacccagaagcagaagtcgatgaaggtgatcctcgaccgcctcatcaaccagacgtacagcaagggcgcgtgcatgatccacaagtacaagaacaagtggtacttgtcgatcacctacaagttcaacgccatcaaggagaacaagttcgacaaggaactgattatggggatcgacatgggcggcatcaacaccgtgtacttcgccttcaacgagggcttcatccggagcaacatcaagtccgacgagatcaagaccttcaacgagcgcatccgccagcgccggatcaacctcctcaagcagtccaaatactgctccaactcccgcatcgggaagggccgcaccaagcggctccagcccatcgacgtgctcagcaacaagatcgccaagttccgcaacagcacgaaccacaagtacgccaactacatcatcaagcagtgcctcaagcacaactgcgggcgcatccagatggagctgctcaagggcatcctcaagaacgacaaggtgctcaagaactggacgtacttcgacctccaggagaagatcaagaaccaggccaagatccacggcatcgaggtcatcaagatcgcgcccgcctacaccagccagcgctgctcgcagtgcgggtacatctgcaaggagaaccgctgcacccaggcgatgttcgagtgcaagcagtgcgggtacaagacccacgcggactacaacgccgccaagaacatcagcacgtacgacatcgagaacatcatcaacaagcagctcgccgtgcagagcaagctccacagcaagaagtgcatggaggagtacatcgaggagctgggctacctggactga

SEQ ID NO: 2169 - DNA, 1356 bp, Unknown
  Bacillus sp. multi
ctcggcgtcacgatcaagatcatgaagtaccagatcctctgcccgatgaacgtggactgggccatcttcgagaagcacctccggtccctgacgtaccaggtccggacgatctccaaccggacgatccagcagctctgggagttcgacgccctgagcttcgactacttcaaggagaccggcacctccccgacggtccaagacctctacggctgcacgcagaagaagattgacggctacatctaccacacgctccagtccaagtacccggacatccacaagggcaacatgagcacgaccctccagaaaatcatcaagacctggaagtcccgccggaacgagatccggaagggcgagatgagcatcccgtccttccgcaaccgcatccccatcgacctccacaacaactccgtggacatcacgaaggagaagaacggggactacatcgcgggcatctccctgttctcgcgcgacttccacaaggagaactccgacgtcccgaagggcaagattttcgtcaagctcgccacgcagaagcagaagtcgatgaaggtcatcctcgaccggctcatcaaccagacgtacagcaagggcgcgtgcatgatccacaagtacaagaacaagtggtacttgagcatcacctacaagttcaacgcgatcaaggagaacaagttcgacaaggaactcattatgggcatcgacatgggcgggatcaacacggtgtacttcgccttcaacgagggcttcatccgcagcaacatcaagagcgacgagatcaagaccttcaacgagcgcatccgccagcgccgcatcaacctcctcaagcagagcaaatactgctcgaactcgcggatcggcaaggggcgcaccaagcgcctccagcccatcgacgtgctgagcaacaagatcgccaagttccgcaacagcaccaaccacaagtacgccaactacatcatcaagcagtgcctcaagcacaactgcgggcgcatccagatggagctgctcaagggcatcctcaagaacgacaaggtgctcaagaactggacctacttcgacctccaggagaagatcaagaatcaggccaagatccacggcatcgaggtcatcaagatcgccccggcctacaccagccagcggtgctcgcagtgcgggtacatctgcaaggagaaccggtgcacccaggcgatgttcgagtgcaagcagtgcgggtacaagacgcacgcggactacaacgccgccaagaacatctcgacgtacgacatcgagaacatcatcaacaagcagctcgcggtgcagagcaagctccactccaagaagtgcatggaggagtacatcgaggagctgggctacctggactag

SEQ ID NO: 2170 - DNA, 1356 bp, Unknown
  Bacillus sp. multi
ctgggcgtcacgatcaagatcatgaagtaccagatcctctgcccgatgaacgtggactggaccatcttcgagaagcacctccgcaacctgacctaccaggtgcggacgatcagcaaccgcacgatccagcagctctgggagttcgacgccctgagcttcgactacttcaaggagcgcggcacctaccccaccgtccaggatctgtacgggtgcacgcagaagaagatcgacggctacatctaccacacgctccagagcaagtaccccgacatccacaaggggaacatgagcacgacgctccagaaaatcatcaagacctggaagtcgcgccggaacgagatccggaagggcgagatgtcgatcccgagcttccgcaaccgcatccccatcgacctccacaacaactcggtggacatcatcaaggagaagaacggcgactacatcgcggggatctcgctgttctcgctggacttccacaaggagaacggcgacgtcccgaagggcaaaatcttcgtcaagctggggacgcagaagcagaagtccatgaaggtcatcctggaccgcctcatcaaccagacgtactcgaagggcgcgtgcatgatccacaagtacaagaacaagtggtatctctccatcacgtacaagttcaacgcgatcaaggagaacaagttcgacaagaagctcatcatgggcatcgacatgggcgggatcaacacggtgtacttcgcgttcaacgagggcttcatccggagcaacatcaagtccgacgagatcaagatgttcaacgagcgcatccgccagcgccgcatcaacctgctcaagcagtccaagtactgctcgaactcccgcaccggcaagggccgcacgaagcgcctccagcccatcgacgtcctctccaacaagatcgccaagttccgcaactccacgaaccacaagtacgccaactacatcgtgaagcagtgcctcaagcacaactgcgggcgcatccagatggagctgctcaaggggatctccaagaacgacaaggtgctcaaggactggacctacttcgacctccaggaaaagattaagaaccaggcggagatatacggcatcgaggtcatcaaggtcgtccccgcctacaccagccagcgctgctcgcagtgcgggtacatctgcaaggagaaccgctgcacccaggccatgttcgagtgcaagcagtgcggctacaagacccacgccgactacaacgcggccaagaacatctccacgtacgacatcgagaacatcatcaacaagcagctcgcggtgcagtcgaagctccactccaagaagtgcatggaggagtacatcgaggagctgggctacctggactga

SEQ ID NO: 2171 - DNA, 1356 bp, Unknown
  Bacillus sp. multi
ctcggggtgacgatcaagatcatgaagtaccagatcctctgccccatgaacgtggactggaccatcttcgagaagcacctccggaacctgacctaccaagtccggacgatcagcaaccggacgatccagcagctctgggagttcgacgccctcagcttcgactacttcaaggagcgcggcacctacccgaccgtccaggatctctacggctgcacgcagaagaaaatcgacggctacatctaccacaccctccagtcgaagtacccggacatccacaagggcaacatgagcaccacgctccagaagatcatcaagacctggaagtcgcgccggaacgagatccgcaagggcgagatgagcatcccctccttccggaaccgcatccccatcgacctgcacaacaactccgtggacatcatcaaggagaagaacggggactacatcgcgggcatctcgctgttcagcctggacttccacaaggagaacggcgacgtgccgaagggcaaaatcttcgtcaagctgggcacgcagaagcagaagtccatgaaggtcatcctggaccggctcatcaaccagacctactcgaagggcgcgtgcatgatccacaagtacaagaacaagtggtacctttccatcacgtacaagttcaacgcgatcaaggagaacaagttcgacaagaagctcatcatgggcatcgacatgggcggcatcaacacggtgtacttcgccttcaacgaggggttcatccgctccaacatcaagtcggacgagatcaagatgttcaacgagcgcatccgccagcgccggatcaacctcctcaagcagtccaagtactgctccaacagccgcacgggcaaggggcgcacgaagcgcctccagcccatcgacgtcctctcgaacaagatcgccaagttccgcaacagcacgaaccacaagtacgccaactacatcgtgaagcagtgcctcaagcacaactgcgggcgcatccagatggagctgctcaaggggatctccaagaacgacaaggtgctcaaggactggacctacttcgacctccaggagaagatcaagaaccaggccgagatatatggcatcgaggtcatcaaggtggtccccgcctacacctcccagcgctgctcccagtgcggctacatctgcaaggagaaccgctgcacccaggccatgttcgagtgcaagcagtgcggctacaagacgcacgcggactacaacgccgccaagaacatctccacctacgacatcgagaacatcatcaacaagcagctcgccgtccagagcaagctccactccaagaagtgcatggaggagtacatcgaggagctgggctacctcgactag

SEQ ID NO: 2172 - DNA, 1356 bp, Unknown
  Bacillus sp. multi
ctcggcgtgacgatcaagatcatgaagtaccagatcctctgccccatgaacgtggactggacgatcttcgagaagcacctccgcaacctgacgtaccaggtgcggacgatctcgaaccgcaccatccagcagctctgggagttcgacgcgctctccttcgactacttcaaggagcgcgggacgtacccgacggtccaggatctctacggctgcacccagaagaagatcgacggctacatctaccacaccctccagtcgaagtaccccgacatccacaaggggaacatgagcaccaccctccagaaaatcatcaagacctggaagtcgcgccgcaacgagatccgcaagggcgagatgtcgatcccgtcgttccgcaaccgcatccccatcgacctgcacaacaactcggtggacatcatcaaggagaagaacggggactacatcgcgggcatctcgctgttcagcctggacttccacaaggagaacggcgacgtcccgaagggcaagattttcgtgaagctcggcacccagaagcagaagtccatgaaggtgatcctcgaccggctcatcaaccagacctacagcaagggcgcgtgcatgatccacaagtacaagaacaagtggtacttgagcatcacctacaagttcaacgccatcaaggagaacaagttcgacaagaagctcatcatgggcatcgacatgggcggcatcaacacggtgtacttcgcgttcaacgagggcttcatccgctccaacatcaagtcggacgagatcaagatgttcaacgagcgcatccgccagcgccgcatcaacctgctcaagcagtccaagtattgctccaactcccgcaccggcaagggccgcaccaagcgcctccagcccatcgacgtcctctccaacaagatcgccaagttccgcaacagcacgaaccacaagtacgccaactacatcgtgaagcagtgcctcaagcacaactgcgggcgcatccagatggagctgctcaaggggatctccaagaacgacaaggtgctcaaggactggacctacttcgacctccaggagaagattaagaaccaggccgaaatctacgggatcgaggtcatcaaggtcgtccccgcctacacctcccagcggtgctcgcagtgcggctacatctgcaaggagaaccggtgcacccaggccatgttcgagtgcaagcagtgcggctacaagacgcacgccgactacaacgcggccaagaacatctcgacctacgacatcgagaacatcatcaacaagcagctcgcggtccagagcaagctgcacagcaagaagtgcatggaggagtacatcgaggagctgggctacctcgactga

SEQ ID NO: 2173 - DNA, 1356 bp, Unknown
  Bacillus sp. multi
ctcggggtcacgatcaagatcatgaagtaccagatcctctgcccgatgaacgtggactggaccatcttcgagaagcacctccgcaacctgacctaccaggtccggacgatctcgaaccgcaccatccagcagctctgggagttcgacgcgctcagcttcgactacttcaaggagcgcggcacctacccgacggtccaggatctatacggctgcacccagaagaagatcgacggctacatctaccacacgctccagtcgaagtacccggacatccacaaggggaacatgagcaccaccctccagaagatcatcaagacctggaagtcccgccggaacgagatccgcaagggcgagatgtccatcccgtccttccggaaccgcatccccatcgacctccacaacaactccgtggacatcatcaaggagaagaacggcgactacatcgccgggatctccctgttctccctcgacttccacaaggagaacggcgacgtgccgaagggcaagatcttcgtcaagctcggcacgcagaagcagaagtccatgaaggtcatcctggaccggctcatcaaccagacctactcgaagggcgcgtgcatgatccacaagtacaagaacaagtggtatctctccatcacctacaagttcaacgccatcaaggagaacaagttcgacaagaaactcatcatgggcatcgacatgggcggcatcaacacggtgtacttcgccttcaacgaggggttcatccgcagcaacatcaagtcggacgagatcaagatgttcaacgagcgcatccgccagcgccggatcaacctgctcaagcagagcaagtattgctccaacagccgcaccgggaagggccgcacgaagcgcctccagcccatcgacgtgctctcgaacaagatcgccaagttccgcaacagcaccaaccacaagtacgcgaactacatcgtcaagcagtgcctcaagcacaactgcgggcgcatccagatggagctgctcaagggcatcagcaagaacgacaaggtgctcaaggactggacgtacttcgacctccaggagaagattaagaaccaggccgaaatctacggcatcgaggtcatcaaggtcgtccccgcctacaccagccagcggtgctcgcagtgcgggtacatctgcaaggagaaccgctgcacccaggccatgttcgagtgcaagcagtgcgggtacaagacccacgcggactacaacgcggccaagaacatctcgacgtacgacatcgagaacatcatcaacaagcagctcgcggtccagagcaagctgcacagcaagaagtgcatggaggagtacatcgaggagctgggctacctggactga

SEQ ID NO: 2174 - DNA, 1356 bp, Unknown
  Bacillus sp. multi
ctgggcgtgacgatcaagatcatgaagtaccagatcctctgcccgatgaacgtggactggacgatcttcgagaagcacctccgcaacctcacctaccaagtccggacgatcagcaaccggaccatccagcagctctgggagttcgacgccctgtccttcgactacttcaaggagcgcggcacctacccgacggtccaggatctctacggctgcacgcagaagaagatcgacgggtacatctaccacaccctccagagcaagtacccggacatccacaaggggaacatgagcaccacgctccagaagatcatcaagacctggaagtcccgccggaacgagatccgcaagggcgagatgtcgatcccctccttccggaaccgcatccccatcgacctgcacaacaactccgtggacatcatcaaggagaagaatggggactacatcgcggggatctccctgttcagcctcgacttccacaaggagaacggcgacgtcccgaagggcaaaatcttcgtcaagctgggcacgcagaagcagaagtccatgaaggtgatcctggaccggctcatcaaccagacctactcgaagggcgcgtgcatgatccacaagtacaagaacaagtggtacctttccatcacctacaagttcaacgcgatcaaggagaacaagttcgacaagaagctcatcatgggcatcgacatgggcggcatcaacaccgtgtacttcgcgttcaacgagggcttcatccggtcgaacatcaagtccgacgagatcaagatgttcaacgagcgcatccgccagcggcggatcaacctgctcaagcagtccaagtactgctccaactcccgcaccggcaagggccggacgaagcgcctccagcccatcgacgtgctcagcaacaagatcgccaagttccgcaacagcaccaaccacaagtacgccaactacatcgtcaagcagtgcctcaagcacaactgcgggcgcatccagatggagctgctcaaggggatcagcaagaacgacaaggtgctcaaggactggacctacttcgacctccaggagaagattaagaaccaggcggaaatctacgggatcgaggtcatcaaggtcgtgcccgcctacacctcgcagcggtgcagccagtgcgggtacatctgcaaggagaaccggtgcacccaggccatgttcgagtgcaagcagtgcggctacaagacgcacgccgactacaacgccgccaagaacatcagcacgtacgacatcgagaacatcatcaacaagcagctcgccgtccagagcaagctgcactccaagaagtgcatggaggagtacatcgaggagctgggctacctggactga

SEQ ID NO: 2175 - DNA, 1335 bp, Unknown
  Bacillus sp. multi
atgaagtaccagatcctctgcccgatgaacgtggactggaccatcttcgagaagcacctccgcaacctgacctaccaggtccggacgatcagcaaccggaccatccagcagctctgggagttcgacgccctctccttcgactacttcaaggagcgcggcacctacccgacggtccaggacttgtacggctgcacgcagaagaaaatcgacgggtacatctaccacaccctccagagcaagtacccggacatccacaaggggaacatgagcacgacgctccagaagatcatcaagacctggaagtcccgccggaacgagatccgcaagggcgagatgtccatcccgtcgttccgcaaccgcatccccatcgacctccacaacaacagcgtggacatcatcaaggagaagaacggcgactacatcgcgggcatctccctgttctcccgcgacttccacaaggagaacgacgacgtgccgaagggcaaaatcttcgtcaagctgagcacgcagaagcagaagtccatgaaggtcatcctggaccgcctcatgaaccagacgtactcgaagggcgcgtgcatgatccacaagtacaagaacaagtggtacctcagcatcacctacaagttcaacgccatcaaggagaacaagttcgacaaggaactaatcatgggcatcgacatgggcggcatcaacaccgtgtacttcgcgttcaacgaggggttcatccgcagcaacatcaagagcgacgagatcaagatattcaacgagcgcatccggcagcggcgcatcaacctgctcaagcagtccaaatactgctccaacagccggacgggcaaggggcgcaccaagcggctccagcccatcgacgtgctcagcaacaagatcgccaagttccgcaacagcaccaaccacaagtacgcgaactacatcgtgaagcagtgcctcaagcacaactgcgggcgcatccagatggagctgctcaagggcatctccaagaacgacaagatcctcaaggactggacgtacttcgacctccaggagaagatcaagaaccaggccgagatccacgggatcgaggtcatcaagatcgcgcccgcctacaccagccagcggtgctcgcagtgcgggtacatctgcaaggagaaccggtgcacccaggcggtgttcgagtgcaagcagtgcgggtacaagacgcacgccgactacaacgccgccaagaacatctcgatctacgacatcgagaacatcatcaacaagcagctcgccgtccagagcaagctgcacagcaagaagtgcatggaggagtacatcgaggagctgggctacctggactga

SEQ ID NO: 2176 - DNA, 1335 bp, Unknown
  Bacillus sp. multi
atgaagtaccagatcctctgccccatgaacgtggactggacgatcttcgagaagcacctccgcaacctgacctaccaggtgcggacgatctccaaccggacgatccagcagctctgggagttcgacgcgctgagcttcgactacttcaaggagcggggcacctacccgacggtccaagacctgtacggctgcacgcagaagaagatcgacgggtacatctaccacaccctccagagcaagtaccccgacatccacaaggggaacatgagcaccaccctccagaagatcatcaagacctggaagtcgcgccggaacgagatccggaagggcgagatgagcatcccgtccttccgcaaccgcatccccatcgacctgcacaacaactccgtggacatcatcaaggagaagaatggggactacatcgccgggatctcgctgttcagccgggacttccacaaggagaacgacgacgtgccgaagggcaaaatcttcgtgaagctgagcacgcagaagcagaagtccatgaaggtcatcctggaccggctcatgaaccagacctactcgaagggcgcgtgcatgatccacaagtacaagaacaagtggtatttgagcatcacgtacaagttcaacgcgatcaaggagaacaagttcgacaaggagctgattatggggatcgacatgggcggcatcaacaccgtgtacttcgccttcaacgagggcttcatccgctcgaacatcaagtccgacgagatcaagatattcaacgagcgcatccgccagcgccggatcaacctgctcaagcagagcaagtactgctccaacagccgcaccggcaagggccggaccaagcgcctccagcccatcgacgtcctctccaacaagatcgccaagttccgcaacagcaccaaccacaagtacgccaactacatcgtcaagcagtgcctcaagcacaactgcgggcgcatccagatggagctgctcaagggcatcagcaagaacgacaagatcctcaaggactggacctacttcgacctccaggagaagatcaagaaccaggccgagatccacggcatcgaggtcatcaagatcgccccggcctacacctcccagcgctgctcccagtgcgggtacatctgcaaggagaaccgctgcacccaggccgtcttcgagtgcaagcagtgcgggtacaagacgcacgcggactacaacgccgccaagaacatcagcatctacgacatcgagaacatcatcaacaagcagctcgccgtgcagtcgaagctccactccaagaagtgcatggaggagtacatcgaggagctgggctacctggactga

SEQ ID NO: 2177 - DNA, 1335 bp, Unknown
  Bacillus sp. multi
atgaagtaccagatcctctgcccgatgaacgtggactggacgatcttcgagaagcacctccgcaacctcacgtaccaagtccggacgatcagcaaccgcaccatccagcagctctgggagttcgacgccctgtcgttcgactacttcaaggagcgcggcacgtaccccaccgtccaagacctctacggctgcacccagaagaagatcgacgggtacatctaccacaccctccagtcgaagtacccggacatccacaaggggaacatgagcacgaccctccagaagatcatcaagacctggaagtcccgccggaacgagatccgcaagggcgagatgagcatcccgtccttccgcaaccgcatccccatcgacctgcacaacaacagcgtggacatcatcaaggagaagaacggcgactacatcgcggggatctccctgttctcccgcgacttccacaaggagaacgacgacgtgccgaagggcaaaatcttcgtgaagctcagcacgcagaagcagaagtcgatgaaggtgatcctggaccgcctcatgaaccagacgtactcgaagggcgcgtgcatgatccacaagtacaagaacaagtggtacttgagcatcacctacaagttcaacgccatcaaggagaacaagttcgacaaggagctgatcatgggcatcgacatgggcgggatcaacaccgtgtacttcgccttcaacgaggggttcatccgcagcaacatcaagtcggacgagatcaagatattcaacgagcgcatccggcagcggcgcatcaacctcctcaagcagagcaaatactgctccaactcgcggacgggcaagggccggaccaagcgcctccagcccatcgacgtgctctccaacaagatcgccaagttccgcaacagcacgaaccacaagtacgccaactacatcgtgaagcagtgcctcaagcacaactgcgggcgcatccagatggagctgctcaagggcatcagcaagaacgacaagatcctcaaggactggacgtacttcgacctccaggagaaaatcaagaaccaggcggagatccacggcatcgaggtcatcaagatcgcgcccgcctacacctcccagcggtgctcgcagtgcggctacatctgcaaggagaaccggtgcacccaggcggtgttcgagtgcaagcagtgcggctacaagacgcacgccgactacaacgcggccaagaacatctccatctacgacatcgagaacatcatcaacaagcagctcgcggtccagagcaagctgcactccaagaagtgcatggaggagtacatcgaggagctgggctacctcgactga

SEQ ID NO: 2178 - DNA, 1335 bp, Unknown
  Bacillus sp. multi
atgaagtaccagatcctctgccccatgaacgtggactggacgatcttcgagaagcacctccgcaacctcacgtaccaagtgcggacgatcagcaaccgcaccatccagcagctctgggagttcgacgccctctccttcgactacttcaaggagcgcgggacgtacccgacggtccaggacttgtacggctgcacgcagaagaagatcgacggctacatctaccacacgctccagagcaagtacccggacatccacaaggggaacatgagcaccacgctccagaaaatcatcaagacctggaagtcgcggcgcaacgagatccgcaagggcgagatgagcatcccgtccttccggaaccgcatccccatcgacctgcacaacaactccgtggacatcatcaaggagaagaacggggactacatcgcgggcatcagcctgttcagccgggacttccacaaggagaacgacgacgtgccgaagggcaagatattcgtcaagctgtccacccagaagcagaagtccatgaaggtgatcctggaccgcctgatgaaccagacctacagcaagggcgcgtgcatgatccacaagtacaagaacaagtggtacttgtccatcacctacaagttcaacgcgatcaaggagaacaagttcgacaaggagctcatcatgggcatcgacatgggcggcatcaacaccgtgtacttcgccttcaacgagggcttcatccgctccaacatcaagagcgacgagatcaagatcttcaacgagcgcatccggcagcgccgcatcaacctcctcaagcagtccaagtattgctccaacagccggacggggaaggggcgcacgaagcgcctccagcccatcgacgtgctctccaacaagatcgccaagttccgcaacagcaccaaccacaagtacgccaactacatcgtgaagcagtgcctcaagcacaactgcgggcgcatccagatggagctgctcaaggggatcagcaagaacgacaagatcctcaaggactggacctacttcgacctccaggagaagatcaagaaccaggcggagatccacgggatcgaggtcatcaagatcgcgcccgcctacaccagccagcgctgctcgcagtgcggctacatctgcaaggagaaccgctgcacccaggcggtcttcgagtgcaagcagtgcggctacaagacccacgccgactacaacgcggccaagaacatctcgatctacgacatcgagaacatcatcaacaagcagctcgccgtccagtcgaagctgcacagcaagaaatgcatggaggagtacatcgaggagctgggctacctcgactga

SEQ ID NO: 2179 - DNA, 1335 bp, Unknown
  Bacillus sp. multi
atgaagtaccagatcctctgccccatgaacgtggactggaccatcttcgagaagcacctccggaacctcacgtaccaggtgcggacgatctccaaccggaccatccagcagctctgggagttcgacgcgctgtccttcgactacttcaaggagcgcggcacgtacccgaccgtccaggatctctacgggtgcacgcagaagaagatagacggctacatctaccacacgctccagagcaagtacccggacatccacaaggggaacatgagcaccacgctccagaaaatcatcaagacctggaagtcccgccgcaacgagatccgcaagggcgagatgagcatccccagcttccggaaccgcatccccatcgacctccacaacaactcggtggacatcatcaaggagaagaacggcgactacatcgcgggcatctcgctcttcagccgcgacttccacaaggagaacgacgacgtgccgaagggcaaaatcttcgtgaagctctccacgcagaagcagaagtcgatgaaggtcatcctggaccgcctcatgaaccagacctacagcaagggcgcgtgcatgatccacaagtacaagaacaagtggtacctctcgatcacgtacaagttcaacgccatcaaggagaacaagttcgacaaggagctaatcatgggcatcgacatgggcgggatcaacaccgtgtacttcgccttcaacgaggggttcatccggtcgaacatcaagtccgacgagatcaagatattcaacgagcgcatccgccagcggcgcatcaacctgctcaagcagtccaagtactgttccaactcgcgcacgggcaagggccggacgaagcgcctccagcccatcgacgtcctgagcaacaagatcgccaagttccgcaactccaccaaccacaagtacgcgaactacatcgtgaagcagtgcctcaagcacaactgcgggcgcatccagatggagctgctcaagggcatctccaagaacgacaagatcctcaaggactggacgtacttcgacctccaggagaagatcaagaaccaggccgagatccacgggatcgaggtcatcaagatcgccccggcctacacctcccagcggtgcagccagtgcggctacatctgcaaggagaaccgctgcacccaggccgtcttcgagtgcaagcagtgcggctacaagacccacgcggactacaacgcggccaagaacatctcgatctacgacatcgagaacatcatcaacaagcagctcgcggtccagtcgaagctgcacagcaagaagtgcatggaggagtacatcgaggagctgggctacctggactag

SEQ ID NO: 2180 - DNA, 1335 bp, Unknown
  Bacillus sp. multi
atgaagtaccagatcctctgccccatgaacgtggactggacgatcttcgagaagcacctccggaacctcacgtaccaggtgcggacgatctccaaccgcaccatccagcagctctgggagttcgacgcgctgagcttcgactacttcaaggagcgcggcacctacccgaccgtccaagacctatacggctgcacccagaagaaaatcgacggctacatctaccacaccctccagtcgaagtacccggacatccacaagggcaacatgagcaccacgctccagaagattatcaagacctggaagtcccgccgcaacgagatccggaagggcgagatgagcatccccagcttccgcaaccgcatccccatcgacctgcacaacaacagcgtggacatcacgaaggagaagaacggcgcgtacatcgcgggcatatcgttcttcagccgcgacttccacaaggagaacggcgacgtcccgaagggcaaaatcttcgtcaagctcagcacccagaagcagaagtccatgaaggtcatcctcgaccggctcatgaaccagacgtactcgaagggcgcgtgcatgatccacaagtacaagaacaagtggtacctgtcaatcacctacaagttcaacgccatcaaggagaacaagttcgacaaggagcttatcatgggcatcgacatgggcggcatcaacacggtgtacttcgcgttcaacgagggcttcatccggtcgaacatcaagagcgacgagatcaagatgttcaacgagcgcatccgccagcgccggatcaacctcctcaagcagtccaaatactgttcgaactcccgcacggggaaggggcggaccaagcgcctccagcccatcgacgtcctctccaacaagatcgccaagttccgcaacagcaccaaccacaagtacgcgaactacatcgtgaagcagtgcctcaagcacaactgcgggcgcatccagatggagctgctcaagggcatcagcaagaacgacaagatcctcaaggactggacgtacttcgacctccaggagaagatcaagaaccaggccgagatccacgggatcgaggtcatcaaggtcgcgcccgcctacaccagccagcgctgctcgcagtgcggctacatctgcaaggagaaccggtgcacccaggccacgttcgagtgcaagcagtgcgggtacaagacccacgcggactacaacgccgccaagaacatctcgacgtacgacatcgagaacatcatcaacaagcagctcgcggtgcagtcgaagctccacagcaagaagtgtatggaggagtacatcgaggagctgggctacctcgactga

SEQ ID NO: 2181 - DNA, 1335 bp, Unknown
  Bacillus sp. multi
atgaagtaccagatcctctgccccatgaacgtggactggacgatcttcgagaagcacctccggaacctcacctaccaagtccggacgatctcgaaccggaccatccagcagctctgggagttcgacgccctgtccttcgactacttcaaggagcgcggcacgtacccgaccgtccaggatctctacggctgcacccagaagaagatcgacgggtacatctaccacacgctccagagcaagtacccggacatccacaaggggaacatgagcacgacgctccagaagattattaagacctggaagtcccgccgcaacgagatccgcaagggcgagatgtcgatcccgagcttccgcaaccgcatccccatcgacctgcacaacaacagcgtggacatcacgaaggagaagaacggggcgtacatcgcgggcatctcgttctttagccgcgacttccacaaggagaacggcgacgtcccgaagggcaagatattcgtgaagctcagcacccagaagcagaagtcgatgaaggtgatcctcgaccggctcatgaaccagacgtacagcaagggcgcgtgcatgatccacaagtacaagaacaagtggtacttgtcgataacctacaagttcaacgccatcaaggagaacaagttcgacaaggagctaatcatgggcatcgacatgggcggcatcaacacggtgtacttcgccttcaacgagggcttcatccggagcaacatcaagtccgacgagatcaagatgttcaacgagcgcatccgccagcggcgcatcaacctcctcaagcagagcaagtactgttccaactcccggacggggaaggggcgcacgaagcgcctccagcccatcgacgtgctcagcaacaagatcgccaagttccgcaacagcacgaaccacaagtacgccaactacatcgtgaagcagtgcctcaagcacaactgcgggcgcatccagatggagctgctcaagggcatctccaagaacgacaagatcctcaaggactggacctacttcgacctccaggagaagattaagaaccaggccgagatccacgggatcgaggtcatcaaggtcgcgcccgcctacacctcccagcggtgctcccagtgcgggtacatctgcaaggagaaccgctgcacccaggccaccttcgagtgcaagcagtgcggctacaagacccacgcggactacaacgccgccaagaacatctcgacctacgacatcgagaacatcatcaacaagcagctcgccgtccagagcaagctccactccaagaagtgcatggaggagtacatcgaggagctgggctacctggactag

SEQ ID NO: 2182 - DNA, 1335 bp, Unknown
  Bacillus sp. multi
atgaagtaccagatcctctgcccgatgaacgtggactggaccatcttcgagaagcacctccgcaacctgacctaccaagtccggacgatctccaaccggaccatccagcagctctgggagttcgacgccctctcgttcgactacttcaaggagcggggcacctaccccacggtccaagacctttacggctgcacccagaagaagatcgacgggtacatctaccacacgctccagagcaagtaccccgacatccacaaggggaacatgagcacgaccctccagaaaatcatcaagacctggaagtcgcggcgcaacgagatccggaagggcgagatgagcatcccctccttccgcaaccgcatccccatcgacctccacaacaactcggtggacatcacgaaggagaagaacggcgcgtacatcgcgggcatcagtttctttagccgggacttccacaaggagaacggggacgtgccgaagggcaaaatcttcgtaaagctgtccacccagaagcagaagtcgatgaaggtcatcctggaccgcctgatgaaccagacctacagcaagggcgcgtgcatgatccacaagtacaagaacaagtggtacctcagcatcacctacaagttcaacgcgatcaaggagaacaagttcgacaaggagctgatcatgggcatcgacatgggcggcatcaacaccgtgtacttcgcgttcaacgagggcttcatccggtcgaacatcaagtcggacgagatcaagatgttcaacgagcgcatccggcagcgccggatcaacctgctcaagcagtccaagtattgctcgaactcgcgcaccggcaaggggcgcaccaagcggctccagcccatcgacgtgctgtccaacaagatcgccaagttccgcaactcgacgaaccacaagtacgcgaactacatcgtcaagcagtgcctcaagcacaactgcgggcgcatccagatggagctgctcaaggggatcagcaagaacgacaagatcctcaaggactggacgtacttcgacctccaggagaagattaagaaccaggccgagatccacggcatcgaggtcatcaaggtggccccggcctacaccagccagcggtgcagccagtgcggctacatctgcaaggagaaccggtgcacccaggcgaccttcgagtgcaagcagtgcggctacaagacgcacgcggactacaacgccgccaagaacatcagcacctacgacatcgagaacatcatcaacaagcagctcgccgtgcagtcgaagctccactccaagaaatgcatggaggagtacatcgaggagctgggctacctcgactag

SEQ ID NO: 2183 - DNA, 1335 bp, Unknown
  Bacillus sp. multi
atgaagtaccagatcctctgccccatgaacgtggactggacgatcttcgagaagcacctccggaacctgacctaccaagtccggacgatctccaaccgcaccatccagcagctctgggagttcgacgccctgtccttcgactacttcaaggagcgcgggacgtacccgaccgtccaagacctctacggctgcacgcagaagaaaatcgacgggtacatctaccacacgctccagagcaagtaccccgacatccacaagggcaacatgagcaccacgctccagaagatcatcaagacctggaagtcgcgccgcaacgagatccgcaagggcgagatgtcgatcccctccttccgcaaccgcatccccatcgacctccacaacaactcggtggacatcacgaaggagaagaatggcgcgtacatcgcgggcatcagcttcttcagccgggacttccacaaggagaacggggacgtgccgaagggcaagatattcgtgaagctgagcacgcagaagcagaagtccatgaaggtcatcctggaccgcctgatgaaccagacgtacagcaagggcgcgtgcatgatccacaagtacaagaacaagtggtatctatcgatcacctacaagttcaacgcgatcaaggagaacaagttcgacaaggagcttatcatgggcatcgacatgggcggcatcaacaccgtgtacttcgccttcaacgaggggttcatccggagcaacatcaagtccgacgagatcaagatgttcaacgagcgcatccggcagcggcgcatcaacctgctcaagcagagcaagtactgttccaactcccgcacggggaagggccggacgaagcggctccagcccatcgacgtcctctccaacaagatcgccaagttccgcaactccaccaaccacaagtacgccaactacatcgtgaagcagtgcctcaagcacaactgcgggcgcatccagatggagctgctcaaggggatcagcaagaacgacaagatcctcaaggactggacctacttcgacctccaggagaaaatcaagaaccaggcggagatccacggcatcgaggtcatcaaggtcgccccggcctacacgagccagcgctgctcgcagtgcgggtacatctgcaaggagaaccgctgcacccaggccacgttcgagtgcaagcagtgcggctacaagacgcacgccgactacaacgccgccaagaacatctccacctacgacatcgagaacatcatcaacaagcagctcgcggtccagagcaagctccactccaagaagtgtatggaggagtacatcgaggagctgggctacctcgactag

SEQ ID NO: 2184 - DNA, 1335 bp, Unknown
  Bacillus sp. multi
atgaagtaccagatcctctgcccgatgaacgtggactggaccatcttcgagaagcacctccgcaacctgacctaccaagtccggacgatctcgaaccgcacgatccagcagctctgggagttcgacgccctgtccttcgactacttcaaggagcgcggcacctaccccaccgtccaagatctctacggctgcacccagaagaaaatcgacggctacatctaccacaccctccagagcaagtacccggacatccacaagggcaacatgagcaccacgctccagaaaatcatcaagacctggaagtcgcggcgcaacgagatccgcaagggcgagatgtccatccccagcttccgcaaccgcatccccatcgacctccacaacaactccgtggacatcacgaaggagaagaatggcgcgtacatcgcgggcatctcgttcttcagcagggacttccacaaggagaacggggacgtgccgaagggcaaaatcttcgtcaagctgtccacgcagaagcagaagtcgatgaaggtcatcctcgaccggctcatgaaccagacctacagcaagggcgcgtgcatgatccacaagtacaagaacaagtggtatctgtccatcacgtacaagttcaacgccatcaaggagaacaagttcgacaaggagctcattatgggcatcgacatgggcggcatcaacaccgtgtacttcgccttcaacgagggcttcatccgcagcaacatcaagtccgacgagatcaagatgttcaacgagcgcatccgccagcgccggatcaacctcctcaagcagagcaaatactgctccaactcccggacgggcaaggggcgcacgaagcgcctccagcccatcgacgtgctgtccaacaagatcgccaagttccgcaacagcaccaaccacaagtacgcgaactacatcgtcaagcagtgcctcaagcacaactgcgggcgcatccagatggagctgctcaagggcatcagcaagaacgacaagatcctcaaggactggacctacttcgacctccaggagaagatcaagaaccaggcggagatccacggcatcgaggtcatcaaggtcgcgcccgcctacacctcgcagcggtgctcccagtgcggctacatctgcaaggagaaccgctgcacccaggcgaccttcgagtgcaagcagtgcggctacaagacccacgccgactacaacgccgccaagaacatctcgacctacgacatcgagaacatcatcaacaagcagctcgccgtgcagagcaagctgcactccaagaagtgcatggaggagtacatcgaggagctgggctacctggactga

SEQ ID NO: 2185 - DNA, 1335 bp, Unknown
  Bacillus sp. multi
atgaagtaccagatcctctgcccgatgaacgtggactggaccatcttcgagaagcacctccgcaacctgacctaccaggtgcggacgatctccaaccggacgatccagcagctctgggagttcgacgccctctcgttcgactacttcaaggagcgcggcacctaccccacggtccaggacctctatggctgcacgcagaagaaaatcgacggctacatctaccacaccctccagtcgaagtacccggacatccacaagggcaacatgagcaccaccctccagaagatcatcaagacctggaagtcccgccgcaacgagatccggaagggcgagatgagcatcccgagcttccgcaaccgcatccccatcgacctgcacaacaactcggtggacatcaagaaggagaagaacggggactacatcgcggggatctccctgttctcccgcgacttccacaaggagaactccgacgtcccgaagggcaagatattcgtcaagctggccaccaagaaacagaagtccatgaagatcatcctcgaccggctcatgaaccagacgtacagcaagggcgcgtgcatgatccacaagtacaagaacaagtggtatctgtctataacctacaagttcaacgccatcaaggagaacaagttcgacaaagacctcatcatggggatcgacatgggcgggatcaacaccgtgtacttcgccttcaacgagggcttcatccggtccaacatcaagagcgacgagatcaaggcgttcaacgagcgcatccggcagcgccgcatcaacctcctcaagcagagcaaatactgttccaactcgcggacgggcaagggccgcgagaagcgcctccagcccatcgacgtcctcagcaacaagatcgccaagttccgcaactcgaccaaccacaagtacgccaactacatcatcaagcagtgcctcaagcacaactgcgggcgcatccagatggagctgctcaagggcatcagcaagaacgacaaggtgctcaaggactggacctacttcgacctccaggagaaaattcagaaccaggccgagatccacggcatcgaggtcatcaaggtcgccccggcctacaccagccagcggtgcagccagtgcgggtacatctgcaaggagaaccgctgcacccaggcggtgttcgagtgcaagcagtgcggctacaagacgcacgccgactacaacgccgccaagaacatcgccacgtacgacatcgagaacatcatcaacaagcagctcgccgtgcagtccaagctgcacagcaagaagtgcatggaggagtacatcgaggagctgggctacctggactag

SEQ ID NO: 2186 - DNA, 1335 bp, Unknown
  Bacillus sp. multi
atgaagtaccagatcctctgcccgatgaacgtggactggaccatcttcgagaagcacctccggaacctcacctaccaggttcggacgatctccaaccgcaccatccagcagctctgggagttcgacgcgctctccttcgactacttcaaggagcggggcacctacccgaccgtccaggatctctacggctgcacgcagaagaagattgacggctacatctaccacacgctccagagcaagtaccccgacatccacaagggcaacatgagcacgaccctccagaaaatcatcaagacctggaagtcccgccgcaacgagatccggaagggcgagatgagcatccccagcttccggaaccgcatccccatcgacctgcacaacaactccgtggacatcaagaaggagaagaacggcgactacatcgccgggatctcgctgttcagccgcgacttccacaaggagaactccgacgtgccgaagggcaagatcttcgtgaagctggccaccaagaaacagaagtccatgaagatcatcctggaccggctcatgaaccagacgtactcgaagggcgcgtgcatgatccacaagtacaagaacaagtggtatctgagcatcacctacaagttcaacgcgatcaaggagaacaagttcgacaaggatcttatcatgggcatcgacatgggcgggatcaacacggtgtacttcgccttcaacgagggcttcatccggtcgaacatcaagtcggacgagatcaaggcgttcaacgagcgcatccgccagcggcgcatcaacctcctcaagcagagcaaatactgctccaactcccgcaccgggaagggccgcgagaagcgcctccagcccatcgacgtgctgtcgaacaagatcgccaagttccgcaactccaccaaccacaagtacgccaactacatcatcaagcagtgcctcaagcacaactgcgggcgcatccagatggagctgctcaaggggatctccaagaacgacaaggtgctcaaggactggacctacttcgacctccaggagaaaatccaaaaccaggccgagatccacggcatcgaggtcatcaaggtcgccccggcctacacgagccagcgctgctcccagtgcggctacatctgcaaggagaaccggtgcacccaggcggtcttcgagtgcaagcagtgcgggtacaagacgcacgccgactacaacgccgccaagaacatcgccacgtacgacatcgagaacatcatcaacaagcagctcgcggtgcagagcaagctccacagcaagaaatgcatggaggagtacatcgaggagctgggctacctcgactag

SEQ ID NO: 2187 - DNA, 1335 bp, Unknown
  Bacillus sp. multi
atgaagtaccagatcctctgcccgatgaacgtggactggaccatcttcgagaagcacctccgcaacctcacctaccaagtgcggacgatcagcaaccggaccatccagcagctctgggagttcgacgcgctctccttcgactacttcaaggagcggggcacgtacccgaccgtccaggacttgtacggctgcacccagaagaagatcgacggctacatctaccacaccctccagtcgaagtacccggacatccacaaggggaacatgagcaccaccctccagaagatcatcaagacatggaagtcccggcgcaacgagatccgcaagggcgagatgagcatcccgagcttccggaaccgcatccccatcgacctccacaacaactccgtggacatcaagaaggaaaagaatggggactacatcgcgggcatcagcctgttcagccgcgacttccacaaggagaactccgacgtgccgaagggcaagatcttcgtgaagctggccaccaagaagcagaagtccatgaagatcatcctggaccgcctcatgaaccagacctacagcaagggcgcgtgcatgatccacaagtacaagaacaagtggtatttgagcatcacctacaagttcaacgccatcaaggagaacaagttcgacaaagacctgataatggggatcgacatgggcgggatcaacacggtgtacttcgcgttcaacgagggcttcatccgcagcaacatcaagtcggacgagatcaaggcgttcaacgagcgcatccggcagcggcggatcaacctcctcaagcagtccaagtattgctcgaactcccgcacgggcaaggggcgcgagaagcggctccagcccatcgacgtcctctccaacaagatcgccaagttccgcaacagcacgaaccacaagtacgcgaactacatcatcaagcagtgcctcaagcacaactgcgggcgcatccagatggagctgctcaagggcatcagcaagaacgacaaggtgctcaaggactggacgtacttcgacctccaggagaaaatccagaaccaggcggagatccacggcatcgaggtcatcaaggtcgccccggcctacacctcccagcggtgcagccagtgcgggtacatctgcaaggagaaccggtgcacccaggcggtcttcgagtgcaagcagtgcggctacaagacgcacgcggactacaacgcggccaagaacatcgccacctacgacatcgagaacatcatcaacaagcagctcgccgtccagagcaagctgcactccaagaaatgcatggaggagtacatcgaggagctgggctacctggactga

SEQ ID NO: 2188 - DNA, 1335 bp, Unknown
  Bacillus sp. multi
atgaagtaccagatcctctgcccgatgaacgtggactggaccatcttcgagaagcacctccgcaacctcacctaccaggtgcggacgatcagcaaccggaccatccagcagctctgggagttcgacgcgctgtccttcgactacttcaaggagcggggcacgtaccccaccgtccaagatctctacggctgcacccagaagaaaatcgacggctacatctaccacacgctccagagcaagtacccggacatccacaagggcaacatgagcacgaccctccagaaaatcatcaagacctggaagtcccgccgcaacgagatccggaagggcgagatgagcatccccagcttccgcaaccgcatccccatcgacctccacaacaactccgtggacatcaagaaggagaagaatggcgactacatcgcggggatcagcctgttcagccgcgacttccacaaggagaactccgacgtcccgaagggcaagattttcgtgaagctggccaccaagaagcagaagtccatgaagatcatcctggaccgcctgatgaaccagacgtacagcaagggcgcgtgcatgatccacaagtacaagaacaagtggtacttgtccatcacctacaagttcaacgcgatcaaggagaacaagttcgacaaggatctgattatggggatcgacatgggcggcatcaacacggtgtacttcgcgttcaacgagggcttcatccgctccaacatcaagagcgacgagatcaaggcgttcaacgagcgcatccggcagcgccggatcaacctgctcaagcagagcaaatactgctccaactcgcgcacggggaaggggcgcgagaagcgcctccagcccatcgacgtgctgtccaacaagatcgccaagttccgcaactcgacgaaccacaagtacgccaactacatcatcaagcagtgcctcaagcacaactgcgggcgcatccagatggagctgctcaagggcatctccaagaacgacaaggtgctcaaggactggacgtacttcgacctccaggagaaaatccagaaccaggcggagatccacgggatcgaggtcatcaaggtcgccccggcctacacctcgcagcggtgctcccagtgcggctacatctgcaaggagaaccgctgcacccaggcggtgttcgagtgcaagcagtgcggctacaagacgcacgccgactacaacgccgccaagaacatcgccacgtacgacatcgagaacatcatcaacaagcagctcgcggtgcagagcaagctgcactccaagaaatgcatggaggagtacatcgaggagctgggctacctggactag

SEQ ID NO: 2189 - DNA, 1335 bp, Unknown
  Bacillus sp. multi
atgaagtaccagatcctctgcccgatgaacgtggactggaccatcttcgagaagcacctccggaacctcacgtaccaagtacggacgatctcgaaccggaccatccagcagctctgggagttcgacgcgctgtccttcgactacttcaaggagcgcggcacgtaccccacggtccaagacctctacggctgcacgcaaaagaaaattgacggctacatctaccacaccctccagagcaagtaccccgacatccacaaggggaacatgagcacgaccctccagaagatcatcaagacctggaagtcccgccgcaacgagatccgcaagggcgagatgtccatcccctccttccgcaaccgcatccccatcgacctccacaacaactccgtggacattaagaaggagaagaacggcgactacatcgcggggatctcgctgttctcccgcgacttccacaaggagaactcggacgtgccgaagggcaagatattcgtcaagctggcgaccaagaagcagaagtcgatgaagatcatcctggaccgcctcatgaaccagacgtacagcaagggcgcgtgcatgatccacaagtacaagaacaagtggtatctgagcatcacctacaagttcaacgcgatcaaggagaacaagttcgacaaagaccttatcatgggcatcgacatgggcggcatcaacaccgtgtacttcgcgttcaacgagggcttcatccgcagcaacatcaagagcgacgagatcaaggcgttcaacgagcgcatccgccagcgccgcatcaacctcctcaagcagagcaagtattgctcgaactcccgcacggggaaggggcgggagaagcgcctccagcccatcgacgtcctcagcaacaagatcgccaagttccgcaacagcacgaaccacaagtacgccaactacatcatcaagcagtgcctcaagcacaactgcgggcgcatccagatggagctgctcaaggggatctccaagaacgacaaggtgctcaaggactggacgtacttcgacctccaggagaagatccagaaccaggccgagatccacggcatcgaggtcatcaaggtcgcgcccgcctacacctcccagcggtgcagccagtgcgggtacatctgcaaggagaaccgctgcacccaggcggtgttcgagtgcaagcagtgcgggtacaagacccacgccgactacaacgccgccaagaacatcgccacctacgacatcgagaacatcatcaacaagcagctcgccgtgcagagcaagctccactccaagaagtgcatggaggagtacatcgaggagctgggctacctcgactag

SEQ ID NO: 2190 - DNA, 1356 bp, Unknown
  Bacillus sp. multi
ctgggcgtgacgatcaagatcatgaagtaccagatcctctgcccgatgaacgtggactggaccatcttcgagaagcacctccgcaacctcacgtaccaagttcggacgatcagcaaccgcacgatccagcagctctgggagttcgacgccctctccttcgagtacttcaaggagcgcgggacgtaccccacggtccaagacttgtacggctgcacgcagaagaaaatcgacgggtacatctaccacaccctccagagcaagtaccccgacatccacaaggggaacatgagcacgaccctccagaagatcattaagacctggaagtcccggcgcaacgagatccgcaagggcgagatgagcatcccgagcttccgcaaccgcatccccatcgacctccacaacaactcggtggacatcatcaaggagaagaacggcgactacatcgccgggatcagcctgttcagccgcgacttccacaaggagaacggcgacgtcccgaagggcaagatattcgtcaagctggccacccagaagcagaagtccatgaaggtcatcctcgaccgcctcatcaaccagacgtacagcaagggcgcgtgcatgatccacaagtacaagaacaagtggtacttgagcatcacctacaagttcaacgccatcaaggagaacaagttcgacaaggaattgattatggggatcgacatgggcgggatcaacacggtgtacttcgcgttcaacgagggcttcatccggtccaacatcaagtccgacgagatcaagatgttcaacgagcgcatccgccagcgccgcatcaacctcctcaagcagtccaagtactgctccaactcgcgcacgggcaagggccggacgaagcggctccagcccatcgacgtgctgtcgaacaagatcgccaagttccgcaactcgaccaaccacaagtacgccaactacatcgtgaagcagtgcctcaagcacaactgcgggcgcatccagatggagctgctcaaggggatcagcaagaacgacaagatcctcaaggactggacctacttcgacctccaggagaagatcaagaaccaggccgagatccacggcatcgaggtcatcaaggtcgtcccggcctacaccagccagcggtgcagccagtgcgggtacatctgcaaggagaaccgctgcacccaggcgacgttcgagtgcaagcagtgcggctacaagacgcacgcggactacaacgccgccaagaacctctccacctacgacatcgagaacatcatcaacaagcagctcgccgtgcagagcaagctccacagcaagaagtgcatggaggagtacatcgaggagctgggctacctcgactag

SEQ ID NO: 2191 - DNA, 1356 bp, Unknown
  Bacillus sp. multi
ctcggggtcaccatcaagatcatgaagtaccagatcctctgcccgatgaacgtggactggaccatcttcgagaagcacctccggaacctcacgtaccaggtgcggacgatctccaaccggaccatccagcagctctgggagttcgacgccctgtccttcgaatactttaaggagcgcggcacgtaccccaccgtccaggatctctacggctgcacgcagaagaaaatcgacgggtacatctaccacaccctccagagcaagtaccccgacatccacaagggcaacatgagcacgaccctccagaaaatcatcaagacctggaagtcccgccggaacgagatccgcaagggcgagatgtcgatccccagcttccggaaccgcatccccatcgacctgcacaacaactccgtggacatcatcaaggagaagaacggggactacatcgccgggatctccctgttctcgcgcgacttccacaaggagaacggggacgtgccgaagggcaagatcttcgtgaagctggccacccagaagcagaagtccatgaaggtcatcctggaccgcctcatcaaccagacgtactcgaagggcgcgtgcatgatccacaagtacaagaacaagtggtacctctcaataacctacaagttcaacgcgatcaaggagaacaagttcgacaaggagcttatcatgggcatcgacatgggcgggatcaacacggtgtacttcgcgttcaacgaggggttcatccggtcgaacatcaagagcgacgagatcaagatgttcaacgagcgcatccgccagcgccggatcaacctcctcaagcagagcaagtattgctcgaactcccggacgggcaagggccggacgaagcgcctccagcccatcgacgtcctctccaacaagatcgccaagttccgcaacagcacgaaccacaagtacgcgaactacatcgtgaagcagtgcctcaagcacaactgcgggcgcatccagatggagctgctcaaggggatctccaagaacgacaagatcctcaaggactggacctacttcgacctccaggaaaagattaagaaccaggcggagatccacggcatcgaggtcatcaaggtggtgcccgcctacacctcccagcgctgctcgcagtgcggctacatctgcaaggagaaccggtgcacccaggccaccttcgagtgcaagcagtgcggctacaagacccacgcggactacaacgcggccaagaacctcagcacgtacgacatcgagaacatcatcaacaagcagctcgccgtccagtcgaagctgcacagcaagaagtgcatggaggagtacatcgaggagctgggctacctggactga

SEQ ID NO: 2192 - DNA, 1356 bp, Unknown
  Bacillus sp. multi
ctcggggtcacgatcaagatcatgaagtaccagatcctctgcccgatgaacgtggactggaccatcttcgagaagcacctccgcaacctgacctaccaagtccggacgatctccaaccgcaccatccagcagctctgggagttcgacgccctcagcttcgagtacttcaaggagcgcggcacgtacccgaccgtccaagacctctacggctgcacccagaagaagatcgacggctacatctaccacaccctccagagcaagtacccggacatccacaagggcaacatgagcacgacgctccagaagatcatcaagacctggaagtcccgccgcaacgagatccgcaagggcgagatgtccatcccgtcgttccgcaaccgcatccccatcgacctgcacaacaactcggtggacatcatcaaggagaagaacggggactacatcgccgggatctccctgttcagccgcgacttccacaaggagaacggcgacgtgccgaagggcaagatattcgtgaagctggcgacgcagaagcagaagtccatgaaggtgatcctcgaccgcctcatcaaccagacgtacagcaagggcgcgtgcatgatccacaagtacaagaacaagtggtatctttcgataacctacaagttcaacgccatcaaggagaacaagttcgacaaggagttgataatgggcatcgacatgggcggcatcaacaccgtgtacttcgcgttcaacgaggggttcatccggtccaacatcaagtcggacgagatcaagatgttcaacgagcgcatccggcagcggcgcatcaacctcctcaagcagtccaagtattgttcgaactcccgcaccggcaagggccgcacgaagcgcctccagcccatcgacgtgctgtcgaacaagatcgccaagttccgcaactccacgaaccacaagtacgcgaactacatcgtcaagcagtgcctcaagcacaactgcgggcgcatccagatggagctgctcaagggcatcagcaagaacgacaagatcctcaaggactggacctacttcgacctccaggagaagattaagaaccaggcggagatccacgggatcgaggtcatcaaggtggtccccgcctacaccagccagcggtgcagccagtgcggctacatctgcaaggagaaccgctgcacccaggccacgttcgagtgcaagcagtgcggctacaagacccacgccgactacaacgcggccaagaacctgagcacgtacgacatcgagaacatcatcaacaagcagctcgcggtgcagtccaagctccactccaagaagtgcatggaggagtacatcgaggagctgggctacctcgactga

SEQ ID NO: 2193 - DNA, 1356 bp, Unknown
  Bacillus sp. multi
ctcggcgtcacgatcaagatcatgaagtaccagatcctctgcccgatgaacgtggactggaccatcttcgagaagcacctccggaacctgacctaccaagtgcggacgatctccaaccggaccatccagcagctctgggagttcgacgcgctgtccttcgagtatttcaaggagcgcggcacgtacccgaccgtccaagacctctacggctgcacgcaaaagaaaatcgacggctacatctaccacaccctccagagcaagtaccccgacatccacaagggcaacatgagcacgaccctccagaagatcatcaagacctggaagtcccggcggaacgagatccgcaagggcgagatgagcatcccctccttccgcaaccgcatccccatcgacctgcacaacaactccgtggacatcatcaaggagaagaatggcgactacatcgcggggatcagcctgttcagccgcgacttccacaaggagaacggcgacgtgccgaagggcaagatattcgtgaagctggccacccagaagcagaagtccatgaaggtgatcctcgaccggctcatcaaccagacgtactcgaagggcgcgtgcatgatccacaagtacaagaacaagtggtacctcagtatcacgtacaagttcaacgccatcaaggagaacaagttcgacaaggagctaatcatggggatcgacatgggcgggatcaacacggtgtacttcgccttcaacgagggcttcatccggagcaacatcaagagcgacgagatcaagatgttcaacgagcgcatccggcagcggcgcatcaacctgctcaagcagagcaagtattgctcgaactcgcgcaccgggaagggccgcaccaagcgcctccagcccatcgacgtgctgagcaacaagatcgccaagttccgcaactccacgaaccacaagtacgccaactacatcgtcaagcagtgcctcaagcacaactgcgggcgcatccagatggagctgctcaagggcatcagcaagaacgacaagatcctcaaggactggacgtacttcgacctccaggagaaaatcaagaaccaggcggagatccacgggatcgaggtcatcaaggtcgtgcccgcctacacctcccagcgctgctcgcagtgcgggtacatctgcaaggagaaccggtgcacccaggccacgttcgagtgcaagcagtgcgggtacaagacgcacgcggactacaacgcggccaagaacctcagcacctacgacatcgagaacatcatcaacaagcagctcgccgtgcagtcgaagctgcacagcaagaagtgcatggaggagtacatcgaggagctgggctacctcgactga

SEQ ID NO: 2194 - DNA, 1356 bp, Unknown
  Bacillus sp. multi
ctcggcgtcaccatcaagatcatgaagtaccagatcctctgcccgatgaacgtggactggacgatcttcgagaagcacctccgcaacctcacgtaccaagttcggacgatcagcaaccgcacgatccagcagctctgggagttcgacgccctcagcttcgaatacttcaaggagcgcgggacgtaccccacggtccaggacctgtacggctgcacccagaagaagatagacggctacatctaccacaccctccagtcgaagtaccccgacatccacaagggcaacatgagcaccaccctccagaaaatcatcaagacctggaagtcgcgccggaacgagatccgcaagggcgagatgtccatcccgtccttccgcaaccgcatccccatcgacctgcacaacaacagcgtggacatcatcaaggagaagaacggggactacatcgcggggatcagcctgttctcgcgggacttccacaaggagaacggcgacgtcccgaagggcaagatattcgtcaagctggccacccagaagcagaagtccatgaaggtcatcctcgaccgcctcatcaaccagacgtacagcaagggcgcgtgcatgatccacaagtacaagaacaagtggtatctgtcgataacctacaagttcaacgccatcaaggagaacaagttcgacaaggaactcatcatgggcatcgacatgggcgggatcaacaccgtgtacttcgcgttcaacgaggggttcatccggagcaacatcaagagcgacgagatcaagatgttcaacgagcgcatccgccagcggcggatcaacctcctcaagcagagcaagtattgctccaactcccgcaccggcaaggggcgcacgaagcgcctccagcccatcgacgtgctctcgaacaagatcgccaagttccgcaacagcacgaaccacaagtacgccaactacatcgtcaagcagtgcctcaagcacaactgcgggcgcatccagatggagctgctcaagggcatctccaagaacgacaagatcctcaaggactggacctacttcgacctccaggagaagatcaagaaccaggcggagatccacggcatcgaggtcatcaaggtcgtgcccgcctacacgagccagcgctgctcccagtgcgggtacatctgcaaggagaaccgctgcacccaggccaccttcgagtgcaagcagtgcgggtacaagacccacgcggactacaacgccgccaagaacctgtccacctacgacatcgagaacatcatcaacaagcagctcgcggtgcagagcaagctccactccaagaagtgtatggaggagtacatcgaggagctgggctacctggactga

SEQ ID NO: 2195 - DNA, 1335 bp, Unknown
  Bacillus sp. multi
atgaagtaccagatcctctgccccatgaacgtggactggatcatcttcgagaagcacctccgcaacctcacctaccaagtgcggacgatctccaaccgcaccatccagcagctctgggagttcgacgccctcagcttcgactacttcaaggcgcgcgggacgtaccccaccgtccaagatctttacggcggcacgcagaagaaaatagacgggtacatctaccacaccctccagagcaagtaccccgacatccacaagggcaacatgagcaccacgctccagaaaatcatcaagacctggaagtcccgccggaacgagatccggaagggcgagatgagcatcccgagcttccggaaccgcatccccatcgacatccacaacaactccgtggacatcacgaaggagaagaacggcgactacatcgcggggatcagcctgttcagccgcgacttccacaaggagaacggcgacgtgccgaagggcaaaatcttcgtgaagctggccacgcagaagcagaagtccatgaaggtcatcctggaccggctcatcaaccagacgtacagcaagggcgcgtgcatgatccacaagtacaagaacaagtggtacttgtcgatcacctacaagttcaacgcgctcaaggagaacaagttcgacaaggagcttatcatggggatcgacatgggcggcatcaacacggtgtacttcgcgttcaacgagggcttcatccggaacaacatcaagagcgaggagatcaagatgttcaacgagcgcatccgccagcggcggatcaacctcctcaagcagtccacgtactgctccaactcccgcacgggcaagggccgcaccaagcgcctccagcccatcgacgtcctgtccaacaagatcgccaagttccgcaactccacgaaccacaagtacgccaactacatcatcaagcagtgcctcaagcacaactgcgggcgcatccagatggagctgctcaaggggatcagcaagaacgacaagatcctcaaggactggacctacttcgacctccaggagaagatcaagaatcaggcggagatccacgggatcgaggtcatcaaggtcgcgcccgcctacaccagccagcggtgcagccagtgcggctacatctgcaaggagaaccggtgcacccaggccatgttcgagtgcaagcagtgcggctacaagacgcacgcggactacaacgcggccaagaacatcgccacctacgacatcgagaacatcatcaacaagcagctcgcggtgcagagcaagctgcactccaagaaatgcatggaggagtacatcgaggagctgggctacctggactga

SEQ ID NO: 2196 - DNA, 1335 bp, Unknown
  Bacillus sp. multi
atgaagtaccagatcctctgcccgatgaacgtggactggatcatcttcgagaagcacctccggaacctcacgtaccaggtccggacgatcagcaaccgcaccatccagcagctctgggagttcgacgcgctcagcttcgactacttcaaggcgcgcggcacgtacccgacggtccaagacctctacggcggcacccagaagaaaatcgacgggtacatctaccacaccctccagagcaagtaccccgacatccacaagggcaacatgagcaccaccctccagaaaatcatcaagacctggaagtcgcgccgaaacgagatccgcaagggcgagatgagcatccccagcttccgcaaccgcatccccatcgacatccacaacaacagcgtggacatcacgaaggagaagaatggggactacatcgcggggatcagcctgttcagccgtgacttccacaaggagaacggggacgtgccgaagggcaagatattcgtgaagctggccacccagaagcagaagtccatgaaggtcatcctggaccgcctcatcaaccagacgtacagcaagggcgcgtgcatgatccacaagtacaagaacaagtggtatttgtcaatcacctacaagttcaacgccctcaaggagaacaagttcgacaaggagcttatcatggggatcgacatgggcgggatcaacaccgtgtacttcgccttcaacgaggggttcatccggaacaacatcaagtccgaggagatcaagatgttcaacgagcgcatccgccagcgccggatcaacctcctcaagcagagcacgtactgctcgaactcgcgcaccgggaagggccggaccaagcgcctccagcccatcgacgtgctgtcgaacaagatcgccaagttccgcaacagcaccaaccacaagtacgcgaactacatcatcaagcagtgcctcaagcacaactgcgggcgcatccagatggagctgctcaaggggatcagcaagaacgacaagatcctcaaggactggacctacttcgacctccaggagaaaatcaagaaccaggccgagatccacggcatcgaggtcatcaaggtcgccccggcctacaccagccagcgctgctcgcagtgcggctacatctgcaaggagaaccgctgcacccaggccatgttcgagtgcaagcagtgcggctacaagacccacgcggactacaacgccgccaagaacatcgccacctacgacatcgagaacatcatcaacaagcagctcgcggtgcagtcgaagctgcacagcaagaagtgcatggaggagtacatcgaggagctgggctacctggactga

SEQ ID NO: 2197 - DNA, 1335 bp, Unknown
  Bacillus sp. multi
atgaagtaccagatcctctgccccatgaacgtggactggatcatcttcgagaagcacctccgcaacctgacctaccaagtgcggacgatctcgaaccgcaccatccagcagctctgggagttcgacgccctgtccttcgactacttcaaggcgcggggcacgtacccgacggtccaggatctctacggcggcacccagaagaaaattgacggctacatctaccacaccctccagagcaagtaccccgacatccacaaggggaacatgagcaccacgctccagaagattatcaagacctggaagtcgcggcgcaacgagatccggaagggcgagatgtccatccccagcttccggaaccgcatccccatcgacatccacaacaactccgtggacatcacgaaggagaagaatggcgactacatcgcggggatcagcctgttctcgcgggacttccacaaggagaacggggacgtgccgaagggcaaaatcttcgtgaagctggcgacccagaagcagaagtccatgaaggtcatcctcgaccgcctcatcaaccagacctacagcaagggcgcgtgcatgatccacaagtacaagaacaagtggtacttgtctatcacctacaagttcaacgccctcaaggagaacaagttcgacaaggaactgattatgggcatcgacatgggcggcatcaacacggtgtacttcgcgttcaacgagggcttcatccgcaacaacatcaagagcgaggagatcaagatgttcaacgagcgcatccggcagcggcgcatcaacctcctcaagcagtccacctactgctccaactcgcgcacggggaaggggcgcaccaagcgcctccagcccatcgacgtcctcagcaacaagatcgccaagttccgcaacagcaccaaccacaagtacgcgaactacatcatcaagcagtgcctcaagcacaactgcgggcgcatccagatggagctgctcaaggggatctccaagaacgacaagatcctcaaggactggacctacttcgacctccaggagaaaatcaagaaccaggccgagatccacgggatcgaggtcatcaaggtcgccccggcctacaccagccagcgctgctcccagtgcgggtacatctgcaaggagaaccgctgcacccaggccatgttcgagtgcaagcagtgcgggtacaagacccacgcggactacaacgcggccaagaacatcgccacctacgacatcgagaacatcatcaacaagcagctcgccgtgcagtccaagctccacagcaagaagtgcatggaggagtacatcgaggagctgggctacctggactga

SEQ ID NO: 2198 - DNA, 1335 bp, Unknown
  Bacillus sp. multi
atgaagtaccagatcctctgcccgatgaacgtggactggatcatcttcgagaagcacctccggaacctcacctaccaagtccggacgatctccaaccgcacgatccagcagctctgggagttcgacgcgctgtcgttcgactacttcaaggcgcgcggcacctaccccacggtccaagatctctacggcggcacccagaagaaaatagacggctacatctaccacaccctccagtcgaagtaccccgacatccacaagggcaacatgagcaccaccctccagaaaatcattaagacctggaagtcccgccgcaacgagatccgcaagggcgagatgtccatcccgagcttccgcaaccgcatccccatcgacatccacaacaactcggtggacatcacgaaggagaagaatggcgactacatcgcggggatcagcctgttcagccgcgacttccacaaggagaacggggacgtgccgaagggcaagatcttcgtcaagctggcgacccagaagcagaagtccatgaaggtgatcctcgaccgcctcatcaaccagacctacagcaagggcgcgtgcatgatccacaagtacaagaacaagtggtatctgagcatcacctacaagttcaacgcgctcaaggagaacaagttcgacaaggaactgataatgggcatcgacatgggcggcatcaacaccgtgtacttcgcgttcaacgaggggttcatccggaacaacatcaagtcggaggagatcaagatgttcaacgagcgcatccggcagcgccgcatcaacctgctcaagcagagcacctactgctccaacagccggacggggaaggggcgcaccaagcgcctccagcccatcgacgtcctctcgaacaagatcgccaagttccgcaactccacgaaccacaagtacgccaactacatcatcaagcagtgcctcaagcacaactgcgggcgcatccagatggagctgctcaagggcatcagcaagaacgacaagatcctcaaggactggacctacttcgacctccaggaaaagatcaagaaccaggcggagatccacgggatcgaggtcatcaaggtcgcgcccgcctacaccagccagcgctgctcccagtgcggctacatctgcaaggagaaccgctgcacccaggccatgttcgagtgcaagcagtgcggctacaagacgcacgcggactacaacgccgccaagaacatcgccacctacgacatcgagaacatcatcaacaagcagctcgcggtgcagtccaagctgcacagcaagaagtgcatggaggagtacatcgaggagctgggctacctcgactag

SEQ ID NO: 2199 - DNA, 1335 bp, Unknown
  Bacillus sp. multi
atgaagtaccagatcctctgccccatgaacgtggactggatcatcttcgagaagcacctccgcaacctcacgtaccaagtgcggacgatctccaaccgcacgatccagcagctctgggagttcgacgccctgagcttcgactacttcaaggcgcggggcacgtaccccacggtccaggatctctacggcggcacccagaagaaaatagacggctacatctaccacaccctccagtcgaagtaccccgacatccacaaggggaacatgagcaccacgctccagaaaatcatcaagacctggaagtcccggcgcaacgagatccgcaagggcgagatgtccatcccctcgttccgcaaccgcatccccatcgacatccacaacaacagcgtggacatcacgaaggagaagaacggcgactacatcgcgggcatctccctgttctcccgcgacttccacaaggagaacggggacgtgccgaagggcaaaatcttcgtcaagctggccacccagaagcagaagtccatgaaggtcatcctggaccggctcatcaaccagacctacagcaagggcgcgtgcatgatccacaagtacaagaacaagtggtatctttcgatcacctacaagttcaacgccctcaaggagaacaagttcgacaaggaactgattatgggcatcgacatgggcggcatcaacaccgtgtacttcgcgttcaacgagggcttcatccgcaacaacatcaagtcggaggagatcaagatgttcaacgagcgcatccggcagcggcggatcaacctgctcaagcagtccacgtactgctccaactcccggacggggaagggccgcacgaagcgcctccagcccatcgacgtgctctcgaacaagatcgccaagttccgcaacagcaccaaccacaagtacgcgaactacatcatcaagcagtgcctcaagcacaactgcgggcgcatccagatggagctgctcaagggcatctccaagaacgacaagatcctcaaggactggacgtacttcgacctccaggagaagattaagaaccaggcggagatccacggcatcgaggtcatcaaggtcgccccggcctacacctcccagcggtgctcccagtgcggctacatctgcaaggagaaccggtgcacccaggccatgttcgagtgcaagcagtgcgggtacaagacccacgccgactacaacgccgccaagaacatcgccacctacgacatcgagaacatcatcaacaagcagctcgcggtccagagcaagctccacagcaagaaatgcatggaggagtacatcgaggagctgggctacctggactga

SEQ ID NO: 2200 - DNA, 1335 bp, Unknown
  Bacillus sp. multi
atgaagtaccagatcctctgcccgatgaacgtggactggaccatcttcgagaagcacctccgcaacctgacctaccaagtccggacgatctccaaccgcacgatccagcagctctgggagttcgacgcgctctcgttcgactacttcaaggcgcgcggcacgtacccgaccgtccaggacttgtacgggtgcacgcagaagaaaatcgacgggtacatctaccacaccctccagtcgaagtacccggacatccacaaggggaacatgagcacgacgctccagaagatcatcaagacctggaagtcccgccgcaacgagatccgcaagggcgagatgagcatcccgtccttccggaaccgcatccccatcgacctgcacaacaactccgtggacatcacgaaggagaagaatggcgactacatcgccgggatcagcctgttctcccgcgacttccacaaggagaacgacgacgtgccgaagggcaagatcttcgtcaagctggccaccaagaagcagaagtccatgaagatcatcctggaccggctgatgaaccagacgtactcgaagggcgcgtgcatgatccacaagtacaagaacaagtggtacctgtccatcacctacaagttcaacgcgatcaaggagaacaagttcgacaaggaactgatcatgggcatcgacatgggcgggatcaacaccatctacttcgcgttcaacgagggcttcatccgctccaacatcaagtcggacgagatcaagaccttcaacgagcgcatccgccagcgccgcatcaacctgctgaaccagagcaaatactgttccaacagccgcaccggcaaggggcgcacgaagcggctccagcccatcgacgtcctgagcaacaagatcgccaagttccgcaacagcaccaaccacaagtacgcgaactacatcatcaagcagtgcctcaagcacaactgcgggcgcatccagatggagctgctcaagggcatctccaagaacgacaaggtgctcaaggactggacctacttcgacctccaggagaagatcaagaaccaggcggagatccacggcatcgaggtcatcaagatcgcgcccgcctacacctcgcagcggtgctcccagtgcggctacatctgcaaggagaaccgctgcacccaggacatgttcgagtgcaagcagtgcggctacaagacccacgccgactacaacgccgccaagaacatctcgacgtacggcatcgagaacatcatcaacaagcagctcgccgtgcagagcaagctgcacagcaagaagtgcatggaggagtacatcgagaagctgggctacctggactag

SEQ ID NO: 2201 - DNA, 1335 bp, Unknown
  Bacillus sp. multi
atgaagtaccagatcctctgcccgatgaacgtggactggaccatcttcgagaagcacctccgcaacctgacctaccaagtccggacgatcagcaaccggaccatccagcagctctgggagttcgacgcgctctcgttcgactacttcaaggcgcgcggcacctaccccaccgtccaagacctctacggctgcacgcagaagaagatcgacggctacatctaccacaccctccagtcgaagtacccggacatccacaaggggaacatgagcaccaccctccagaagatcatcaagacctggaagtcccgccggaacgagatccgcaagggcgagatgtccatcccgtccttccgcaaccgcatccccatcgacctccacaacaactccgtggacatcacgaaggagaagaacggcgactacatcgccgggatctccctgttctcgcgcgacttccacaaggagaacgacgacgtgccgaagggcaagatcttcgtgaagctggcgaccaagaagcagaagtcgatgaagatcatcctggaccggctcatgaaccagacgtacagcaagggcgcgtgcatgatccacaagtacaagaacaagtggtacttgtccatcacctacaagttcaacgccatcaaggagaacaagttcgacaaggaactcatcatgggcatcgacatgggcgggatcaacaccatctacttcgccttcaacgagggcttcatccgcagcaacatcaagtccgacgagatcaagacgttcaacgagcgcatccggcagcggcggatcaacctgctcaaccagagcaagtattgctcgaactcccgcaccggcaaggggcggaccaagcggctccagcccatcgacgtgctctcgaacaagatcgccaagttccgcaactccaccaaccacaagtacgccaactacatcatcaagcagtgcctcaagcacaactgcgggcgcatccagatggagctgctcaagggcatcagcaagaacgacaaggtgctcaaggactggacctacttcgacctccaggagaagattaagaaccaggccgagatccacggcatcgaggtcatcaagatcgccccggcctacaccagccagcggtgctcccagtgcggctacatctgcaaggagaaccgctgcacccaggatatgttcgagtgcaagcagtgcgggtacaagacccacgcggactacaacgccgccaagaacatcagcacgtacggcatcgagaacatcatcaacaagcagctcgccgtgcagtccaagctgcactccaagaagtgcatggaggagtacatcgagaagctgggctacctggactga

SEQ ID NO: 2202 - DNA, 1335 bp, Unknown
  Bacillus sp. multi
atgaagtaccagatcctctgccccatgaacgtggactggacgatcttcgagaagcacctccggaacctcacctaccaagtgcggacgatctccaaccggacgatccagcagctctgggagttcgacgccctcagcttcgactacttcaaggcgcgcggcacctacccgaccgtccaagacctgtacggctgcacccagaagaagatcgacgggtacatctaccacaccctccagagcaagtacccggacatccacaagggcaacatgagcacgacgctccagaagatcatcaagacctggaagtcccggcggaacgagatccgcaagggcgagatgtccatcccgtccttccgcaaccgcatccccatcgacctccacaacaacagcgtggacatcacgaaggagaagaacggggactacatcgccgggatctccctgttctcccgcgacttccacaaggagaacgacgacgtgccgaagggcaagattttcgtgaagctggccaccaagaagcagaagtccatgaagatcatcctggaccgcctgatgaaccagacctacagcaagggcgcgtgcatgatccacaagtacaagaacaagtggtacttgtccatcacgtacaagttcaacgccatcaaggagaacaagttcgacaaggagctgataatggggatcgacatgggcggcatcaacacgatctacttcgccttcaacgagggcttcatccgcagcaacatcaagagcgacgagatcaagaccttcaacgagcgcatccggcagcgccgcatcaacctcctgaaccagagcaagtactgttccaactcccgcaccgggaaggggcggaccaagcgcctccagcccatcgacgtgctgtcgaacaagatcgccaagttccgcaacagcaccaaccacaagtacgccaactacatcatcaagcagtgcctcaagcacaactgcgggcgcatccagatggagctgctcaagggcatctccaagaacgacaaggtgctcaaggactggacctacttcgacctccaggagaagatcaagaaccaggccgagatccacggcatcgaggtcatcaagatcgcgcccgcctacacctcccagcggtgctcgcagtgcggctacatctgcaaggagaaccggtgcacccaggatatgttcgagtgcaagcagtgcgggtacaagacccacgccgactacaacgcggccaagaacatctccacctacgggatcgagaacatcatcaacaagcagctcgcggtccagagcaagctccacagcaagaagtgcatggaggagtacatcgagaagctgggctacctcgactga

SEQ ID NO: 2203 - DNA, 1335 bp, Unknown
  Bacillus sp. multi
atgaagtaccagatcctctgccccatgaacgtggactggacgatcttcgagaagcacctccgcaacctcacctaccaggtccggacgatctcgaaccggaccatccagcagctctgggagttcgacgccctcagcttcgactacttcaaggcgcgcggcacgtacccgaccgtccaagacctctacggctgcacgcagaagaagattgacggctacatctaccacaccctccagagcaagtacccggacatccacaaggggaacatgagcacgacgctccagaagatcatcaagacctggaagtcccggcggaacgagatccggaagggcgagatgtcgatcccgagcttccggaaccgcatccccatcgacctgcacaacaactccgtggacatcacgaaggagaagaatggcgactacatcgcgggcatctccctcttcagccgcgacttccacaaggagaacgacgacgtgccgaagggcaagatcttcgtaaagctggcgaccaagaagcagaagtccatgaagatcatcctggaccggctgatgaaccagacctactcgaagggcgcgtgcatgatccacaagtacaagaacaagtggtacctctccatcacctacaagttcaacgccatcaaggagaacaagttcgacaaggagctgataatggggatcgacatgggcgggatcaacacgatctacttcgccttcaacgagggcttcatccggtccaacatcaagagcgacgagatcaagacgttcaacgagcgcatccggcagcgccggatcaacctgctgaaccagagcaagtattgctcgaactcccgcaccggcaagggccgcaccaagcgcctccagcccatcgacgtcctgtccaacaagatcgccaagttccgcaactcgacgaaccacaagtacgcgaactacatcatcaagcagtgcctcaagcacaactgcgggcgcatccagatggagctgctcaaggggatcagcaagaacgacaaggtgctcaaggactggacgtacttcgacctccaggagaagatcaagaaccaggcggagatccacggcatcgaggtcatcaagatcgcgcccgcctacacgagccagcgctgctcccagtgcggctacatctgcaaggagaaccgctgcacccaggatatgttcgagtgcaagcagtgcgggtacaagacgcacgcggactacaacgccgccaagaacatctcgacctacgggatcgagaacatcatcaacaagcagctcgcggtgcagtccaagctccactccaagaagtgcatggaggagtacatcgagaagctgggctacctggactag

SEQ ID NO: 2204 - DNA, 1335 bp, Unknown
  Bacillus sp. multi
atgaagtaccagatcctctgcccgatgaacgtggactggacgatcttcgagaagcacctccggaacctgacctaccaggtgcggacgatcagcaaccgcaccatccagcagctctgggagttcgacgcgctcagcttcgactacttcaaggcgcgcgggacgtaccccaccgtccaagacctctacgggtgcacgcagaagaagatcgacgggtacatctaccacacgctccagtcgaagtaccccgacatccacaaggggaacatgagcacgaccctccagaaaatcatcaagacctggaagtcgcgccggaacgagatccgcaagggcgagatgtcgatcccgtcgttccgcaaccgcatccccatcgacctccacaacaactccgtggacatcacgaaggagaagaacggcgactacatcgcggggatctcgctgttcagccgggacttccacaaggagaacgacgacgtgccgaagggcaaaatcttcgtgaagctggccaccaagaaacagaagtccatgaagatcatcctggaccggctgatgaaccagacctacagcaagggcgcgtgcatgatccacaagtacaagaacaagtggtacctgagcatcacctacaagttcaacgccatcaaggagaacaagttcgacaaggagttgatcatggggatcgacatgggcggcatcaacacgatctacttcgccttcaacgaggggttcatccggtccaacatcaagtccgacgagatcaagaccttcaacgagcgcatccggcagcgccggatcaacctcctgaaccagagcaaatactgctccaacagccgcaccggcaaggggcgcaccaagcgcctccagcccatcgacgtcctctccaacaagatcgccaagttccgcaactccaccaaccacaagtacgcgaactacatcatcaagcagtgcctcaagcacaactgcgggcgcatccagatggagctgctcaagggcatctccaagaacgacaaggtgctcaaggactggacctacttcgacctccaggagaagatcaagaaccaggccgagatccacgggatcgaggtcatcaagatcgccccggcctacaccagccagcggtgctcccagtgcgggtacatctgcaaggagaaccgctgcacccaggatatgttcgagtgcaagcagtgcgggtacaagacgcacgcggactacaacgcggccaagaacatctcgacgtacggcatcgagaacatcatcaacaagcagctcgcggtgcagagcaagctccactccaagaagtgcatggaggagtacatcgagaagctcggctacctcgactga

SEQ ID NO: 2205 - DNA, 1356 bp, Unknown
  Bacillus sp. multi
ctcggcgtcaccatcaagatcatgaagtaccagatcctctgccccatgaacgtggactggaccatcttcgagaagcacctccgcaacctgacctaccaagtccggacgatcagcaaccgcaccatccagcagctctgggagttcgacgccctgagcttcgactacttcaaggcgcggggcacgtaccccaccgtccaggacttgtacgggtgcacgcagaagaagattgacgggtacatctaccacaccctccagtcgaagtaccccgacatccacaaggggaacatgagcaccacgctccagaaaatcatcaagacctggaagtcccgccgcaacgagatccgcaagggcgagatgtccatcccctccttccggaaccgcatccccatcgacctgcacaacaacagcgtcgagatcacgaaggagaagaatggcgactacatcgcggggatctcgctgttctcgcgcgacttccacaaggagaacggcgacgtcccgaagggcaaaatcttcctcaagctcgggacgcagaagcagaagtccatgaaggtgatcctggaccgcctcatcaaccagacctactcgaagggcgcgtgcatgatccacaagtacaagaacaagtggtatctcagcatcacctacaagttcaacgccatcaaggagaacaagttcgacaaggagctgataatgggcatcgacatgggcggcatcaacaccgtgtacttcgcgttcaacgagggcttcatccggtccaacatcaagtccgacgagatcaaggcgttcaacgagaaaatccgccagcggcgcatcaacctcctcaagcagtccaactactgctccaactcccgcacgggcaagggccgggccaagcggctccagcccatcgacgtgctgtcgaacaagatcgccaagttccgcaacagcacgaaccacaagtacgcgaactacatcatcaagcagtgcctcaagcacaactgcgggcgcatccagatcgaactgctcaaggggatcagcaagaacgacaaggtgctcaaggactggacgtacttcgacctccaggagaaaatcaagaatcaggccgagatccacgggatcgaggtcatcaaggtcgccccggcctacacctcccagcggtgcagccagtgcgggtacatctgcaaggagaaccggtgcacccaggccatgttcgagtgcaagcagtgcggctacaagacccacgcggactacaacgcggccaagaacatctccacctacgacatcgagaacatcatcaacaagcagctcgccgtgcagagcaagctccacagcaagaagtgtatggaggagtacatcgaggagctgggctacctggactga

SEQ ID NO: 2206 - DNA, 1356 bp, Unknown
  Bacillus sp. multi
ctcggcgtgaccatcaagatcatgaagtaccagatcctctgcccgatgaacgtggactggacgatcttcgagaagcacctccgcaacctgacgtaccaagtccggacgatctccaaccgcaccatccagcagctctgggagttcgacgcgctgagcttcgactacttcaaggcgcggggcacctaccccaccgtccaggatctctacgggtgcacgcaaaagaaaatcgacgggtacatctaccacaccctccagagcaagtaccccgacatccacaagggcaacatgagcaccaccctccagaagatcatcaagacctggaagtcccggcgcaacgagatccgcaagggcgagatgtcgatccccagcttccgcaaccgcatccccatcgacctgcacaacaactccgtggagatcacgaaggagaagaacggcgactacatcgcgggcatctcgctgttcagccgcgacttccacaaggagaacggcgacgtcccgaagggcaagatatttctcaagctcgggacgcagaagcagaagtcgatgaaggtgatcctcgaccgcctcatcaaccagacctacagcaagggcgcgtgcatgatccacaagtacaagaacaagtggtatcttagcatcacctacaagttcaacgcgatcaaggagaacaagttcgacaaggagctcataatgggcatcgacatgggcggcatcaacacggtgtacttcgccttcaacgaggggttcatccgctcgaacatcaagagcgacgagatcaaggcgttcaacgagaagatccgccagcggcgcatcaacctcctcaagcagagcaactactgctccaactcccggacggggaaggggcgggcgaagcgcctccagcccatcgacgtgctgtccaacaagatcgccaagttccgcaacagcaccaaccacaagtacgccaactacatcatcaagcagtgcctcaagcacaactgcgggcgcatccagatcgagctgctcaaagggatcagcaagaacgacaaggtgctcaaggactggacgtacttcgacctccaggagaagattaagaatcaggcggagatccacgggatcgaggtcatcaaggtcgccccggcctacacctcccagcggtgctcgcagtgcggctacatctgcaaggagaaccgctgcacccaggccatgttcgagtgcaagcagtgcgggtacaagacccacgccgactacaacgcggccaagaacatcagcacctacgacatcgagaacatcatcaacaagcaactggccgtgcagtcgaagctgcactccaagaagtgcatggaggagtacatcgaggagctgggctacctcgactga

SEQ ID NO: 2207 - DNA, 1356 bp, Unknown
  Bacillus sp. multi
ctcggcgtcaccatcaagatcatgaagtaccagatcctctgcccgatgaacgtggactggacgatcttcgagaagcacctccgcaacctgacctaccaagtccggacgatctcgaaccgcaccatccagcagctctgggagttcgacgccctctcgttcgactacttcaaggcgcgcggcacgtaccccaccgtccaagacctctacggctgcacgcagaagaagattgacggctacatctaccacacgctccagagcaagtaccccgacatccacaagggcaacatgagcacgaccctccagaaaatcatcaagacctggaagtcccgccgcaacgagatccgcaagggcgagatgtccatccccagcttccgcaaccgcatccccatcgacctccacaacaactccgtcgagatcacgaaggagaagaacggcgactacatcgcggggatctcgctgttctcccgcgacttccacaaggagaacggcgacgtcccgaagggcaagatattcctcaagctcggcacgcagaagcagaagtccatgaaggtcatcctcgaccgcctcatcaaccagacctactcgaagggcgcgtgcatgatccacaagtacaagaacaagtggtacctgagcatcacctacaagttcaacgccatcaaggagaacaagttcgacaaggagcttatcatgggcatcgacatgggcggcatcaacacggtgtacttcgccttcaacgagggcttcatccgctccaacatcaagtcggacgagatcaaggcgttcaacgaaaagatccggcagcgccggatcaacctcctcaagcagtccaactactgctcgaactcccgcaccggcaagggccgggcgaagcggctccagcccatcgacgtgctgtcgaacaagatcgccaagttccgcaacagcaccaaccacaagtacgccaactacatcatcaagcagtgcctcaagcacaactgcgggcgcatccagattgaactcctgaaggggatctccaagaacgacaaggtgctcaaggactggacctacttcgacctccaggagaagatcaagaaccaggcggagatccacggcatcgaggtcatcaaggtcgccccggcctacacgagccagcgctgctcccagtgcgggtacatctgcaaggagaaccggtgcacccaggccatgttcgagtgcaagcagtgcgggtacaagacccacgcggactacaacgccgccaagaacatctccacctacgacatcgagaacatcatcaacaaacaacttgcagtgcagtcgaagctgcactccaagaagtgcatggaggagtacatcgaggagctgggctacctggactga

SEQ ID NO: 2208 - DNA, 1356 bp, Unknown
  Bacillus sp. multi
ctcggggtgacgatcaagatcatgaagtaccagatcctctgcccgatgaacgtggactggaccatcttcgagaagcacctccgcaacctcacctaccaggtccggacgatctcgaaccggaccatccagcagctctgggagttcgacgcgctgagcttcgactacttcaaggcgcggggcacctaccccaccgtccaagacctgtacgggtgcacgcagaagaagatcgacgggtacatctaccacaccctccagtcgaagtacccggacatccacaaggggaacatgagcacgaccctccagaaaatcatcaagacctggaagtcccgccgcaacgagatccgcaagggcgagatgagcatcccctcgttccgcaaccgcatccccatcgacctccacaacaactccgtggagatcacgaaggagaagaatggcgactacatcgccgggatcagcctcttcagccgcgacttccacaaggagaacggcgacgtcccgaagggcaagatattcctcaagctggggacgcagaagcagaagtccatgaaggtgatcctggaccgcctcatcaaccagacgtacagcaagggcgcgtgcatgatccacaagtacaagaacaagtggtatcttagcatcacctacaagttcaacgccatcaaggagaacaagttcgacaaggagcttatcatgggcatcgacatgggcggcatcaacacggtgtacttcgccttcaacgagggcttcatccgcagcaacatcaagagcgacgagatcaaggcgttcaacgagaaaatccggcagcgccgcatcaacctgctcaagcagtccaactactgctccaactcgcggacgggcaaggggcgggcgaagcgcctccagcccatcgacgtcctcagcaacaagatcgccaagttccgcaactccacgaaccacaagtacgcgaactacatcatcaagcagtgcctcaagcacaactgcgggcgcatccagattgagctactcaaggggatctccaagaacgacaaggtgctcaaggactggacgtacttcgacctccaggagaagattaagaaccaggcggagatccacggcatcgaggtcatcaaggtggccccggcctacacgagccagcggtgcagccagtgcggctacatctgcaaggagaaccgctgcacccaggccatgttcgagtgcaagcagtgcgggtacaagacgcacgcggactacaacgccgccaagaacatcagcacgtacgacatcgagaacatcatcaacaagcagttggcggtgcagtccaagctccactccaagaaatgcatggaggagtacatcgaggagctgggctacctggactag

SEQ ID NO: 2209 - DNA, 1356 bp, Unknown
  Bacillus sp. multi
ctgggcgtgaccatcaagatcatgaagtaccagatcctctgcccgatgaacgtggactggaccatcttcgagaagcacctccggaacctgacgtaccaagtccggacgatctccaaccggaccatccagcagctctgggagttcgacgcgctcagcttcgactacttcaaggcgcggggcacgtaccccaccgtccaggacctatacggctgcacgcagaagaagatcgacggctacatctaccacacgctccagagcaagtaccccgacatccacaaggggaacatgagcacgacgctccagaaaatcatcaagacctggaagtcccgccggaacgagatccgcaagggcgagatgtcgatcccgtccttccgcaaccgcatccccatcgacctccacaacaacagcgtcgagatcacgaaggagaagaacggcgactacatcgcggggatctccctgttctcccgcgacttccacaaggagaacggcgacgtgccgaagggcaagatcttcctcaagctcggcacgcagaagcagaagtccatgaaggtgatcctggaccgcctcatcaaccagacctacagcaagggcgcgtgcatgatccacaagtacaagaacaagtggtatctcagcatcacctacaagttcaacgccatcaaggagaacaagttcgacaaggagctgataatgggcatcgacatgggcgggatcaacaccgtgtacttcgcgttcaacgagggcttcatccggtcgaacatcaagtccgacgagatcaaggcgttcaacgagaagatccggcagcgccggatcaacctgctcaagcagagcaactactgctccaacagccgcacgggcaaggggcgggcgaagcgcctccagcccatcgacgtcctgagcaacaagatcgccaagttccgcaacagcacgaaccacaagtacgcgaactacatcatcaagcagtgcctcaagcacaactgcgggcgcatccagattgaattgttaaaggggatctccaagaacgacaaggtgctcaaggactggacctacttcgacctccaggagaagattaagaaccaggccgagatccacgggatcgaggtcatcaaggtcgcgcccgcctacaccagccagcggtgctcccagtgcgggtacatctgcaaggagaaccgctgcacccaggcgatgttcgagtgcaagcagtgcggctacaagacccacgccgactacaacgccgccaagaacatctcgacgtacgacatcgagaacatcatcaacaaacaactcgcggtgcagagcaagctccactccaagaagtgcatggaggagtacatcgaggagctgggctacctcgactga

SEQ ID NO: 2210 - DNA, 1338 bp, Unknown
  Bacillus sp. multi
ctgggcgtgaccatcaagatcatgaagtaccagatcctctgcccgctcaacgtggactggaccatcttcgagaagcacctccgcaacctgacgtaccaggtccggacgatcagcaaccgcaccatccagcagctctgggagttcgacgcgctgtcgttcgactacttcaaggagcggggcacgtaccccaccgtccaagatctgtacggctgcacgcagaagaagattgacgggtacatctaccacaccctccagagcaagtacccggacatccacaaggggaacatgagcaccaccctccagaaaatcatcaagacctggaagtcccgccggaacgagatccggaagggcgagatgagcatcccctccttccgcaaccgcatccccatcgacctccacaacaacagcgtggacatcacgaaggagaagaatggggactacatcgcggggatctcgctgttcagccgcgacttccacaaggagaacgacgacgtgccgaagggcaaaatcttcgttaagctggccacccagaagcagaagtccatgaaggtcatcctcgaccgcctcatcaaccagacgtacagcaagggcgcgtgcatgatccacaagtacaagaacaagtggtatcttagcatcacctacaagttcaacgccatcaaggagaacaagttcgacaaggaactgataatgggcatcgacctcggcggcatcaacaccgtgtacttcgccttcaacgagggcttcatccggagcaacatcaagtcggacgagatcatccggcagcgccgcatcaacctgctcaagcagtccaagtattgttccaactcccggacgggcaagggccggaccaagcggctccagcccatcgacgtcctcagcaacaagatcgccaagttccgcaactccaccaaccacaagtacgcgaactacatcgtcaagcagtgcctcaagcacaactgcgggcgcatccagatggagctgctcaaggggatctccaagaacgaccgcatcctcaaggactggacctacttcgacctccaggagaaaatcaagaaccaggcggagatccacggcatcgaggtcatcaaggtcgccccggcctacacctcccagcggtgctcgcagtgcgggtacatctgcaaggagaaccggtgcacccaggccatgttcgagtgcaagcagtgcgggtacaagacgcacgcggactacaacgcggccaagaacatcagcacgtacgacatcgagaacatcatcaacaagcagctcgcggtccagagcaagctccacagcaagaaatgcatggaggagtacatcgaggagctgggctacctggactag

SEQ ID NO: 2211 - DNA, 1338 bp, Unknown
  Bacillus sp. multi
ctcggcgtcacgatcaagatcatgaagtaccagatcctctgcccgctgaacgtggactggaccatcttcgagaagcacctccgcaacctcacctaccaagtgcggacgatctccaaccggacgatccagcagctctgggagttcgacgcgctctcgttcgactacttcaaggagcgcggcacctaccccaccgtccaggacttatacggctgcacgcagaagaaaatagacggctacatctaccacaccctccagagcaagtacccggacatccacaagggcaacatgagcaccacgctccagaaaatcatcaagacctggaagtcccggcgcaacgagatccggaagggcgagatgagcatccccagcttccgcaaccgcatccccatcgacctccacaacaacagcgtggacatcacgaaggagaagaacggggactacatcgcggggatcagcctcttcagccgcgacttccacaaggagaacgacgacgtgccgaagggcaaaatcttcgtcaagctcgccacgcagaagcagaagtccatgaaggtgatcctcgaccgcctcatcaaccagacctacagcaagggcgcgtgcatgatccacaagtacaagaacaagtggtacctgagcatcacctacaagttcaacgccatcaaggagaacaagttcgacaaggaacttattatggggatcgacctcggcggcatcaacaccgtgtacttcgccttcaacgagggcttcatccggagcaacatcaagagcgacgagatcatccggcagcgccgcatcaacctcctcaagcagtccaagtattgttccaactcccggacgggcaaggggcggaccaagcgcctccagcccatcgacgtgctctccaacaagatcgccaagttccgcaacagcaccaaccacaagtacgcgaactacatcgtcaagcagtgcctcaagcacaactgcgggcgcatccagatggagctgctcaagggcatctccaagaacgaccgcatcctcaaggactggacctacttcgacctccaggagaagattaagaatcaggcggagatccacggcatcgaggtcatcaaggtcgcgcccgcctacacgagccagcggtgcagccagtgcggctacatctgcaaggagaaccggtgcacccaggcgatgttcgagtgcaagcagtgcgggtacaagacgcacgcggactacaacgcggccaagaacatctcgacgtacgacatcgagaacatcatcaacaagcagctcgccgtccagtcgaagctccacagcaagaaatgcatggaggagtacatcgaggagctgggctacctggactga

SEQ ID NO: 2212 - DNA, 1338 bp, Unknown
  Bacillus sp. multi
ctcggggtgaccatcaagatcatgaagtaccagatcctctgcccgctcaacgtggactggaccatcttcgagaagcacctccgcaacctgacctaccaagtgcggacgatctccaaccgcaccatccagcagctctgggagttcgacgccctgtccttcgactacttcaaggagcgcggcacgtacccgacggtccaagacctttacggctgcacccagaagaaaattgacgggtacatctaccacaccctccagtcgaagtacccggacatccacaagggcaacatgagcacgaccctccaaaagattatcaagacctggaagtcccggcgcaacgagatccgcaagggcgagatgtcgatcccgtccttccggaaccgcatccccatcgacctccacaacaactcggtggacatcacgaaggagaagaatggcgactacatcgcgggcatctcgctgttctcccgcgacttccacaaggagaacgacgacgtgccgaagggcaaaatcttcgtcaagctggccacccagaagcagaagtcgatgaaggtgatcctcgaccgcctcatcaaccagacctacagcaagggcgcgtgcatgatccacaagtacaagaacaagtggtatctgagtatcacctacaagttcaacgcgatcaaggagaacaagttcgacaaggaacttatcatgggcatcgacctgggcggcatcaacacggtgtacttcgcgttcaacgagggcttcatccggtccaacatcaagtcggacgagatcatccggcagcgccggatcaacctcctcaagcagtccaagtactgctccaactcccggacggggaagggccgcaccaagcgcctccagcccatcgacgtcctgtccaacaagatcgccaagttccgcaacagcaccaaccacaagtacgccaactacatcgtgaagcagtgcctcaagcacaactgcgggcgcatccagatggagctgctcaaggggatcagcaagaacgaccgcatcctcaaggactggacctacttcgacctccaggagaagattaagaatcaggccgagatccacggcatcgaggtcatcaaggtcgccccggcctacacctcccagcggtgctcgcagtgcggctacatctgcaaggagaaccgctgcacccaggcgatgttcgagtgcaagcagtgcggctacaagacccacgccgactacaacgccgccaagaacatctcgacgtacgacatcgagaacatcatcaacaagcagctcgcggtgcagagcaagctccactccaagaagtgcatggaggagtacatcgaggagctgggctacctcgactag

SEQ ID NO: 2213 - DNA, 1338 bp, Unknown
  Bacillus sp. multi
ctcggcgtcaccatcaagatcatgaagtaccagatcctctgcccgctcaacgtggactggacgatcttcgagaagcacctccgcaacctcacctaccaagtccggacgatcagcaaccgcaccatccagcagctctgggagttcgacgccctgtcgttcgactacttcaaggagcggggcacctacccgacggtccaagatctatacggctgcacgcagaagaagatcgacggctacatctaccacacgctccagagcaagtaccccgacatccacaagggcaacatgagcacgacgctccagaagatcatcaagacatggaagtcccgccgcaacgagatccgcaagggcgagatgtccatcccgtccttccgcaaccgcatccccatcgacctgcacaacaactcggtggacatcacgaaggagaagaacggcgactacatcgcggggatctccctcttcagccgcgacttccacaaggagaacgacgacgtgccgaagggcaagattttcgtaaagctggccacccagaagcagaagtcgatgaaggtgatcctcgaccggctcatcaaccagacctactcgaagggcgcgtgcatgatccacaagtacaagaacaagtggtatcttagcatcacctacaagttcaacgccatcaaggagaacaagttcgacaaggaactcattatgggcatcgacctcggcgggatcaacaccgtgtacttcgccttcaacgagggcttcatccggagcaacatcaagtccgacgagatcatccgccagcgccgcatcaacctgctcaagcagagcaaatactgttccaactcgcggacgggcaagggccgcacgaagcgcctccagcccatcgacgtcctcagcaacaagatcgccaagttccgcaacagcaccaaccacaagtacgccaactacatcgtgaagcagtgcctcaagcacaactgcgggcgcatccagatggagctgctcaagggcatcagcaagaacgaccgcatcctcaaggactggacgtacttcgacctccaggagaagattaagaaccaggccgagatccacgggatcgaggtcatcaaggtcgcgcccgcctacacctcgcagcggtgctcccagtgcgggtacatctgcaaggagaaccggtgcacccaggcgatgttcgagtgcaagcagtgcggctacaagacgcacgccgactacaacgccgccaagaacatcagcacctacgacatcgagaacatcatcaacaagcagctcgcggtccagagcaagctccactccaagaaatgcatggaggagtacatcgaggagctgggctacctcgactga

SEQ ID NO: 2214 - DNA, 1338 bp, Unknown
  Bacillus sp. multi
ctcggcgtcacgatcaagatcatgaagtaccagatcctctgcccgctcaacgtggactggacgatcttcgagaagcacctccggaacctcacctaccaggtccggacgatcagcaaccggaccatccagcagctctgggagttcgacgccctgtccttcgactacttcaaggagcgcggcacgtacccgaccgtccaagatctctacggctgcacgcagaagaagatcgacggctacatctaccacaccctccagtcgaagtaccccgacatccacaagggcaacatgagcaccaccctccagaagattattaagacttggaaatcaagacggaacgagatccgcaagggcgagatgtccatccccagcttccgcaaccgcatccccatcgacctgcacaacaacagcgtggacatcacgaaggagaagaacggcgactacatcgccgggatctccctgttcagccgcgatttccacaaggagaacgacgacgtgccgaagggcaagatcttcgttaagctggccacccagaagcagaagtccatgaaggtcatcctcgaccgcctcatcaaccagacgtactcgaagggcgcgtgcatgatccacaagtacaagaacaagtggtatctgagcatcacctacaagttcaacgcgatcaaggagaacaagttcgacaaggagctgataatgggcatcgacctcggcgggatcaacaccgtgtacttcgccttcaacgagggcttcatccgctccaacatcaagagcgacgagatcatccgccagcggcggatcaacctcctcaagcagagcaaatactgttcgaactcgcggacgggcaagggccgcaccaagcgcctccagcccatcgacgtcctgagcaacaagatcgccaagttccgcaacagcacgaaccacaagtacgcgaactacatcgtgaagcagtgcctcaagcacaactgcgggcgcatccagatggagctgctcaagggcatcagcaagaacgaccgcatcctcaaggactggacgtacttcgacctccaggagaagatcaagaaccaggcggagatccacggcatcgaggtcatcaaggtggccccggcctacacgagccagcggtgctcccagtgcgggtacatctgcaaggagaaccgctgcacccaggccatgttcgagtgcaagcagtgcggctacaagacgcacgcggactacaacgccgccaagaacatcagcacgtacgacatcgagaacatcatcaacaagcagctcgccgtccagagcaagctgcactccaagaagtgcatggaggagtacatcgaggagctgggctacctcgactag

SEQ ID NO: 2215 - DNA, 1356 bp, Unknown
  Bacillus sp. multi
ctcggggtcacgatcaagatcatgaagtaccagatcctctgcccgatgaacgtggactggacgatcttcgagaagcacctccggaacctcacctaccaagtgcggacgatctccaaccggaccatccagcagctctgggagttcgacgcgctgtccttcgactacttcaaggccatcggcacctaccccaccgtccaggatctgtacgggtgcacgcagaagaagattgacgggtacatctaccacaccctccagtcgaagtacccggacatccacaaggggaacatgagcaccacgctccagaaaatcatcaagacctggaagtcccgccggaacgagatccgcaagggcgagatgtccatcccgagcttccgcaaccgcatccccatcgacctgcacaacaacagcgtggacatcacgaaggagaagcacggggactacatcgcgggcatctccctgttcagccgcgacttccacaaggagaacaacgacgtgccgaagggcaagatcttcgtgaagctggccacccagaagcagaagtccatgaaggtcatcctggaccgcctcatgaaccagacgtactcgaagggcgcgtgcatgatctacaagtacaagaacaagtggtatcttagcatcacctacaagttcaacgccctcaaggagaacaagttcgacaaggaattgatcatgggcatcgacatgggcggcatcaacaccgtgtacctggccttcaacgagggcttcatccgctccaacatcaagagcgacgagatcaagatgttcaacgagcgcatccgccagcgccgcatcaacctgctcaagcagagcaagtactgttccaacagccgcaccgggaagggccgcacgaagcgcctccagcccatcgacgtgctcagcaacaagatcgccaagttccgcaactccacgaaccacaagtacgcgaactacatcatcaagcagtgcctcaagcacaactgcgggcgcatccagatggagctgctcaagggcatctccaagaacgacaaggtgctcaaggactggacctacttcgacctccaggagaagatcaagaaccaggcggagatccacggcatcgaggtcatcaaggtcgccccggcctacacctcccagcggtgcagccagtgcggctacatctgcaaggagaaccggtgcacccaggccatgttcgagtgcaagcagtgcgggtacaagacccacgccgactacaacgcggccaagaacatctcgacgtacaacatcgagaacatcatcaacaagcagctcgccgtgcagagcaagctccactccaagaagtgcatggaggagtacatcgaggagctgggctacctggactga

SEQ ID NO: 2216 - DNA, 1356 bp, Unknown
  Bacillus sp. multi
ctcggcgtcacgatcaagatcatgaagtaccagatcctctgcccgatgaacgtggactggaccatcttcgagaagcacctccggaacctcacctaccaggtccggacgatctccaaccgcaccatccagcagctctgggagttcgacgcgctcagcttcgactacttcaaggccatcgggacgtaccccaccgtccaagacctgtacggctgcacgcagaagaaaatcgacgggtacatctaccacaccctccagagcaagtaccccgacatccacaagggcaacatgagcacgaccctccagaaaatcattaagacctggaagtcccgccgcaacgagatccggaagggcgagatgtccatcccctccttccgcaaccgcatccccatcgacctccacaacaactcggtggacatcacgaaggagaagcacggcgactacatcgcgggcatctcgctgttcagccgcgacttccacaaggagaacaacgacgtgccgaagggcaaaatcttcgtcaagctggccacccagaagcagaagtcgatgaaggtgatcctcgaccggctcatgaaccagacctacagcaagggcgcgtgcatgatctacaagtacaagaacaagtggtacctgtcgatcacctacaagttcaacgcgctcaaggagaacaagttcgacaaggagcttatcatgggcatcgacatgggcggcatcaacacggtgtacctggccttcaacgaggggttcatccggagcaacatcaagagcgacgagatcaagatgttcaacgagcgcatccgccagcgccgcatcaacctgctcaagcagtccaaatactgctccaactcccgcaccgggaaggggcggacgaagcggctccagcccatcgacgtcctctccaacaagatcgccaagttccgcaacagcacgaaccacaagtacgcgaactacatcatcaagcagtgcctcaagcacaactgcgggcgcatccagatggagctgctcaaggggatctccaagaacgacaaggtgctcaaggactggacctacttcgacctccaggagaagattaagaatcaggccgagatccacgggatcgaggtcatcaaggtcgccccggcctacacctcccagcgctgctcccagtgcgggtacatctgcaaggagaaccgctgcacccaggccatgttcgagtgcaagcagtgcggctacaagacgcacgcggactacaacgcggccaagaacatcagcacctacaacatcgagaacatcatcaacaagcagctcgccgtgcagtcgaagctccactccaagaagtgcatggaggagtacatcgaggagctgggctacctggactga

SEQ ID NO: 2217 - DNA, 1356 bp, Unknown
  Bacillus sp. multi
ctcggcgtcaccatcaagatcatgaagtaccagatcctctgcccgatgaacgtggactggaccatcttcgagaagcacctccgcaacctcacgtaccaagtccggacgatcagcaaccgcacgatccagcagctctgggagttcgacgccctctcgttcgactacttcaaggccatcggcacctaccccacggtccaagacctttacggctgcacgcagaagaaaatcgacgggtacatctaccacacgctccagagcaagtaccccgacatccacaagggcaacatgagcacgaccctccagaaaatcatcaagacctggaagtcgcgccggaacgagatccggaagggcgagatgagcatcccgagcttccggaaccgcatccccatcgacctgcacaacaacagcgtggacatcacgaaggagaagcacggcgactacatcgcggggatctccctgttctcgcgggacttccacaaggagaacaacgacgtgccgaagggcaagatattcgtcaagctggcgacccagaagcagaagtccatgaaggtgatcctcgaccgcctcatgaaccagacgtactcgaagggcgcgtgcatgatctacaagtacaagaacaagtggtacctgagtatcacctacaagttcaacgccctcaaggagaacaagttcgacaaggagttgataatgggcatcgacatgggcggcatcaacaccgtgtacctcgccttcaacgaggggttcatccgcagcaacatcaagtcggacgagatcaagatgttcaacgagcgcatccgccagcgccggatcaacctcctcaagcagagcaagtactgctccaacagccgcacgggcaaggggcggacgaagcgcctccagcccatcgacgtgctgtccaacaagatcgccaagttccgcaactcgaccaaccacaagtacgccaactacatcatcaagcagtgcctcaagcacaactgcgggcgcatccagatggagctgctcaagggcatctccaagaacgacaaggtgctcaaggactggacctacttcgacctccaggagaagatcaagaaccaggcggagatccacggcatcgaggtcatcaaggtggccccggcctacaccagccagcggtgcagccagtgcggctacatctgcaaggagaaccgctgcacccaggccatgttcgagtgcaagcagtgcggctacaagacgcacgccgactacaacgccgccaagaacatctccacgtacaacatcgagaacatcatcaacaagcagctcgcggtgcagagcaagctgcactccaagaagtgcatggaggagtacatcgaggagctgggctacctggactga

SEQ ID NO: 2218 - DNA, 1356 bp, Unknown
  Bacillus sp. multi
ctcggggtgacgatcaagatcatgaagtaccagatcctctgccccatgaacgtggactggacgatcttcgagaagcacctccgcaacctgacgtaccaagtccggacgatcagcaaccgcacgatccagcagctctgggagttcgacgccctgtccttcgactacttcaaggccatcgggacgtaccccaccgtccaagacctctacggctgcacccagaagaaaatcgacgggtacatctaccacaccctccagagcaagtaccccgacatccacaagggcaacatgagcacgaccctccagaagatcatcaagacctggaagtcccgccgcaacgagatccgcaagggcgagatgagcatccccagcttccggaaccgcatccccatcgacctgcacaacaactcggtggacatcacgaaggagaagcacggcgactacatcgccgggatctcgctgttctcccgcgacttccacaaggagaacaacgacgtcccgaagggcaagatattcgtaaagctcgccacccagaagcagaagtcgatgaaggtgatcctcgaccgcctcatgaaccagacctacagcaagggcgcgtgcatgatctacaagtacaagaacaagtggtatctgtcgatcacctacaagttcaacgccctcaaggagaacaagttcgacaaggagctgataatgggcatcgacatgggcggcatcaacaccgtgtacctggcgttcaacgagggcttcatccgcagcaacatcaagtccgacgagatcaagatgttcaacgagcgcatccgccagcgccgcatcaacctcctcaagcagagcaaatactgctccaacagccgcaccgggaaggggcgcacgaagcggctccagcccatcgacgtgctcagcaacaagatcgccaagttccgcaactcgaccaaccacaagtacgccaactacatcatcaagcagtgcctcaagcacaactgcgggcgcatccagatggagctgctcaagggcatctccaagaacgacaaggtgctcaaggactggacctacttcgacctccaggagaagatcaagaaccaggccgagatccacgggatcgaggtcatcaaggtggccccggcctacaccagccagcggtgctcccagtgcggctacatctgcaaggagaaccgctgcacccaggccatgttcgagtgcaagcagtgcggctacaagacccacgccgactacaacgcggccaagaacatctccacctacaacatcgagaacatcatcaacaagcagctcgcggtccagagcaagctccactccaagaagtgtatggaggagtacatcgaggagctgggctacctggactga

SEQ ID NO: 2219 - DNA, 1356 bp, Unknown
  Bacillus sp. multi
ctcggcgtgacgatcaagatcatgaagtaccagatcctctgcccgatgaacgtggactggacgatcttcgagaagcacctccgcaacctgacgtaccaagtgcggacgatctcgaaccggacgatccagcagctctgggagttcgacgccctctcgttcgactacttcaaggccatcggcacgtaccccacggtccaggatctttacgggtgcacgcagaagaaaatcgacgggtacatctaccacaccctccagtcgaagtacccggacatccacaaggggaacatgagcacgaccctccagaaaatcatcaagacctggaagtcccgccgcaacgagatccggaagggcgagatgtccatcccgagcttccggaaccgcatccccatcgacctccacaacaactcggtggacatcacgaaggagaagcacggcgactacatcgcgggcatctccctgttctcccgcgacttccacaaggagaacaacgacgtcccgaagggcaaaatcttcgtgaagctggccacccagaagcagaagtccatgaaggtcatcctggaccggctgatgaaccagacctacagcaagggcgcgtgcatgatctacaagtacaagaacaagtggtatctcagcatcacgtacaagttcaacgcgctcaaggagaacaagttcgacaaggagctaatcatgggcatcgacatgggcgggatcaacacggtgtacctcgcgttcaacgaggggttcatccgcagcaacatcaagtccgacgagatcaagatgttcaacgagcgcatccgccagcggcggatcaacctgctcaagcagtccaaatactgctcgaactcgcggacgggcaagggccggacgaagcgcctccagcccatcgacgtcctgtcgaacaagatcgccaagttccgcaactcgaccaaccacaagtacgccaactacatcatcaagcagtgcctcaagcacaactgcgggcgcatccagatggagctgctcaagggcatcagcaagaacgacaaggtgctcaaggactggacctacttcgacctccaggagaagatcaagaaccaggccgagatccacggcatcgaggtcatcaaggtcgcgcccgcctacacctcccagcgctgctcccagtgcggctacatctgcaaggagaaccgctgcacccaggccatgttcgagtgcaagcagtgcgggtacaagacgcacgcggactacaacgccgccaagaacatctccacgtacaacatcgagaacatcatcaacaagcagctcgccgtgcagagcaagctccactccaagaagtgcatggaggagtacatcgaggagctgggctacctcgactga

SEQ ID NO: 2220 - DNA, 1335 bp, Unknown
  Bacillus sp. multi
atgaagtaccagatcctctgcccgatgaacgacgactggaccatcttcgagaagcacctccggaacctcacctaccaagtgcggacgatctcgaaccggacgatccagcagctctgggagttcgacgccctgtccttcgactacttcaaggcgcgcgggacgtacccgaccgtccaagacctctacggctgcacccagaagaagatcgacgggtacatctaccacaccctccagtcgaagtaccccgacatccacaaggggaacatgagcaccacgctccagaagattatcaagacctggaagtcgcgccgcaacgagatccgcaagggcgagatgtcgatcccgtccttccgcaaccgcaagcccatcgacctccacaacaactcggtggacatcacgaaggagaagaacggcgactacatcgcgggcatcagcctgttcagccgggacttccacaaggagaacggcgacgtgccgaagggcaaaatcttcctcaagctcggcacccagaagcagaagtcgatgaaggtcatcctcgaccgcctcatcaaccagacctacagcaagggcgcgtgcatgatccacaagtacaagaacaagtggtacttgtccatcacctacaagttcaacgccatcaaggagaacaagttcgacaaggagcttatcatgggcatcgacatgggcggcatcaacacggtgtacttcgcgttcaacgaggggttcatccggtccaacatcaagagcgacgagatcaaggcgttcaacgagcgcatccgccagcgccgcatcaacctgctcaagcagtccaagtactgctccaactcgcggacgggcaaggggcgcgagaagcgcctccagcccatcgacatgctcagcaacaagatcgccaagttccgcaacagcaccaaccacaagtacgccaactacatcatcaagcagtgcctcaagcacaactgcgggcgcatccagatggagctgctcaagggcatctccaagaacgacaaggtgctcaaggactggacctacttcgacctccaggagaagattaagaatcaggccgagatccacggcatcgaggtcatcaaggtcgccccggcctacacctcgcagcggtgctcccagtgcggctacatctgcaaggagaaccgctgcacccaggatatgttcgaatgcaagcagtgcgggtacaagacccacgccgactacaacgcggccaagaacatctccacgtacaacatcgagaacatcatcaacaagcagctcgcggtccagagcaagctgcactccaagaaatgcatggaggagtacatcgaggagctgggctacctcgactag

SEQ ID NO: 2221 - DNA, 1335 bp, Unknown
  Bacillus sp. multi
atgaagtaccagatcctctgccccatgaacgacgactggaccatcttcgagaagcacctccggaacctgacctaccaagtgcggacgatctccaaccgcaccatccagcagctctgggagttcgacgccctgtcgttcgactacttcaaggcgcgcggcacgtacccgaccgtccaagacctgtacggctgcacgcagaagaagattgacgggtacatctaccacaccctccagagcaagtaccccgacatccacaaggggaacatgagcaccaccctccagaaaatcatcaagacctggaagtcccgccggaacgagatccggaagggcgagatgagcatcccgtccttccgcaaccgcaagcccatcgacctccacaacaacagcgtggacatcacgaaggagaagaacggcgactacatcgccgggatcagcctgttcagccgcgacttccacaaggagaacggcgacgtcccgaagggcaagatcttcctcaagctcggcacgcagaagcagaagtccatgaaggtgatcctggaccgcctcatcaaccagacgtactcgaagggcgcgtgcatgatccacaagtacaagaacaagtggtacctaagtatcacctacaagttcaacgcgatcaaggagaacaagttcgacaaggagctgattatggggatcgacatgggcggcatcaacacggtgtacttcgccttcaacgaggggttcatccgctccaacatcaagagcgacgagatcaaggcgttcaacgagcgcatccggcagcggcgcatcaacctcctcaagcagtccaagtattgttcgaactcccgcacggggaagggccgcgagaagcgcctccagcccatcgacatgctctccaacaagatcgccaagttccgcaactccaccaaccacaagtacgcgaactacatcatcaagcagtgcctcaagcacaactgcgggcgcatccagatggagctgctcaagggcatctccaagaacgacaaggtgctcaaggactggacgtacttcgacctccaggagaagattaagaaccaggcggagatccacgggatcgaggtcatcaaggtcgccccggcctacaccagccagcggtgcagccagtgcgggtacatctgcaaggagaaccggtgcacccaggatatgttcgagtgcaagcagtgcggctacaagacccacgcggactacaacgccgccaagaacatctcgacgtacaacatcgagaacatcatcaacaagcagctcgcggtgcagagcaagctgcacagcaagaagtgcatggaggagtacatcgaggagctgggctacctcgactga

SEQ ID NO: 2222 - DNA, 1335 bp, Unknown
  Bacillus sp. multi
atgaagtaccagatcctctgcccgatgaacgacgactggacgatcttcgagaagcacctccggaacctcacctaccaagtccggacgatctccaaccgcaccatccagcagctctgggagttcgacgcgctgagcttcgactacttcaaggcgcgcggcacctacccgacggtccaggatctttacggctgcacgcagaagaaaatcgacggctacatctaccacacgctccagtccaagtacccggacatccacaagggcaacatgagcaccacgctccagaaaatcatcaagacctggaagtcccgccgcaacgagatccgcaagggcgagatgagcatcccgtccttccgcaaccggaagcccatcgacctccacaacaactcggtggacatcacgaaggagaagaacggcgactacatcgcgggcatctcgctgttctcccgcgacttccacaaggagaacggcgacgtgccgaagggcaaaatcttcctcaagctcggcacgcagaagcagaagtccatgaaggtgatcctcgaccgcctcatcaaccagacgtactcgaagggcgcgtgcatgatccacaagtacaagaacaagtggtatctgtccatcacctacaagttcaacgccatcaaggagaacaagttcgacaaggagctgataatggggatcgacatgggcgggatcaacacggtgtacttcgccttcaacgagggcttcatccgcagcaacatcaagagcgacgagatcaaggcgttcaacgagcgcatccggcagcgccgcatcaacctcctcaagcagtccaagtattgttccaactcccgcacgggcaaggggcgcgagaagcggctccagcccatcgacatgctgtccaacaagatcgccaagttccgcaacagcacgaaccacaagtacgccaactacatcatcaagcagtgcctcaagcacaactgcgggcgcatccagatggagctgctcaaggggatcagcaagaacgacaaggtgctcaaggactggacctacttcgacctccaggagaagattaagaaccaggccgagatccacggcatcgaggtcatcaaggtcgccccggcctacacgagccagcggtgctcgcagtgcgggtacatctgcaaggagaaccggtgcacccaggacatgttcgagtgcaagcagtgcggctacaagacccacgcggactacaacgccgccaagaacatctccacctacaacatcgagaacatcatcaacaagcagctcgccgtgcagtccaagctccacagcaagaagtgcatggaggagtacatcgaggagctgggctacctcgactag

SEQ ID NO: 2223 - DNA, 1335 bp, Unknown
  Bacillus sp. multi
atgaagtaccagatcctctgccccatgaacgacgactggaccatcttcgagaagcacctccgcaacctgacctaccaagtgcggacgatctccaaccggacgatccagcagctctgggagttcgacgccctgtccttcgactacttcaaggcgcggggcacgtaccccaccgtccaggatctgtacggctgcacccagaagaaaattgacgggtacatctaccacacgctccagtcgaagtacccggacatccacaagggcaacatgagcacgaccctccagaaaatcatcaagacctggaagtcccgccgcaacgagatccgcaagggcgagatgtccatcccctccttccgcaaccggaagcccatcgacctccacaacaacagcgtggacatcacgaaggagaagaatggggactacatcgcggggatcagcctgttcagccgcgacttccacaaggagaacggcgacgtgccgaagggcaaaatcttcctcaagctggggacgcagaagcagaagtccatgaaggtgatcctggaccgcctcatcaaccagacgtactcgaagggcgcgtgcatgatccacaagtacaagaacaagtggtacctcagcatcacctacaagttcaacgccatcaaggagaacaagttcgacaaggagctaatcatgggcatcgacatgggcggcatcaacacggtgtacttcgccttcaacgagggcttcatccggtccaacatcaagtccgacgagatcaaggcgttcaacgagcgcatccgccagcggcggatcaacctcctcaagcagagcaaatactgctccaactcgcgcaccggcaaggggcgcgagaagcgcctccagcccatcgacatgctctccaacaagatcgccaagttccgcaacagcacgaaccacaagtacgccaactacatcatcaagcagtgcctcaagcacaactgcgggcgcatccagatggagctgctcaaggggatctccaagaacgacaaggtgctcaaggactggacctacttcgacctccaggagaagatcaagaaccaggcggagatccacggcatcgaggtcatcaaggtggccccggcctacacgagccagcggtgctcgcagtgcgggtacatctgcaaggagaaccgctgcacccaggatatgtttgagtgcaagcagtgcgggtacaagacccacgcggactacaacgccgccaagaacatctcgacgtacaacatcgagaacatcatcaacaagcagctcgccgtccagagcaagctccactccaagaagtgcatggaggagtacatcgaggagctgggctacctcgactag

SEQ ID NO: 2224 - DNA, 1335 bp, Unknown
  Bacillus sp. multi
atgaagtaccagatcctctgcccgatgaacgacgactggaccatcttcgagaagcacctccgcaacctgacctaccaagtgcggacgatctccaaccggaccatccagcagctctgggagttcgacgccctgtccttcgactacttcaaggcgcggggcacgtaccccacggtccaagacctatacggctgcacccagaagaagatcgacgggtacatctaccacacgctccagtcgaagtacccggacatccacaagggcaacatgagcaccaccctccagaagatcatcaagacctggaagtcccgccggaacgagatccgcaagggcgagatgtccatcccgagcttccgcaaccggaagcccatcgacctgcacaacaacagcgtggacatcacgaaggagaagaatggcgactacatcgccgggatcagcctgttctcccgcgacttccacaaggagaacggcgacgtcccgaagggcaaaatcttcctcaagctgggcacgcagaagcagaagtccatgaaggtcatcctggaccgcctcatcaaccagacgtactcgaagggcgcgtgcatgatccacaagtacaagaacaagtggtatctcagcatcacctacaagttcaacgcgatcaaggagaacaagttcgacaaggagctcattatggggatcgacatgggcgggatcaacacggtgtacttcgcgttcaacgagggcttcatccggagcaacatcaagagcgacgagatcaaggcgttcaacgagcgcatccgccagcgccgcatcaacctgctcaagcagtccaagtactgttccaactcccggacggggaaggggcgcgagaagcgcctccagcccatcgacatgctgtccaacaagatcgccaagttccgcaacagcacgaaccacaagtacgccaactacatcatcaagcagtgcctcaagcacaactgcgggcgcatccagatggagctgctcaaggggatcagcaagaacgacaaggtgctcaaggactggacctacttcgacctccaggaaaagattaagaaccaggcggagatccacggcatcgaggtcatcaaggtcgccccggcctacacgagccagcggtgctcgcagtgcggctacatctgcaaggagaaccggtgcacccaggatatgttcgagtgcaagcagtgcgggtacaagacgcacgccgactacaacgccgccaagaacatctccacctacaacatcgagaacatcatcaacaagcagctcgccgtgcagagcaagctgcacagcaagaagtgcatggaggagtacatcgaggagctgggctacctggactga

SEQ ID NO: 2225 - DNA, 1356 bp, Unknown
  Bacillus sp. multi
ctcggcgtcacgatcaagatcatgaagtaccagatcctctgccccatgaacgtggactggaccatcttcgagaagcacctccgcaacctgacgtaccaagtgcggacgatctcgaaccgcaccatccagcagctctgggagttcgacgcgctctcgttcgactacttcaaggcgcgcggcacctacccgaccgtccaggatctctacggctgcacccagaagaagatagacggctacatctaccacaccctccagtcgaagtaccccgacatccacaaggggaacatgagcaccaccctccagaaaatcatcaagacctggaagtcccggcggaacgagatcggcaagggcgagatgtccatccccagcttccggaaccgcatccccatcgacctccacaacaactccgtggagatcacgaaggagaagaacggcgactacatcgcggggatcagcctgttctcccgcgacttccacaaggagaacggcgacgtgccgaagggcaagatcttcctcaagctcggcacgcagaagcagaagtccatgaaggtcatcctcgaccgcctcatcaaccagacctactcgaagggcgcgtgcatgatccacaagtacaagaacaagtggtacttgtctatcacctacaagttcaacgccatcaaggagaacaagttcgacaaggagctaatcatgggcatcgacatgggcggcatcaacaccgtgtacttcgccttcaacgagggcttcatccggtcgaacatcaagtcggacgagatcaaggcgttcaacgaaaagatccggcagcgccgcatcaacctcctcaagcagagcaactactgctccaacagccgcacgggcaagggccgcgccaagcgcctccagcccatcgacgtcctctccaacaagatcgccaagttccgcaacagcaccaaccacaagtacgccaactacatcatcaagcagtgcctcaagcacaactgcgggcgcatccagatcgagcttctaaaggggatcagcaagaacgacaaggtgctcaaggactggacgtacttcgacctccaggagaagatcaagaaccaggcggagatccacgggatcgaggtcatcaaggtcgcgcccgcctacaccagccagcggtgctcccagtgcgggtacatctgcaaggagaaccgctgcacccaggcgatgttcgagtgcaagcagtgcggctacaagacccacgccgactacaacgcggccaagaacatctccacctacgacatcgagaacatcatcaacaaacagcttgcggtgcagagcaagctccactccaagaagtgtatggaggagtacatcgaggagctgggctacctggactag

SEQ ID NO: 2226 - DNA, 1356 bp, Unknown
  Bacillus sp. multi
ctcggcgtgacgatcaagatcatgaagtaccagatcctctgcccgatgaacgtggactggaccatcttcgagaagcacctccgcaacctcacctaccaggtgcggacgatctcgaaccgcacgatccagcagctctgggagttcgacgcgctgtccttcgactacttcaaggcgcggggcacctaccccaccgtccaagacctttacggctgcacccagaagaagatcgacggctacatctaccacacgctccagagcaagtacccggacatccacaagggcaacatgagcacgaccctccagaagatcatcaagacctggaagtcccgccggaacgagatcgggaagggcgagatgtccatcccctccttccggaaccgcatccccatcgacctccacaacaacagcgtcgagatcacgaaggagaagaatggcgactacatcgcgggcatctccctgttcagccgcgacttccacaaggagaacggggacgtgccgaagggcaagatattcctcaagctgggcacccagaagcagaagtccatgaaggtcatcctcgaccggctcatcaaccagacgtactcgaagggcgcgtgcatgatccacaagtacaagaacaagtggtatctctccatcacctacaagttcaacgcgatcaaggagaacaagttcgacaaggagcttatcatggggatcgacatgggcgggatcaacaccgtgtacttcgccttcaacgagggcttcatccggagcaacatcaagagcgacgagatcaaggcgttcaacgagaaaatacgccagcgccgcatcaacctgctcaagcagtccaactactgctccaacagccggacgggcaagggccgggcgaagcgcctccagcccatcgacgtcctgagcaacaagatcgccaagttccgcaacagcacgaaccacaagtacgccaactacatcatcaagcagtgcctcaagcacaactgcgggcgcatccagatagagctacttaaggggatcagcaagaacgacaaggtgctcaaggactggacgtacttcgacctccaggagaagatcaagaaccaggccgagatccacggcatcgaggtcatcaaggtcgccccggcctacaccagccagcggtgctcgcagtgcggctacatctgcaaggagaaccggtgcacccaggccatgttcgagtgcaagcagtgcgggtacaagacgcacgcggactacaacgcggccaagaacatctccacgtacgacatcgagaacatcatcaacaaacagttggcggtccagagcaagctccacagcaagaagtgcatggaggagtacatcgaggagctgggctacctggactag

SEQ ID NO: 2227 - DNA, 1356 bp, Unknown
  Bacillus sp. multi
ctgggcgtcacgatcaagatcatgaagtaccagatcctctgcccgatgaacgtggactggaccatcttcgagaagcacctccgcaacctgacgtaccaagtccggacgatctccaaccgcacgatccagcagctctgggagttcgacgccctcagcttcgactacttcaaggcgcgcggcacgtacccgaccgtccaagacctgtacggctgcacgcagaagaaaatcgacggctacatctaccacaccctccagtcgaagtacccggacatccacaaggggaacatgagcaccaccctccagaaaatcatcaagacctggaagtcgcggcgcaacgagatcggcaagggcgagatgagcatcccgagcttccggaaccgcatccccatcgacctgcacaacaacagcgtggagatcacgaaggagaagaacggcgactacatcgcgggcatctcgctgttcagccgggacttccacaaggagaacggcgacgtgccgaagggcaagatcttcctcaagctgggcacccagaagcagaagtccatgaaggtgatcctggaccggctcatcaaccagacgtacagcaagggcgcgtgcatgatccacaagtacaagaacaagtggtacctgtccatcacctacaagttcaacgccatcaaggagaacaagttcgacaaggaacttatcatggggatcgacatgggcgggatcaacacggtgtacttcgcgttcaacgaggggttcatccggagcaacatcaagagcgacgagatcaaggcgttcaacgagaaaatacggcagcggcgcatcaacctcctcaagcagtccaactactgctcgaactcgcggacgggcaaggggcgggcgaagcgcctccagcccatcgacgtgctgagcaacaagatcgccaagttccgcaacagcaccaaccacaagtacgcgaactacatcatcaagcagtgcctcaagcacaactgcgggcgcatccagatagagcttctgaaagggatcagcaagaacgacaaggtgctcaaggactggacgtacttcgacctccaggagaaaatcaagaaccaggccgagatccacggcatcgaggtcatcaaggtcgcgcccgcctacacctcgcagcggtgcagccagtgcggctacatctgcaaggagaaccgctgcacccaggcgatgttcgagtgcaagcagtgcggctacaagacccacgcggactacaacgccgccaagaacatcagcacgtacgacatcgagaacatcatcaacaagcaactggccgtgcagtccaagctccactccaagaagtgcatggaggagtacatcgaggagctgggctacctggactga

SEQ ID NO: 2228 - DNA, 1356 bp, Unknown
  Bacillus sp. multi
ctgggcgtcacgatcaagatcatgaagtaccagatcctctgccccatgaacgtggactggaccatcttcgagaagcacctccgcaacctgacgtaccaagtccggacgatcagcaaccgcaccatccagcagctctgggagttcgacgccctgtcgttcgactacttcaaggcgcgcggcacgtaccccaccgtccaggatctctacggctgcacccagaagaagatagacgggtacatctaccacaccctccagtcgaagtaccccgacatccacaaggggaacatgagcaccaccctccagaagatcatcaagacctggaagtcccggcgcaacgagatcggcaagggcgagatgagcatcccgagcttccgcaaccgcatccccatcgacctccacaacaactccgtggagatcacgaaggagaagaacggcgactacatcgcggggatcagcctcttcagccgcgacttccacaaggagaacggcgacgtcccgaagggcaagatattcctcaagctgggcacccagaagcagaagtcgatgaaggtgatcctcgaccgcctcatcaaccagacgtacagcaagggcgcgtgcatgatccacaagtacaagaacaagtggtacttatctatcacctacaagttcaacgcgatcaaggagaacaagttcgacaaggaactgattatgggcatcgacatgggcggcatcaacaccgtgtacttcgcgttcaacgaggggttcatccggtccaacatcaagtccgacgagatcaaggcgttcaacgagaaaatccggcagcggcgcatcaacctcctcaagcagtccaactactgctccaactcccgcaccgggaagggccgcgccaagcgcctccagcccatcgacgtgctgtccaacaagatcgccaagttccgcaactccaccaaccacaagtacgccaactacatcatcaagcagtgcctcaagcacaactgcgggcgcatccagatcgagctgcttaaggggatcagcaagaacgacaaggtgctcaaggactggacctacttcgacctccaggagaagatcaagaatcaggccgagatccacggcatcgaggtcatcaaggtcgccccggcctacaccagccagcggtgctcgcagtgcgggtacatctgcaaggagaaccgctgcacccaggccatgttcgagtgcaagcagtgcgggtacaagacccacgccgactacaacgcggccaagaacatcagcacgtacgacatcgagaacatcatcaacaaacagctcgccgtgcagagcaagctccactccaagaagtgcatggaggagtacatcgaggagctgggctacctcgactag

SEQ ID NO: 2229 - DNA, 1356 bp, Unknown
  Bacillus sp. multi
ctcggcgtcaccatcaagatcatgaagtaccagatcctctgccccatgaacgtggactggacgatcttcgagaagcacctccggaacctgacctaccaagtccggacgatcagcaaccgcacgatccagcagctctgggagttcgacgcgctgtccttcgactacttcaaggcgcgcggcacgtacccgaccgtccaggacttgtacgggtgcacgcaaaagaaaatcgacgggtacatctaccacaccctccagagcaagtaccccgacatccacaagggcaacatgagcaccacgctccagaagatcattaagacctggaagtcccggcgcaacgagatcgggaagggcgagatgtccatcccctccttccgcaaccgcatccccatcgacctccacaacaactcggtcgagatcacgaaggagaagaacggcgactacatcgcggggatcagcctgttcagccgcgacttccacaaggagaacggggacgtgccgaagggcaaaatcttcctcaagctcggcacgcagaagcagaagtccatgaaggtgatcctcgaccgcctcatcaaccagacgtacagcaagggcgcgtgcatgatccacaagtacaagaacaagtggtatctgagcatcacctacaagttcaacgcgatcaaggagaacaagttcgacaaggagttgataatgggcatcgacatgggcgggatcaacaccgtgtacttcgccttcaacgagggcttcatccgctcgaacatcaagagcgacgagatcaaggcgttcaacgagaaaatccggcagcgccggatcaacctcctcaagcagagcaactactgctcgaacagccgcacggggaagggccgcgccaagcggctccagcccatcgacgtgctcagcaacaagatcgccaagttccgcaactccaccaaccacaagtacgcgaactacatcatcaagcagtgcctcaagcacaactgcgggcgcatccagatcgagctgttgaaggggatctccaagaacgacaaggtgctcaaggactggacctacttcgacctccaggagaaaatcaagaaccaggccgagatccacgggatcgaggtcatcaaggtggccccggcctacacgagccagcggtgcagccagtgcgggtacatctgcaaggagaaccggtgcacccaggcgatgttcgagtgcaagcagtgcgggtacaagacccacgcggactacaacgccgccaagaacatcagcacgtacgacatcgagaacatcatcaacaagcagcttgccgtgcagtcgaagctccactccaagaagtgcatggaggagtacatcgaggagctgggctacctcgactag

SEQ ID NO: 2230 - DNA, 1335 bp, Unknown
  Bacillus sp. multi
atgaagtaccagatcctctgccccatgaacgtggactggacgatcttcgagaagcacctccgcaacctcacgtaccaagtacggacgatcagcaaccggacgatccagcagctctgggagttcgacgccctgtccttcgactacttcaaggagcgcgggacgtacccgaccgtccaagacctctacgggtgcacgcagaagaagatagacggctacatctaccacaccctccagtcgaagtacccggacatccacaaggggaacatgagcaccaccctccagaaaatcatcaagacctggaagtcccggcggaacgagatccgcaagggcgagatgagcatcccgtccttccgcaaccgcatccccatcgacctccacaacaacagcgtggacatcaagaaggagaagaacggggactacatcgcggggatcagcctgttctcccgcgacttccacaaggagaactcggacgtcccgaagggcaaaatcttcgtgaagctggccaccaagaagcagaagtccatgaagatcatcctcgaccgcctgatgaaccagacctacagcaagggcgcgtgcatgatccacaagtacaagaacaagtggtatttgtcgatcacgtacaagttcaacgccatcaaggagaacaagttcgacaaggacctcattatggggatcgacatgggcgggatcaacaccgtgtacttcgccttcaacgagggcttcatccgctccaacatcaagagcgacgagatcaaggcgttcaacgagcgcatccgccagcgccggatcaacctgctcaagcagtccaagtactgctccaacagccgcatgggcaagggccgcgagaagcgcctccagcccatcgacgtgctctcgaacaagatcgccaagttccgcaactcgaccaaccacaagtacgccaactacatcatcaagcagtgcctcaagcacaactgcgggcgcatccagatggagctgctcaaggggatctccaagaacgacaaggtgctcaaggactggacctacttcgacctccaggagaaaatccagaaccaggccgagatccacggcatcgaggtcatcaaggtcgcgcccgcctacaccagccagcgctgctcccagtgcggctacatctgcaaggagaaccggtgcacccaggccgtcttcgagtgcaagcagtgcggctacaagacccacgccgactacaacacggccaagaacatcgccacgtacgacatcgagaacatcatcaacaagcagctcgccgtccagagcaagctccactccaagaagtgcatggaggagtacatcgaggagctgggctacctcgactag

SEQ ID NO: 2231 - DNA, 1335 bp, Unknown
  Bacillus sp. multi
atgaagtaccagatcctctgccccatgaacgtggactggaccatcttcgagaagcacctccgcaacctcacgtaccaagtccggacgatctccaaccgcaccatccagcagctctgggagttcgacgcgctgagcttcgactacttcaaggagcgcggcacgtacccgacggtccaagatctgtacggctgcacccagaagaagatcgacggctacatctaccacaccctccagagcaagtaccccgacatccacaagggcaacatgagcacgacgctccagaaaatcatcaagacctggaagtcccgccgcaacgagatccgcaagggcgagatgtccatcccgtccttccggaaccgcatccccatcgacctccacaacaactccgtggacatcaagaaggagaagaacggcgactacatcgcggggatctccctgttcagccgcgacttccacaaggagaacagcgacgtcccgaagggcaaaatcttcgtcaagctggcgaccaagaagcagaagtccatgaagatcatcctcgaccgcctgatgaaccagacgtacagcaagggcgcgtgcatgatccacaagtacaagaacaagtggtatctgagcatcacctacaagttcaacgccatcaaggagaacaagttcgacaaggaccttatcatggggatcgacatgggcgggatcaacacggtgtacttcgcgttcaacgaggggttcatccgcagcaacatcaagtcggacgagatcaaggcgttcaacgagcgcatccggcagcggcgcatcaacctcctcaagcagtccaaatactgttccaactcccggatgggcaaggggcgcgagaagcggctccagcccatcgacgtgctctccaacaagatcgccaagttccgcaactcgaccaaccacaagtacgccaactacatcatcaagcagtgcctcaagcacaactgcgggcgcatccagatggagctgctcaagggcatctccaagaacgacaaggtgctcaaggactggacgtacttcgacctccaggagaagatccaaaaccaggccgagatccacgggatcgaggtcatcaaggtggccccggcctacacgagccagcgctgctcccagtgcggctacatctgcaaggagaaccgctgcacccaggccgtcttcgagtgcaagcagtgcggctacaagacgcacgcggactacaacacggccaagaacatcgccacctacgacatcgagaacatcatcaacaagcagctcgcggtgcagtcgaagctgcactccaagaagtgcatggaggagtacatcgaggagctgggctacctggactag

SEQ ID NO: 2232 - DNA, 1335 bp, Unknown
  Bacillus sp. multi
atgaagtaccagatcctctgcccgatgaacgtggactggacgatcttcgagaagcacctccgcaacctcacgtaccaggtccggacgatctcgaaccgcacgatccagcagctctgggagttcgacgccctcagcttcgactacttcaaggagcgcggcacgtaccccaccgtccaagacctgtacggctgcacccagaagaagatagacgggtacatctaccacacgctccagtcgaagtaccccgacatccacaagggcaacatgagcaccacgctccagaagattatcaagacctggaagtcgcgccggaacgagatccgcaagggcgagatgtccatcccctccttccgcaaccgcatccccatcgacctccacaacaactccgtggacatcaagaaggagaagaacggcgactacatcgcggggatctccctcttcagccgggacttccacaaggagaacagcgacgtgccgaagggcaagatattcgtcaagctcgccaccaagaagcagaagtccatgaagatcatcctggaccgcctcatgaaccagacgtacagcaagggcgcgtgcatgatccacaagtacaagaacaagtggtacctctctataacctacaagttcaacgccatcaaggagaacaagttcgacaaagacttgataatgggcatcgacatgggcggcatcaacaccgtgtacttcgccttcaacgagggcttcatccggagcaacatcaagagcgacgagatcaaggcgttcaacgagcgcatccgccagcggcggatcaacctgctcaagcagagcaagtattgctccaactcccggatgggcaagggccgcgagaagcgcctccagcccatcgacgtcctcagcaacaagatcgccaagttccgcaactcgaccaaccacaagtacgcgaactacatcatcaagcagtgcctcaagcacaactgcgggcgcatccagatggagctgctcaagggcatcagcaagaacgacaaggtgctcaaggactggacgtacttcgacctccaggagaagatccagaaccaggccgagatccacggcatcgaggtcatcaaggtcgcgcccgcctacacctcccagcggtgctcccagtgcgggtacatctgcaaggagaaccggtgcacccaggccgtcttcgagtgcaagcagtgcgggtacaagacccacgccgactacaacacggccaagaacatcgccacctacgacatcgagaacatcatcaacaagcagctcgcggtgcagtcgaagctgcacagcaagaagtgcatggaggagtacatcgaggagctgggctacctcgactga

SEQ ID NO: 2233 - DNA, 1335 bp, Unknown
  Bacillus sp. multi
atgaagtaccagatcctctgcccgatgaacgtggactggaccatcttcgagaagcacctccggaacctgacgtaccaggtgcggacgatcagcaaccgcacgatccagcagctctgggagttcgacgccctcagcttcgactacttcaaggagcgcggcacctaccccaccgtccaggatctatacggctgcacgcagaagaagatcgacggctacatctaccacaccctccagagcaagtacccggacatccacaagggcaacatgagcaccaccctccagaaaatcatcaagacctggaagtcccgccggaacgagatccggaagggcgagatgtcgatcccctccttccgcaaccgcatccccatcgacctccacaacaacagcgtggacatcaagaaggagaagaatggggactacatcgcgggcatctccctgttcagccgcgacttccacaaggagaactccgacgtcccgaagggcaagattttcgtcaagctggccaccaagaagcagaagtccatgaagatcatcctggaccgcctgatgaaccagacctacagcaagggcgcgtgcatgatccacaagtacaagaacaagtggtacttgtccatcacctacaagttcaacgccatcaaggagaacaagttcgacaaagacttgataatggggatcgacatgggcggcatcaacaccgtgtacttcgccttcaacgaggggttcatccgctccaacatcaagagcgacgagatcaaggcgttcaacgagcgcatccgccagcggcggatcaacctcctcaagcagagcaagtactgttccaacagccgcatggggaaggggcgcgagaagcgcctccagcccatcgacgtcctgagcaacaagatcgccaagttccgcaactcgaccaaccacaagtacgcgaactacatcatcaagcagtgcctcaagcacaactgcgggcgcatccagatggagctgctcaagggcatctccaagaacgacaaggtgctcaaggactggacctacttcgacctccaggagaagatccagaaccaggccgagatccacggcatcgaggtcatcaaggtcgccccggcctacacctcccagcggtgcagccagtgcgggtacatctgcaaggagaaccggtgcacccaggcggtcttcgagtgcaagcagtgcggctacaagacccacgcggactacaacaccgccaagaacatcgccacgtacgacatcgagaacatcatcaacaagcagctcgccgtgcagtcgaagctgcacagcaagaagtgcatggaggagtacatcgaggagctgggctacctcgactag

SEQ ID NO: 2234 - DNA, 1335 bp, Unknown
  Bacillus sp. multi
atgaagtaccagatcctctgccccatgaacgtggactggacgatcttcgagaagcacctccggaacctcacgtaccaggtccggacgatctccaaccggaccatccagcagctctgggagttcgacgccctctccttcgactacttcaaggagcgcgggacgtacccgaccgtccaagacctgtacggctgcacccagaagaagatagacggctacatctaccacaccctccagagcaagtaccccgacatccacaaggggaacatgagcaccaccctccagaagatcatcaagacctggaagtcgcggcggaacgagatccgcaagggcgagatgtcgatcccgtccttccgcaaccgcatccccatcgacctgcacaacaactcggtggacatcaagaaggagaagaatggcgactacatcgcggggatcagcctcttcagccgggacttccacaaggagaactccgacgtcccgaagggcaagatattcgtgaagctcgccaccaagaagcagaagtcgatgaagatcatcctcgaccggctcatgaaccagacctactcgaagggcgcgtgcatgatccacaagtacaagaacaagtggtatctcagcatcacctacaagttcaacgccatcaaggagaacaagttcgacaaggatctcatcatgggcatcgacatgggcggcatcaacaccgtgtacttcgcgttcaacgaggggttcatccggagcaacatcaagtcggacgagatcaaggcgttcaacgagcgcatccggcagcggcggatcaacctcctcaagcagagcaaatactgttccaactcgcggatggggaagggccgggagaagcgcctccagcccatcgacgtgctgtcgaacaagatcgccaagttccgcaacagcaccaaccacaagtacgccaactacatcatcaagcagtgcctcaagcacaactgcgggcgcatccagatggagctgctcaagggcatcagcaagaacgacaaggtgctcaaggactggacctacttcgacctccaggagaagatacagaaccaggcggagatccacgggatcgaggtcatcaaggtggccccggcctacacctcgcagcggtgctcccagtgcgggtacatctgcaaggagaaccggtgcacccaggccgtgttcgagtgcaagcagtgcggctacaagacccacgccgactacaacaccgccaagaacatcgccacgtacgacatcgagaacatcatcaacaagcagctcgccgtgcagtccaagctgcacagcaagaagtgcatggaggagtacatcgaggagctgggctacctcgactga

SEQ ID NO: 2235 - DNA, 1335 bp, Unknown
  Bacillus sp. multi
atgaagtaccagatcctctgccccatgaacgtggactggacgatcttcgagaagcacctccgcaacctgacctaccaggtgcggacgatctccaaccgcaccatccagcagctctgggagttcgacgccctgtcgttcgactacttcaaggcgcgcggcacctaccccacggtccaggatctgtacggctgcacgcagaagaaaatcgacggctacatctaccacaagctccagagcaagtacccggacatccacaaggggaacatgagcaccaccctccaaaagattatcaagacctggaagtcccgccgcaacgagatccgcaagggcgagatgtcgatcccctccttccgcaaccgcatccccatcgacctgcacaacaactcggtcgagatcacgaaggagaagaatggggactacatcgcggggatctcgctgttctcccgcgacttccacaaggagaacggcgacgtgccgaagggcaagatattcctcaagctggggacgcagaagcagaagtccatgaaggtgatcctcgaccggctcatcaaccagacctactcgaagggcgcgtgcatgatccacaagtacaagaacaagtggtacttgtcgatcacctacaagttcaacgcgatcaaggagaacaagttcgacaaggagctaatcatgggcatcgacatgggcggcatcaacacggtgtacttcgccttcaacgagggcttcatccgctcgaacatcaagtccgacgagatcaaggcgttcaacgagaaaatccggcagcgccggatcaacctgctcaagcagtccaactactgctccaactcccggacgggcaagggccgcgcgaagcggctccagcccatcgacgtgctgtccaacaagatcgccaagttccgcaactccaccaaccacaagtacgccaactacatcatcaagcagtgcctcaagcacaactgcgggcgcatccagatcgagttgctcaaggggatcagcaagaacgacaaggtgctcaaggactggacgtacttcgacctccaggagaaaatcaagaaccaggcggagatccacggcatcgaggtcatcaaggtcgcgcccgcctacaccagccagcggtgctcgcagtgcggctacatctgcaaggagaaccgctgcacccaggccatgttcgagtgcaagcagtgcggctacaagacgcacgcggactacaacgcggccaagaacatcagcacctacgacatcgagaacatcatcaacaagcagcttgcggtccagagcaagctccactccaagaagtgcatggaggagtacatcgaggagctgggctacctcgactag

SEQ ID NO: 2236 - DNA, 1335 bp, Unknown
  Bacillus sp. multi
atgaagtaccagatcctctgccccatgaacgtggactggacgatcttcgagaagcacctccgcaacctgacgtaccaagtgcggacgatctccaaccggaccatccagcagctctgggagttcgacgccctgtcgttcgactacttcaaggcgcgcgggacgtaccccacggtccaagacctctacggctgcacgcagaagaagatagacgggtacatctaccacaagctccagtcgaagtaccccgacatccacaaggggaacatgagcaccaccctccagaaaatcatcaagacctggaagtcccgccgcaacgagatccgcaagggcgagatgagcatcccgtccttccgcaaccgcatccccatcgacctccacaacaactcggtcgagatcacgaaggagaagaacggggactacatcgcgggcatctcgctgttctcccgcgacttccacaaggagaacggcgacgtcccgaagggcaaaatcttcctcaagctcgggacgcagaagcagaagtccatgaaggtcatcctggaccggctcatcaaccagacgtacagcaagggcgcgtgcatgatccacaagtacaagaacaagtggtatctgtccattacctacaagttcaacgcgatcaaggagaacaagttcgacaaggaattgatcatggggatcgacatgggcggcatcaacaccgtgtacttcgccttcaacgagggcttcatccgctcgaacatcaagagcgacgagatcaaggcgttcaacgagaagatacgccagcgccgcatcaacctgctcaagcagagcaactactgctcgaactcccgcacgggcaaggggcgggccaagcgcctccagcccatcgacgtgctgagcaacaagatcgccaagttccgcaacagcacgaaccacaagtacgccaactacatcatcaagcagtgcctcaagcacaactgcgggcgcatccagatcgagctgctcaaggggatcagcaagaacgacaaggtgctcaaggactggacctacttcgacctccaggagaagattaagaaccaggccgagatccacggcatcgaggtcatcaaggtcgccccggcctacacctcccagcgctgctcgcagtgcggctacatctgcaaggagaaccgctgcacccaggcgatgttcgagtgcaagcagtgcgggtacaagacccacgcggactacaacgcggccaagaacatctcgacctacgacatcgagaacatcatcaacaagcagttggcggtgcagtcgaagctccactccaagaagtgcatggaggagtacatcgaggagctgggctacctggactag

SEQ ID NO: 2237 - DNA, 1335 bp, Unknown
  Bacillus sp. multi
atgaagtaccagatcctctgccccatgaacgtggactggaccatcttcgagaagcacctccggaacctgacctaccaagtgcggacgatctccaaccggaccatccagcagctctgggagttcgacgcgctgtccttcgactacttcaaggcgcggggcacgtacccgaccgtccaagacctctacgggtgcacgcagaagaagatcgacggctacatctaccacaagctccagagcaagtacccggacatccacaagggcaacatgagcaccacgctccagaagatcatcaagacctggaagtcccgccgcaacgagatccgcaagggcgagatgagcatcccgtccttccgcaaccgcatccccatcgacctgcacaacaactccgtggagatcacgaaggagaagaacggggactacatcgcgggcatcagcctgttcagccgcgacttccacaaggagaacggggacgtgccgaagggcaagattttcctcaagctgggcacgcagaagcagaagtccatgaaggtgatcctcgaccggctcatcaaccagacctacagcaagggcgcgtgcatgatccacaagtacaagaacaagtggtatctgtccatcacctacaagttcaacgcgatcaaggagaacaagttcgacaaggagttaatcatgggcatcgacatgggcggcatcaacaccgtgtacttcgccttcaacgagggcttcatccggtcgaacatcaagtccgacgagatcaaggcgttcaacgagaaaatccgccagcggcggatcaacctcctcaagcagtcgaactactgctcgaacagccggacgggcaaggggcgcgcgaagcgcctccagcccatcgacgtcctctccaacaagatcgccaagttccgcaacagcacgaaccacaagtacgcgaactacatcatcaagcagtgcctcaagcacaactgcgggcgcatccagatagagctgctgaaagggatcagcaagaacgacaaggtgctcaaggactggacctacttcgacctccaggagaaaatcaagaaccaggccgagatccacgggatcgaggtcatcaaggtcgcgcccgcctacacctcccagcggtgcagccagtgcggctacatctgcaaggagaaccggtgcacccaggcgatgttcgagtgcaagcagtgcggctacaagacccacgccgactacaacgccgccaagaacatctccacgtacgacatcgagaacatcatcaacaaacagttggccgtccagagcaagctccactccaagaagtgcatggaggagtacatcgaggagctgggctacctcgactag

SEQ ID NO: 2238 - DNA, 1335 bp, Unknown
  Bacillus sp. multi
atgaagtaccagatcctctgcccgatgaacgtggactggaccatcttcgagaagcacctccgcaacctgacctaccaggttcggacgatctccaaccgcaccatccagcagctctgggagttcgacgcgctcagcttcgactacttcaaggcgcgcggcacgtacccgaccgtccaggatctatacggctgcacccagaagaaaatcgacgggtacatctaccacaagctccagagcaagtacccggacatccacaagggcaacatgagcaccaccctccagaagatcatcaagacctggaagtcccggcgcaacgagatccgcaagggcgagatgagcatcccgagcttccgcaaccgcatccccatcgacctccacaacaactcggtggagatcacgaaggagaagaatggcgactacatcgcgggcatcagcctgttctcccgcgacttccacaaggagaacggggacgtgccgaagggcaaaatcttcctcaagctggggacgcagaagcagaagtccatgaaggtcatcctcgaccgcctcatcaaccagacctacagcaagggcgcgtgcatgatccacaagtacaagaacaagtggtacctcagcatcacctacaagttcaacgccatcaaggagaacaagttcgacaaggaattgatcatgggcatcgacatgggcgggatcaacaccgtgtacttcgccttcaacgaggggttcatccggtcgaacatcaagtcggacgagatcaaggcgttcaacgagaagatccggcagcgccggatcaacctgctcaagcagagcaactactgctccaacagccgcacgggcaagggccgcgcgaagcgcctccagcccatcgacgtgctctcgaacaagatcgccaagttccgcaactccaccaaccacaagtacgccaactacatcatcaagcagtgcctcaagcacaactgcgggcgcatccagatcgaattgctcaaggggatcagcaagaacgacaaggtgctcaaggactggacctacttcgacctccaggagaagattaagaatcaggccgagatccacggcatcgaggtcatcaaggtcgccccggcctacacctcccagcggtgcagccagtgcggctacatctgcaaggagaaccgctgcacccaggcgatgttcgagtgcaagcagtgcgggtacaagacccacgccgactacaacgcggccaagaacatcagcacgtacgacatcgagaacatcatcaacaagcagctcgccgtgcagtccaagctgcactccaagaagtgcatggaggagtacatcgaggagctgggctacctcgactag

SEQ ID NO: 2239 - DNA, 1335 bp, Unknown
  Bacillus sp. multi
atgaagtaccagatcctctgccccatgaacgtggactggaccatcttcgagaagcacctccgcaacctgacctaccaagtacggacgatctcgaaccggacgatccagcagctctgggagttcgacgccctctcgttcgactacttcaaggcgcgcggcacgtacccgaccgtccaagacctctacgggtgcacgcagaagaagatagacggctacatctaccacaagctccagagcaagtacccggacatccacaaggggaacatgagcacgacgctccaaaagatcatcaagacctggaagtcccggcggaacgagatccgcaagggcgagatgagcatcccgagcttccgcaaccgcatccccatcgacctgcacaacaacagcgtcgagatcacgaaggagaagaacggcgactacatcgcgggcatcagcctcttcagccgcgacttccacaaggagaacggcgacgtgccgaagggcaagatattcctcaagctgggcacccagaagcagaagtccatgaaggtcatcctcgaccgcctcatcaaccagacctactcgaagggcgcgtgcatgatccacaagtacaagaacaagtggtacttgtccatcacctacaagttcaacgccatcaaggagaacaagttcgacaaggagctaatcatgggcatcgacatgggcgggatcaacacggtgtacttcgccttcaacgagggcttcatccgctcgaacatcaagtccgacgagatcaaggcgttcaacgagaaaatccgccagcgccgcatcaacctcctcaagcagagcaactactgctccaactcgcgcaccggcaagggccgcgccaagcgcctccagcccatcgacgtcctctcgaacaagatcgccaagttccgcaacagcaccaaccacaagtacgccaactacatcatcaagcagtgcctcaagcacaactgcgggcgcatccagatcgagctgctcaaggggatcagcaagaacgacaaggtgctcaaggactggacctacttcgacctccaggagaagatcaagaaccaggcggagatccacgggatcgaggtcatcaaggtggccccggcctacacctcgcagcggtgcagccagtgcggctacatctgcaaggagaaccggtgcacccaggccatgttcgagtgcaagcagtgcggctacaagacccacgcggactacaacgccgccaagaacatctcgacgtacgacatcgagaacatcatcaacaagcaacttgccgtgcagtcgaagctccactccaagaaatgcatggaggagtacatcgaggagctgggctacctggactga

SEQ ID NO: 2240 - DNA, 1368 bp, Unknown
  Bacillus sp. multi
ctgggcgtcaccatcaagatcatgaagtaccagatcctctgccccatgaacgtggactggatcatcttcgagaagcacctccggaacctgacctaccaagtgcggacgatctcgaaccgcaccatccagcagctctgggagttcgacgccctgtcgttcgactacttcaaggagcgcggcacgtaccccaccgtccaagacctctacggctgcacgcgcaagaagattgacgtgtatatctaccacacgctccagagcaagtaccccgacatccacaagggcaacatgagcaccacgctccagaagattatcaagacctggaagtcccgccgcaacgagatccgcaagggcgagatgagcatcccctccttccgcaaccgcatccccatcgacctccacaacaacagcgtggacatcacgaaggagaagaacggcgactacatcgccgggatcagcctgttcagccgcgacttccacaaggagaacgacgacgtgccgaagggcaaaatcttcgtcaagctggccacccagaagcagaagtccatgaaggtcatcctcgaccggctcatcaaccagacctacagcaagggcgcgtgcatgatccacaagtacaagaacaagtggtacctctccatcacctacaagttcaacgccatcaaggagaacaagttcgacaaggagctgattatgggcatcgacctcggcgggatcaacacggtgtacttcgcgttcaacgaggggttcatccggtccaacatcaagagcgacgagatcaagatgttcaacgagcgcatccgccagcgccgcatcaacctgctcaagcagagcaagtattgctccaacagccgcacggggaaggggcgcaccaagcgcctccagcccatcgacgtgctctccaacaagatcgccaagttccgcaacagcaccaaccacaagtacgccaactacatcgtcaagcagtgcctcaagcacaactgcgggcgcatccagatggagctgctcaagggcatcagcaagaacgacaagatcctcaaggactggacctacttcgacctccaggagaagattaagaatcaggccgagatccacgggatcgaggtcatcaaggtcgcgcccgcctacacctcccagcggtgcagccagtgcgggtacatctgcaaggagaaccgctgcacccaggcgaccttcgagtgcaagcagtgcggctacaagacccacgccgactacaacgccgccaagaacatctcgacgtacgacatcgagaacatcatcaacaagcagctcgccgtccagagcaagctccacagcaagaagtgcatggaggagtacatcgaggagtacatcgaggagctgggctacctggactag

SEQ ID NO: 2241 - DNA, 1368 bp, Unknown
  Bacillus sp. multi
ctgggcgtgaccatcaagatcatgaagtaccagatcctctgccccatgaacgtggactggatcatcttcgagaagcacctccggaacctgacctaccaagtgcggacgatctcgaaccggaccatccagcagctctgggagttcgacgccctgagcttcgactacttcaaggagcgcggcacctaccccaccgtccaagacctgtacggctgcacgcgcaagaagatcgacgtttacatctaccacaccctccagagcaagtacccggacatccacaagggcaacatgagcacgacgctccagaaaatcatcaagacctggaagtcgcggcgcaacgagatccggaagggcgagatgtcgatcccgtccttccgcaaccgcatccccatcgacctgcacaacaacagcgtggacatcacgaaggagaagaacggcgactacatcgcggggatcagcctgttcagccgggacttccacaaggagaacgacgacgtgccgaagggcaagatattcgtgaagctggcgacccagaagcagaagtcgatgaaggtgatcctggaccgcctcatcaaccagacctacagcaagggcgcgtgcatgatccacaagtacaagaacaagtggtatctgagcatcacctacaagttcaacgcgatcaaggagaacaagttcgacaaggagctcataatggggatcgacctcggcggcatcaacaccgtgtacttcgccttcaacgaggggttcatccgctccaacatcaagtcggacgagatcaagatgttcaacgagcgcatccgccagcgccggatcaacctgctcaagcagtccaaatactgctccaacagccgcacgggcaagggccggacgaagcgcctccagcccatcgacgtcctgtccaacaagatcgccaagttccgcaactccaccaaccacaagtacgccaactacatcgtgaagcagtgcctcaagcacaactgcgggcgcatccagatggagctgctcaaggggatctccaagaacgacaagatcctcaaggactggacctacttcgacctccaggagaagattaagaaccaggccgagatccacggcatcgaggtcatcaaggtcgccccggcctacaccagccagcggtgctcccagtgcggctacatctgcaaggagaaccgctgcacccaggccaccttcgagtgcaagcagtgcggctacaagacccacgccgactacaacgcggccaagaacatcagcacctacgacatcgagaacatcatcaacaagcagctcgccgtgcagtcgaagctgcacagcaagaaatgcatggaggagtacatcgaggagtacatcgaggagctgggctacctggactga

SEQ ID NO: 2242 - DNA, 1368 bp, Unknown
  Bacillus sp. multi
ctcggcgtgaccatcaagatcatgaagtaccagatcctctgccccatgaacgtggactggatcatcttcgagaagcacctccgcaacctgacgtaccaagtccggacgatctcgaaccgcacgatccagcagctctgggagttcgacgccctctcgttcgactacttcaaggagcggggcacctaccccacggtccaggatctatacggctgcacccgcaagaagatcgatgtctatatctaccacaccctccagagcaagtacccggacatccacaaggggaacatgagcaccaccctccagaaaatcatcaagacctggaagtcccgccgcaacgagatccggaagggcgagatgtcgatccccagcttccgcaaccgcatccccatcgacctccacaacaactccgtggacatcacgaaggagaagaatggggactacatcgcggggatcagcctcttcagccgcgacttccacaaggagaacgacgacgtgccgaagggcaagatattcgtgaagctcgccacgcagaagcagaagtcgatgaaggtcatcctggaccggctcatcaaccagacctacagcaagggcgcgtgcatgatccacaagtacaagaacaagtggtacctgagcatcacctacaagttcaacgcgatcaaggagaacaagttcgacaaggagctgattatgggcatcgacctcggcggcatcaacaccgtgtacttcgcgttcaacgaggggttcatccggtcgaacatcaagtcggacgagatcaagatgttcaacgagcgcatccggcagcgccgcatcaacctgctcaagcagagcaaatactgctccaactcccgcacggggaaggggcgcaccaagcggctccagcccatcgacgtgctctcgaacaagatcgccaagttccgcaactcgaccaaccacaagtacgccaactacatcgtgaagcagtgcctcaagcacaactgcgggcgcatccagatggagctgctcaaggggatcagcaagaacgacaagatcctcaaggactggacctacttcgacctccaggagaagatcaagaaccaggcggagatccacggcatcgaggtcatcaaggtcgccccggcctacacctcccagcgctgctcgcagtgcggctacatctgcaaggagaaccggtgcacccaggccacgttcgagtgcaagcagtgcgggtacaagacccacgcggactacaacgcggccaagaacatcagcacctacgacatcgagaacatcatcaacaagcagctcgcggtgcagtcgaagctgcacagcaagaagtgcatggaggagtacatcgaggagtacatcgaggagctgggctacctggactag

SEQ ID NO: 2243 - DNA, 1368 bp, Unknown
  Bacillus sp. multi
ctcggcgtcaccatcaagatcatgaagtaccagatcctctgccccatgaacgtggactggatcatcttcgagaagcacctccgcaacctcacctaccaagtccggacgatctccaaccgcacgatccagcagctctgggagttcgacgcgctgagcttcgactacttcaaggagcggggcacgtacccgaccgtccaggatctctacggctgcacgcgcaagaagatcgacgtctatatctaccacaccctccagagcaagtacccggacatccacaagggcaacatgagcacgacgctccagaagattatcaagacctggaagtcccggcgcaacgagatccgcaagggcgagatgtccatcccctccttccgcaaccgcatccccatcgacctgcacaacaactccgtggacatcacgaaggagaagaatggcgactacatcgcgggcatcagcctgttctcccgcgacttccacaaggagaacgacgacgtgccgaagggcaagatcttcgtcaagctggccacccagaagcagaagtccatgaaggtgatcctggaccggctcatcaaccagacctactcgaagggcgcgtgcatgatccacaagtacaagaacaagtggtatttgagcatcacctacaagttcaacgccatcaaggagaacaagttcgacaaggagcttatcatgggcatcgacctgggcggcatcaacaccgtgtacttcgcgttcaacgaggggttcatccgctccaacatcaagagcgacgagatcaagatgttcaacgagcgcatccgccagcggcgcatcaacctgctcaagcagtccaagtattgttccaacagccgcaccgggaaggggcggaccaagcggctccagcccatcgacgtgctcagcaacaagatcgccaagttccgcaacagcacgaaccacaagtacgcgaactacatcgtgaagcagtgcctcaagcacaactgcgggcgcatccagatggagctgctcaagggcatctccaagaacgacaagatcctcaaggactggacgtacttcgacctccaggagaagatcaagaaccaggcggagatccacggcatcgaggtcatcaaggtcgccccggcctacacgagccagcgctgctcgcagtgcgggtacatctgcaaggagaaccgctgcacccaggccacgttcgagtgcaagcagtgcgggtacaagacccacgccgactacaacgccgccaagaacatcagcacgtacgacatcgagaacatcatcaacaagcagctcgcggtccagagcaagctccacagcaagaagtgcatggaggagtacatcgaggagtacatcgaggagctgggctacctcgactga

SEQ ID NO: 2244 - DNA, 1368 bp, Unknown
  Bacillus sp. multi
ctgggcgtgacgatcaagatcatgaagtaccagatcctctgccccatgaacgtggactggatcatcttcgagaagcacctccggaacctcacgtaccaggtccggacgatctccaaccgcaccatccagcagctctgggagttcgacgccctgagcttcgactacttcaaggagcggggcacctaccccacggtccaggatctgtacggctgcacgcgcaagaagatcgacgtctacatctatcacacgctccagtcgaagtaccccgacatccacaaggggaacatgagcaccaccctccagaaaatcatcaagacctggaagtcccgccgcaacgagatccggaagggcgagatgtccatccccagcttccgcaaccgcatccccatcgacctccacaacaactccgtggacatcacgaaggagaagaatggcgactacatcgcgggcatcagcctgttctcccgcgacttccacaaggagaacgacgacgtgccgaagggcaaaatcttcgtcaagctggccacgcagaagcagaagtccatgaaggtgatcctggaccggctcatcaaccagacgtacagcaagggcgcgtgcatgatccacaagtacaagaacaagtggtacttgtccatcacctacaagttcaacgcgatcaaggagaacaagttcgacaaggagcttatcatggggatcgacctcggcggcatcaacaccgtgtacttcgccttcaacgaggggttcatccgctccaacatcaagtccgacgagatcaagatgttcaacgagcgcatccgccagcgccgcatcaacctgctcaagcagagcaagtattgttcgaactcccgcaccgggaagggccggaccaagcgcctccagcccatcgacgtcctgtccaacaagatcgccaagttccgcaacagcacgaaccacaagtacgcgaactacatcgtgaagcagtgcctcaagcacaactgcgggcgcatccagatggagctgctcaaggggatcagcaagaacgacaagatcctcaaggactggacctacttcgacctccaggagaagatcaagaaccaggccgagatccacgggatcgaggtcatcaaggtcgccccggcctacacctcgcagcggtgctcgcagtgcggctacatctgcaaggagaaccggtgcacccaggccaccttcgagtgcaagcagtgcgggtacaagacgcacgccgactacaacgccgccaagaacatcagcacctacgacatcgagaacatcatcaacaagcagctcgccgtgcagagcaagctgcacagcaagaagtgtatggaggagtacatcgaggagtacatcgaggagctgggctacctcgactga

SEQ ID NO: 2245 - DNA, 1335 bp, Unknown
  Bacillus sp. multi
atgaagtaccagatcctctgcccgatgaacgtggactggacgatcttcgagaagcacctccggaacctcacgtaccaagtgcggacgatcagcaaccgcaccatccagcagctctgggagttcgacgccctgagcttcgactacttcaaggagcgcggcacgtacccgaccgtccaggatctctacggctgcacgcagaagaaaattgacgggtacatctaccacaccctccagagcaagtaccccgacatccacaagggcaacatgagcaccaccctccagaaaatcattaagacctggaagtcgcgccgcaacgagatccgcaagggcgagatgtcggtgccctccttccgcaaccacatccccatcgacatccacaacaactccgtggacatcacgaaggagaagaatggcgactacatcgccgggatcagcctgttctcgcgggacttccacaaggagaacggcgacgtgccgaagggcaagatattcgtcaagctcagcacccagaagcagaagtcgatgaaggtcatcctcgaccggctgatgaaccagacctactcgaagggcgcgtgcatgatccacaagtacaagaacaagtggtacctgtccatcacgtacaagttcaacgccatcaaggagaacaagttcgacaaagatctcatcatggggatcgacatgggcgggatcaacacggtgtacttcgcgttcaacgagggcttcatccgctccaacatcaagtcggacgagatcaaggcgttcaacgagcgcatccgccagcggcgcatcaacctgctcaagcagtccaagtattgctccaactcccggacggggaagggccgcgagaagcgcctccagcccatcgacgtcctgtcgaacaagatcgccaagttccgcaacagcaccaaccacaagtacgcgaactacatcatcaagcagtgcctcaagcacaactgcgggcgcatccacatggagctgctcaagggcatcagcaagaacgacaaggtgctcaaggactggacctacttcgacctccaggagaaaatccaaaaccaggcggagatccacggcatcgaggtcatcaaggtcgccccggcctacaccagccagcgctgctcgcagtgcggctacatctgcaaggagaaccggtgcacccaggccgtgttcgagtgcaagcagtgcgggtacaagacccacgcggactacaacgcggccaagaacatcgccacgtacgacatcgagaacatcatcaacaagcagctcgcggtgcagtccaagctgcacagcaagaaatgcatggaggagtacatcgaggagctgggctacctggactag

SEQ ID NO: 2246 - DNA, 1335 bp, Unknown
  Bacillus sp. multi
atgaagtaccagatcctctgcccgatgaacgtggactggaccatcttcgagaagcacctccgcaacctcacctaccaagtccggacgatctccaaccggacgatccagcagctctgggagttcgacgccctcagcttcgactacttcaaggagcgcggcacgtacccgacggtccaggacctatatggctgcacgcagaagaagatagacgggtacatctaccacaccctccagagcaagtaccccgacatccacaagggcaacatgagcacgaccctccagaagattatcaaaacctggaagtcccgccgcaacgagatccggaagggcgagatgtcggtgccctcgttccgcaaccacatccccatcgacatccacaacaacagcgtggacatcacgaaggagaagaacggggactacatcgcgggcatctcgctgttcagccgcgacttccacaaggagaacggcgacgtcccgaagggcaagatattcgtaaagctgagcacgcagaagcagaagtccatgaaggtgatcctggaccggctcatgaaccagacctacagcaagggcgcgtgcatgatccacaagtacaagaacaagtggtatttgagcatcacctacaagttcaacgccatcaaggagaacaagttcgacaaagacttgataatgggcatcgacatgggcggcatcaacaccgtgtacttcgcgttcaacgaggggttcatccgctccaacatcaagagcgacgagatcaaggcgttcaacgagcgcatccgccagcggcggatcaacctcctcaagcagagcaagtattgctccaacagccggacggggaagggccgggagaagcggctccagcccatcgacgtcctgagcaacaagatcgccaagttccgcaacagcaccaaccacaagtacgcgaactacatcatcaagcagtgcctcaagcacaactgcgggcgcatccacatggagctgctcaagggcatctccaagaacgacaaggtgctcaaggactggacctacttcgacctccaggagaagatccagaaccaggcggagatccacgggatcgaggtcatcaaggtcgcgcccgcctacacctcccagcggtgctcccagtgcggctacatctgcaaggagaaccggtgcacccaggcggtgttcgagtgcaagcagtgcgggtacaagacccacgcggactacaacgccgccaagaacatcgccacctacgacatcgagaacatcatcaacaagcagctcgcggtgcagtcgaagctccacagcaagaagtgcatggaggagtacatcgaggagctgggctacctggactga

SEQ ID NO: 2247 - DNA, 1335 bp, Unknown
  Bacillus sp. multi
atgaagtaccagatcctctgccccatgaacgtggactggaccatcttcgagaagcacctccgcaacctgacctaccaagtgcggacgatcagcaaccggaccatccagcagctctgggagttcgacgccctgtcgttcgactacttcaaggagcggggcacgtacccgaccgtccaagacctatacggctgcacccagaagaaaattgacggctacatctaccacaccctccagagcaagtaccccgacatccacaagggcaacatgagcaccaccctccagaaaatcatcaagacctggaagtcccgccgcaacgagatccggaagggcgagatgagcgtcccgtccttccgcaaccacatccccatcgacatccacaacaacagcgtggacatcacgaaggagaagaacggggactacatcgcggggatctccctgttctcccgcgacttccacaaggagaacggcgacgtcccgaagggcaaaatcttcgtgaagctcagcacccagaagcagaagtccatgaaggtcatcctggaccggctgatgaaccagacctacagcaagggcgcgtgcatgatccacaagtacaagaacaagtggtatctgtcgattacctacaagttcaacgccatcaaggagaacaagttcgacaaagatctgatcatgggcatcgacatgggcggcatcaacacggtgtacttcgccttcaacgagggcttcatccgctccaacatcaagagcgacgagatcaaggcgttcaacgagcgcatccggcagcgccgcatcaacctcctcaagcagagcaagtattgctccaactcccgcaccgggaaggggcgggagaagcgcctccagcccatcgacgtgctgtccaacaagatcgccaagttccgcaacagcacgaaccacaagtacgcgaactacatcatcaagcagtgcctcaagcacaactgcgggcgcatccacatggagctgctcaaggggatctccaagaacgacaaggtgctcaaggactggacctacttcgacctccaggagaaaatccagaaccaggccgagatccacggcatcgaggtcatcaaggtggccccggcctacaccagccagcgctgctcgcagtgcgggtacatctgcaaggagaaccggtgcacccaggcggtgttcgagtgcaagcagtgcggctacaagacccacgccgactacaacgccgccaagaacatcgccacctacgacatcgagaacatcatcaacaagcagctcgccgtgcagtccaagctgcacagcaagaagtgtatggaggagtacatcgaggagctgggctacctcgactga

SEQ ID NO: 2248 - DNA, 1335 bp, Unknown
  Bacillus sp. multi
atgaagtaccagatcctctgccccatgaacgtggactggaccatcttcgagaagcacctccggaacctgacgtaccaagttcggacgatctcgaaccgcaccatccagcagctctgggagttcgacgcgctgagcttcgactacttcaaggagcgcggcacgtaccccaccgtccaagacttgtacggctgcacccagaagaaaatcgacggctacatctaccacaccctccagagcaagtacccggacatccacaagggcaacatgagcacgaccctccagaagatcattaagacctggaagtcacgccgcaacgagatccgcaagggcgagatgtccgtcccgtccttccgcaaccacatccccatcgacatccacaacaactccgtggacatcacgaaggagaagaatggcgactacatcgcggggatcagcctgttctcgcgggacttccacaaggagaacggcgacgtgccgaagggcaagattttcgtcaagctgtccacgcagaagcagaagtccatgaaggtcatcctggaccgcctcatgaaccagacgtactcgaagggcgcgtgcatgatccacaagtacaagaacaagtggtacttgagcatcacgtacaagttcaacgcgatcaaggagaacaagttcgacaaagacctcatcatgggcatcgacatgggcgggatcaacaccgtgtacttcgcgttcaacgagggcttcatccggtccaacatcaagagcgacgagatcaaggcgttcaacgagcgcatccggcagcgccggatcaacctcctcaagcagtccaaatactgctccaactcccgcaccgggaagggccgcgagaagcgcctccagcccatcgacgtgctctccaacaagatcgccaagttccgcaactccaccaaccacaagtacgccaactacatcatcaagcagtgcctcaagcacaactgcgggcgcatccacatggagctgctcaaggggatctccaagaacgacaaggtgctcaaggactggacgtacttcgacctccaggagaagatacagaaccaggccgagatccacggcatcgaggtcatcaaggtggccccggcctacacctcccagcgctgctcccagtgcggctacatctgcaaggagaaccggtgcacccaggcggtcttcgagtgcaagcagtgcgggtacaagacgcacgccgactacaacgccgccaagaacatcgccacctacgacatcgagaacatcatcaacaagcagctcgcggtccagagcaagctgcacagcaagaaatgcatggaggagtacatcgaggagctgggctacctcgactga

SEQ ID NO: 2249 - DNA, 1335 bp, Unknown
  Bacillus sp. multi
atgaagtaccagatcctctgcccgatgaacgtggactggaccatcttcgagaagcacctccgcaacctgacgtaccaagtgcggacgatcagcaaccgcacgatccagcagctctgggagttcgacgcgctcagcttcgactacttcaaggagcgcggcacctaccccacggtccaggatctctacgggtgcacgcaaaagaaaatagacggctacatctaccacaccctccagtcgaagtaccccgacatccacaagggcaacatgagcacgacgctccagaaaatcattaagacctggaagtcccggcgcaacgagatccggaagggcgagatgagcgtgccgtccttccgcaaccacatccccatcgacatccacaacaactccgtggacatcacgaaggagaagaatggcgactacatcgcggggatcagcctgttctcgcgcgacttccacaaggagaacggcgacgtcccgaagggcaaaatcttcgtcaagctcagcacgcagaagcagaagtccatgaaggtgatcctggaccggctcatgaaccagacgtacagcaagggcgcgtgcatgatccacaagtacaagaacaagtggtacttgagcatcacctacaagttcaacgccatcaaggagaacaagttcgacaaggatctcataatggggatcgacatgggcgggatcaacaccgtgtacttcgccttcaacgagggcttcatccggtccaacatcaagtcggacgagatcaaggcgttcaacgagcgcatccggcagcggcgcatcaacctcctcaagcagtccaagtattgttccaacagccggacggggaagggccgcgagaagcgcctccagcccatcgacgtgctgtcgaacaagatcgccaagttccgcaacagcaccaaccacaagtacgccaactacatcatcaagcagtgcctcaagcacaactgcgggcgcatccacatggagctgctcaagggcatcagcaagaacgacaaggtgctcaaggactggacgtacttcgacctccaggagaagatccagaaccaggcggagatccacgggatcgaggtcatcaaggtcgccccggcctacacgagccagcgctgctcgcagtgcggctacatctgcaaggagaaccggtgcacccaggccgtcttcgagtgcaagcagtgcggctacaagacccacgccgactacaacgccgccaagaacatcgccacctacgacatcgagaacatcatcaacaagcagctcgccgtgcagtccaagctccactccaagaagtgcatggaggagtacatcgaggagctgggctacctcgactag

SEQ ID NO: 2250 - DNA, 1338 bp, Unknown
  Bacillus sp. multi
ctgggcgtcacgatcaagatcatgaagtaccagatcctcttcccgctgaacgtggactggaccatcttcgagaagcacctccgcaacctcacctaccaagtgcggacgatctcgaaccggacgatccagcagctctgggagttcgacgcgctctcgttcgactacttcaaggagcgcggcacctaccccacggtccaagacctgtacggctgcacccagaagaagattgacgggtacatctaccacacgctccagagcaagtaccccgacatccacaagggcaacatgagcacgaccctccagaagatcatcaagacctggaagtcacggcgcaacgagatccgcaagggcgagatgagcatcccgagcttccgcaaccgcatccccatcgacctccacaacaactcggtggacatcacgaaggaaaagaacggggactacatcgcgggcatcagcctgttctcacgagacttccacaaggagaacgacgacgtgccgaagggcaaaatcttcgttaagctcgccacccagaagcagaagtcgatgaaggtgatcctggaccggctcatcaaccagacctacagcaagggcgcgtgcatgatccacaagtacaagaacaagtggtatctcagcatcacctacaagttcaacgccatcaaggagaacaagttcgacaaggagttgataatgggcatcgacctcggcgggatcaacacggtgtacttcgcgttcaacgagggcttcatccgctcgaacatcaagagcgacgagatcatccgccagcgccggatcaacctcctcaagcagagcaagtattgctccaactcgcgcacggggaagggccgcaccaagcggctccagcccatcgacgtcctgtccaacaagatcgccaagttccgcaactccaccaaccacaagtacgcgaactacatcgtgaagcagtgcctcaagcacaactgcgggcgcatccagatggagctgctcaagggcatctccaagaacgaccgcatcctcaaggactggacgtacttcgacctccaggaaaagatcaagaaccaggcggagatccacggcatcgaggtcatcaaggtcgcgcccgcctacacctcccagcgctgctcccagtgcggctacatctgcaaggagaaccggtgcacccaggccacgttcgagtgcaagcagtgcgggtacaagacccacgccgactacaacgcggccaagaacatctccacctacgacatcgagaacatcatcaacaagcagctcgccgtccagagcaagctgcacagcaagaaatgcatggaggagtacatcgaggagctgggctacctggactag

SEQ ID NO: 2251 - DNA, 1338 bp, Unknown
  Bacillus sp. multi
ctcggcgtgacgatcaagatcatgaagtaccagatcctcttcccgctgaacgtggactggaccatcttcgagaagcacctccgcaacctgacctaccaagtgcggacgatctccaaccggaccatccagcagctctgggagttcgacgcgctctcgttcgactacttcaaggagcggggcacgtaccccacggtccaagatctttacggctgcacccaaaagaaaatcgacggctacatctaccacacgctccagagcaagtacccggacatccacaagggcaacatgagcacgaccctccagaaaatcatcaagacctggaagtcccgccggaacgagatccggaagggcgagatgagcatcccctccttccgcaaccgcatccccatcgacctgcacaacaacagcgtggacatcacgaaggagaagaatggcgactacatcgcggggatcagcctgttctcgcgcgacttccacaaggagaacgacgacgtgccgaagggcaaaatcttcgtcaagctcgccacgcagaagcagaagtcgatgaaggtgatcctcgaccggctcatcaaccagacgtacagcaagggcgcgtgcatgatccacaagtacaagaacaagtggtatctgtccatcacctacaagttcaacgcgatcaaggagaacaagttcgacaaggaattgatcatggggatcgacctcggcgggatcaacaccgtgtacttcgccttcaacgaggggttcatccgcagcaacatcaagtccgacgagatcatccgccagcgccgcatcaacctcctcaagcagtccaagtactgctccaacagccgcaccgggaagggccgcacgaagcgcctccagcccatcgacgtcctctcgaacaagatcgccaagttccgcaactccacgaaccacaagtacgccaactacatcgtgaagcagtgcctcaagcacaactgcgggcgcatccagatggagctgctcaagggcatctccaagaacgaccgcatcctcaaggactggacctacttcgacctccaggagaagattaagaatcaggccgagatccacgggatcgaggtcatcaaggtcgcgcccgcctacaccagccagcgctgctcccagtgcggctacatctgcaaggagaaccggtgcacccaggccaccttcgagtgcaagcagtgcggctacaagacccacgccgactacaacgcggccaagaacatctccacctacgacatcgagaacatcatcaacaagcagctcgccgtccagtcgaagctgcacagcaagaaatgcatggaggagtacatcgaggagctgggctacctcgactga

SEQ ID NO: 2252 - DNA, 1338 bp, Unknown
  Bacillus sp. multi
ctcggcgtgacgatcaagatcatgaagtaccagatcctcttcccgctcaacgtggactggacgatcttcgagaagcacctccgcaacctgacctaccaagtacggacgatctcgaaccgcaccatccagcagctctgggagttcgacgccctctcgttcgactacttcaaggagcgcggcacctaccccaccgtccaagacctctacggctgcacccagaagaagatcgacgggtacatctaccacaccctccagagcaagtacccggacatccacaaggggaacatgagcaccacgctccagaaaatcatcaagacgtggaaaagtcgccggaacgagatccgcaagggcgagatgtcgatcccgagcttccgcaaccgcatccccatcgacctgcacaacaactccgtggacatcacgaaggagaagaacggcgactacatcgcggggatctcgctgttcagccgggacttccacaaggagaacgacgacgtgccgaagggcaaaatcttcgtgaagctcgccacccagaagcagaagtccatgaaggtcatcctggaccggctcatcaaccagacctactcgaagggcgcgtgcatgatccacaagtacaagaacaagtggtatctcagcatcacgtacaagttcaacgccatcaaggagaacaagttcgacaaggaactcatcatgggcatcgacctcggcggcatcaacaccgtgtacttcgcgttcaacgaggggttcatccgctcgaacatcaagtccgacgagatcatccgccagcgccgcatcaacctgctcaagcagtccaaatactgttccaacagccgcacggggaagggccgcaccaagcggctccagcccatcgacgtcctcagcaacaagatcgccaagttccgcaactccacgaaccacaagtacgcgaactacatcgtgaagcagtgcctcaagcacaactgcgggcgcatccagatggagctgctcaagggcatcagcaagaacgaccgcatcctcaaggactggacctacttcgacctccaggaaaagataaagaatcaggcggagatccacggcatcgaggtcatcaaggtcgccccggcctacaccagccagcgctgctcgcagtgcggctacatctgcaaggagaaccggtgcacccaggccacgttcgagtgcaagcagtgcggctacaagacgcacgcggactacaacgcggccaagaacatctccacgtacgacatcgagaacatcatcaacaagcagctcgcggtgcagagcaagctccactccaagaaatgcatggaggagtacatcgaggagctgggctacctcgactga

SEQ ID NO: 2253 - DNA, 1338 bp, Unknown
  Bacillus sp. multi
ctcggggtcacgatcaagatcatgaagtaccagatcctcttcccgctgaacgtggactggaccatcttcgagaagcacctccggaacctgacctaccaagtacggacgatctccaaccgcaccatccagcagctctgggagttcgacgccctgtcgttcgactacttcaaggagcgcggcacctaccccaccgtccaagatttgtacggctgcacgcaaaagaaaatcgacggctacatctaccacaccctccagtcgaagtacccggacatccacaagggcaacatgagcaccacgctccagaaaatcattaagacctggaagtcgcgccgcaacgagatccggaagggcgagatgagcatccccagcttccgcaaccgcatccccatcgacctgcacaacaactcggtggacatcacgaaggagaagaacggggactacatcgccgggatctcgctgttcagccgggacttccacaaggagaacgacgacgtgccgaagggcaagatcttcgtcaagctcgccacccagaagcagaagtcgatgaaggtcatcctggaccggctcatcaaccagacctactcgaagggcgcgtgcatgatccacaagtacaagaacaagtggtatctctcgatcacgtacaagttcaacgccatcaaggagaacaagttcgacaaggagttgatcatgggcatcgacctcggcgggatcaacaccgtgtacttcgccttcaacgagggcttcatccgcagcaacatcaagagcgacgagatcatccggcagcgccggatcaacctcctcaagcagtccaagtattgctcgaactcccgcaccggcaaggggcggaccaagcgcctccagcccatcgacgtgctctccaacaagatcgccaagttccgcaactcgaccaaccacaagtacgccaactacatcgtgaagcagtgcctcaagcacaactgcgggcgcatccagatggagctgctcaaggggatctccaagaacgaccgcatcctcaaggactggacctacttcgacctccaggagaaaatcaagaatcaggccgagatccacggcatcgaggtcatcaaggtcgccccggcctacaccagccagcggtgctcgcagtgcgggtacatctgcaaggagaaccgctgcacccaggccacgttcgagtgcaagcagtgcggctacaagacccacgccgactacaacgcggccaagaacatcagcacctacgacatcgagaacatcatcaacaagcagctcgccgtgcagtcgaagctgcacagcaagaaatgcatggaggagtacatcgaggagctgggctacctggactga

SEQ ID NO: 2254 - DNA, 1338 bp, Unknown
  Bacillus sp. multi
ctcggcgtgacgatcaagatcatgaagtaccagatcctcttcccgctcaacgtggactggaccatcttcgagaagcacctccgcaacctcacgtaccaagttcggacgatctcgaaccgcacgatccagcagctctgggagttcgacgccctcagcttcgactacttcaaggagcggggcacctaccccaccgtccaagatctgtacggctgcacccagaagaaaatcgacggctacatctaccacaccctccagtcgaagtacccggacatccacaaggggaacatgagcaccaccctccagaaaatcatcaagacctggaaatcacgccggaacgagatccggaagggcgagatgtccatccccagcttccgcaaccgcatccccatcgacctccacaacaactcggtggacatcacgaaggagaagaacggggactacatcgcggggatctccctgttctcccgcgacttccacaaggagaacgacgacgtgccgaagggcaagatattcgtaaagctcgccacccagaagcagaagtcgatgaaggtgatcctggaccggctcatcaaccagacctactcgaagggcgcgtgcatgatccacaagtacaagaacaagtggtacttgagcatcacctacaagttcaacgccatcaaggagaacaagttcgacaaggaactgataatgggcatcgacctcggcgggatcaacaccgtgtacttcgcgttcaacgagggcttcatccgcagcaacatcaagtcggacgagatcatccggcagcgccgcatcaacctcctcaagcagagcaagtactgttccaacagccgcacgggcaaggggcggacgaagcgcctccagcccatcgacgtcctgtcgaacaagatcgccaagttccgcaacagcacgaaccacaagtacgccaactacatcgtgaagcagtgcctcaagcacaactgcgggcgcatccagatggagctgctcaagggcatcagcaagaacgaccgcatcctcaaggactggacctacttcgacctccaggagaagatcaagaaccaggcggagatccacggcatcgaggtcatcaaggtcgccccggcctacacctcccagcgctgctcccagtgcgggtacatctgcaaggagaaccgctgcacccaggcgacgttcgagtgcaagcagtgcggctacaagacccacgccgactacaacgcggccaagaacatcagcacctacgacatcgagaacatcatcaacaagcagctcgccgtgcagtccaagctccacagcaagaaatgcatggaggagtacatcgaggagctgggctacctcgactga

SEQ ID NO: 2255 - DNA, 1338 bp, Unknown
  Bacillus sp. multi
ctcggcgtgacgatcaagatcatgaagtaccagatcctctgcccgctgaacgtggactggacgatcttcgagaagcacctccggaacctgacgtaccaggtgcggacgatcagcaaccgcacgatccagcagctctgggagttcgacgcgctcagcttcgactacttcaaggagcgcggcacctacccgaccgtccaggacttgtacggctgcacccagaagaaaattgacggctacatctaccacaccctccagagcaagtaccccgacatccacaagggcaacatgagcaccacgctccagaagataatcaagacttggaagtcccgccgcaacgagatccggaagggcgagatgagcatccccagcttccggaaccgcatccccatcgacctccacaacaactcggtggacatcacgaaggagaagaatggcgactacatcgccgggatcagcctcttcagccgcgacttccacaaggagaacgacgacgtgccgaagggcaagatattcgttaaactggccacccagaagcagaagtcgatgaaggtcatcctcgaccgcctcatcaaccagacgtactcgaagggcgcgtgcatgatccacaagtacaagaacaagtggtacttgagcatcacctacaagttcaacgccatcaaggagaacaagttcgacaaggagctaattatgggcatcgacctgggcggcatcaacacggtgtacttcgccttcaacgaggggttcatccggtccaacatcaagagcgacgagatcatccgccagcgccggatcaacctgctcaagcagagcaagtattgttccaacagccgcacgggcaagggccgcaccaagcgcctccagcccatcgacgtgctgtcgaacaagatcgccaagttccgcaactccacgaaccacaagtacgccaactacatcgtgaagcagtgcctcaagcacaactgcgggcgcatccagatggagctgctcaaggggatcagcaagaacgaccgcatcctcaaggactggacgtacttcgacctccaggagaagataaagaaccaggccgagatccacggcatcgaggtcatcaaggtcgccccggcctacacctcccagcggtgctcccagtgcggctacatctgcaaggagaaccgctgcacccaggccacgttcgagtgcaagcagtgcggctacaagacccacgccgactacaacgcggccaagaacatcagcacctacgacatcgagaacatcatcaacaagcagctcgcggtgcagagcaagctccactccaagaaatgcatggaggagtacatcgaggagctgggctacctggactag

SEQ ID NO: 2256 - DNA, 1338 bp, Unknown
  Bacillus sp. multi
ctcggggtgaccatcaagatcatgaagtaccagatcctctgcccgctcaacgtggactggaccatcttcgagaagcacctccggaacctcacctaccaagtgcggacgatctccaaccgcacgatccagcagctctgggagttcgacgccctcagcttcgactacttcaaggagcgcggcacgtaccccacggtccaggacttgtacggctgcacgcagaagaaaattgacggctacatctaccacaccctccagtcgaagtacccggacatccacaagggcaacatgagcaccacgctccagaaaatcatcaagacctggaagtcccgccgcaacgagatccgcaagggcgagatgtcgatcccgtccttccgcaaccgcatccccatcgacctccacaacaacagcgtggacatcacgaaggagaagaatggcgactacatcgccgggatcagcctgttctcgcgcgacttccacaaggagaacgacgacgtgccgaagggcaagatattcgtgaagctcgccacccagaagcagaagtccatgaaggtcatcctcgaccggctcatcaaccagacctactcgaagggcgcgtgcatgatccacaagtacaagaacaagtggtatctctcaatcacctacaagttcaacgccatcaaggagaacaagttcgacaaggagctgattatgggcatcgacctcggcgggatcaacaccgtgtacttcgcgttcaacgagggcttcatccgctccaacatcaagtcggacgagatcatccggcagcggcgcatcaacctgctcaagcagtccaaatattgctccaacagccgcaccggcaaggggcgcacgaagcgcctccagcccatcgacgtcctctccaacaagatcgccaagttccgcaactcgaccaaccacaagtacgcgaactacatcgtgaagcagtgcctcaagcacaactgcgggcgcatccagatggagctgctcaagggcatctccaagaacgaccgcatcctcaaggactggacctacttcgacctccaggagaagattaagaatcaggccgagatccacggcatcgaggtcatcaaggtggccccggcctacacgagccagcgctgctcgcagtgcggctacatctgcaaggagaaccgctgcacccaggccacgttcgagtgcaagcagtgcggctacaagacccacgccgactacaacgcggccaagaacatctccacctacgacatcgagaacatcatcaacaagcagctcgccgtccagtcgaagctccactccaagaagtgtatggaggagtacatcgaggagctgggctacctcgactga

SEQ ID NO: 2257 - DNA, 1338 bp, Unknown
  Bacillus sp. multi
ctgggcgtcacgatcaagatcatgaagtaccagatcctgtgcccgctgaacgtggactggacgatcttcgagaagcacctccgcaacctcacgtaccaagtccggacgatcagcaaccggaccatccagcagctctgggagttcgacgcgctcagcttcgactacttcaaggagcgcggcacctacccgaccgtccaggatctctacgggtgcacgcagaagaaaatcgacggctacatctaccacaccctccagtcgaagtacccggacatccacaagggcaacatgagcaccacgctccagaaaatcatcaagacctggaagtcccggcggaacgagatccgcaagggcgagatgagcatccccagcttccggaaccgcatccccatcgacctgcacaacaacagcgtggacatcacgaaggaaaaaaatggggactacatcgcgggcatctcgctgttcagccgcgacttccacaaggagaacgacgacgtgccgaagggcaagatattcgtcaagctggcgacccagaagcagaagtccatgaaggtgatcctcgaccgcctcatcaaccagacctacagcaagggcgcgtgcatgatccacaagtacaagaacaagtggtatctcagcatcacctacaagttcaacgccatcaaggagaacaagttcgacaaggagcttatcatgggcatcgacctcggcgggatcaacaccgtgtacttcgccttcaacgaggggttcatccggtccaacatcaagtcggacgagatcatccgccagcgccgcatcaacctcctcaagcagtccaaatactgctccaactcccgcacggggaaggggcggacgaagcgcctccagcccatcgacgtcctctccaacaagatcgccaagttccgcaactcgacgaaccacaagtacgccaactacatcgtgaagcagtgcctcaagcacaactgcgggcgcatccagatggagctgctcaaggggatcagcaagaacgaccgcatcctcaaggactggacctacttcgacctccaggagaagatcaaaaaccaggccgagatccacggcatcgaggtcatcaaggtcgcgcccgcctacacgagccagcggtgctcgcagtgcgggtacatctgcaaggagaaccggtgcacccaggcgaccttcgagtgcaagcagtgcggctacaagacgcacgccgactacaacgccgccaagaacatcagcacgtacgacatcgagaacatcatcaacaagcagctcgccgtccagagcaagctccacagcaagaaatgcatggaggagtacatcgaggagctgggctacctggactga

SEQ ID NO: 2258 - DNA, 1338 bp, Unknown
  Bacillus sp. multi
ctcggggtgacgatcaagatcatgaagtaccagatcctctgcccgctcaacgtggactggacgatcttcgagaagcacctccgcaacctgacctaccaagtccggacgatcagcaaccgcacgatccagcagctctgggagttcgacgccctgtccttcgactacttcaaggagcggggcacgtacccgaccgtccaagacctttatggctgcacgcagaagaaaatagacggctacatctaccacacgctccagtcgaagtacccggacatccacaagggcaacatgagcaccaccctccagaagataatcaaaacctggaagtcccgccgcaacgagatccgcaagggcgagatgagcatcccgtccttccggaaccgcatccccatcgacctccacaacaacagcgtggacatcacgaaggagaagaacggggactacatcgcggggatctccctcttcagccgcgacttccacaaggagaacgacgacgtgccgaagggcaagatattcgtaaagctggcgacccagaagcagaagtcgatgaaggtcatcctcgaccgcctcatcaaccagacgtacagcaagggcgcgtgcatgatccacaagtacaagaacaagtggtatctctcgatcacctacaagttcaacgcgatcaaggagaacaagttcgacaaggagcttatcatgggcatcgacctgggcggcatcaacaccgtgtacttcgccttcaacgaggggttcatccgctccaacatcaagtcggacgagatcatccggcagcgccgcatcaacctgctcaagcagagcaaatactgttcgaactcccgcacgggcaagggccgcaccaagcgcctccagcccatcgacgtcctcagcaacaagatcgccaagttccgcaactcgacgaaccacaagtacgccaactacatcgtgaagcagtgcctcaagcacaactgcgggcgcatccagatggagctgctcaagggcatcagcaagaacgaccgcatcctcaaggactggacgtacttcgacctccaggagaagatcaagaatcaggccgagatccacggcatcgaggtcatcaaggtcgccccggcctacaccagccagcggtgctcccagtgcgggtacatctgcaaggagaaccgctgcacccaggccaccttcgagtgcaagcagtgcgggtacaagacccacgccgactacaacgcggccaagaacatcagcacctacgacatcgagaacatcatcaacaagcagctcgccgtgcagtccaagctgcactccaagaagtgtatggaggagtacatcgaggagctgggctacctcgactag

SEQ ID NO: 2259 - DNA, 1338 bp, Unknown
  Bacillus sp. multi
ctcggcgtgacgatcaagatcatgaagtaccagatcctctgcccgctcaacgtggactggacgatcttcgagaagcacctccgcaacctcacgtaccaagttcggacgatcagcaaccggacgatccagcagctctgggagttcgacgcgctcagcttcgactacttcaaggagcgcgggacgtaccccacggtccaggacttgtacggctgcacccaaaagaaaatcgacggctacatctaccacacgctccagagcaagtacccggacatccacaaggggaacatgagcacgaccctccagaaaatcattaaaacctggaagtcccgccgcaacgagatccggaagggcgagatgtcgatcccctcgttccgcaaccgcatccccatcgacctccacaacaacagcgtggacatcacgaaggagaaaaacggggactacatcgcggggatcagcctgttctcccgcgacttccacaaggagaacgacgacgtgccgaagggcaaaatcttcgtgaagctggcgacccagaagcagaagtccatgaaggtgatcctcgaccgcctcatcaaccagacctactcgaagggcgcgtgcatgatccacaagtacaagaacaagtggtatctgtctatcacctacaagttcaacgcgatcaaggagaacaagttcgacaaggagcttatcatgggcatcgacctcggcggcatcaacaccgtgtacttcgccttcaacgaggggttcatccggagcaacatcaagtcggacgagatcatccgccagcgccggatcaacctgctcaagcagtccaagtattgctcgaactcccggacggggaagggccggaccaagcgcctccagcccatcgacgtcctgtccaacaagatcgccaagttccgcaactccacgaaccacaagtacgcgaactacatcgtcaagcagtgcctcaagcacaactgcgggcgcatccagatggagctgctcaaggggatctccaagaacgaccgcatcctcaaggactggacctacttcgacctccaggagaagatcaagaatcaggcggagatccacggcatcgaggtcatcaaggtcgccccggcctacacgagccagcggtgcagccagtgcgggtacatctgcaaggagaaccgctgcacccaggccaccttcgagtgcaagcagtgcgggtacaagacccacgcggactacaacgccgccaagaacatcagcacctacgacatcgagaacatcatcaacaagcagctcgccgtccagtcgaagctgcacagcaagaaatgcatggaggagtacatcgaggagctgggctacctcgactga

SEQ ID NO: 2260 - DNA, 1356 bp, Unknown
  Bacillus sp. multi
ctcggcgtgacgatcaagatcatgaagtaccagatcctctgccccatgaacgtggactggaccatcttcgagaagcacctccggaacctcacgtaccaagtccggacgatctcgaaccgcaccatccagcagctctgggagttcgacgccctcagcttcgactacttcaaggagcgcggcacctaccccacggtccaggatctgtacggctgcacgcagaagaagatcgacggctacatctaccacacgctccagtcgaagtacccggacatccacaagggcaacatgagcaccacgctccagaaaatcatcaagacctggaagtcgcgccgcaacgagatccgcaagggcgagatgtcgatcccgtccttccgcaaccgcatccccatcgacctccacaacaactccgtggacatcacgaaggagaagaatggcgactacatcgccgggatctccctcttcctccgggacttccacaaggagaacggcgacgtgccgaagggcaagatcttcgttaagctctccacgcagaagcagaagtccatgaaggtgatcctcgaccggctgatgaaccagacctactcgaagggcgcgtgcatgatccacaagtacaagaacaagtggtacctctccatcacctacaagttcaacgccatcaaggagaacaagttcgacaaggagttaatcatgggcatcgacatgggcggcatcaacaccgtgtacttcgccttcaacgagggcttcatccggagcaacatcaagtcggacgagatcaagatgttcaacgagcgcatccggcagcgccggatcaacctcctcaagcagagcaagtattgctcgaactcccggatcgggaaggggcggaccaagcggctccagcccatcgacgtgctgagcaacaagatcgccaagttccgcaactcgaccaaccacaagtacgccaactacatcgtcaagcagtgcctcaagcacaactgcgggcgcatccagatggagctgctcaagggcatctccaagaacgacaagatcctcaaggactggacctacttcgacctccaggagaagattaagaaccaggcgggcatccacggcatcgaggtcatcaagatcgcgcccgcctacaccagccagcggtgctcccagtgcggctacatctgcaaggagaaccgctgcacccaggccgtgttcgagtgcaagcagtgcgggtacaagacgcacgcggactacaacgccgccaagaacatctccatctacgacatcgagaacatcatcaacaagcagctcgcggtgcagtccaagctgcactccaagaagtgcatggaggagtacatcgaggagctgggctacctggactga

SEQ ID NO: 2261 - DNA, 1356 bp, Unknown
  Bacillus sp. multi
ctcggcgtcaccatcaagatcatgaagtaccagatcctctgcccgatgaacgtggactggaccatcttcgagaagcacctccggaacctcacgtaccaggtgcggacgatctccaaccgcacgatccagcagctctgggagttcgacgcgctgagcttcgactacttcaaggagcggggcacctaccccacggtccaggacctgtacggctgcacgcagaagaaaatcgacgggtacatctaccacaccctccagagcaagtaccccgacatccacaagggcaacatgagcaccaccctccagaaaatcatcaagacctggaagtcccgccgcaacgagatccggaagggcgagatgtccatccccagcttccggaaccgcatccccatcgacctccacaacaactcggtggacatcacgaaggagaagaacggcgactacatcgcgggcatcagcctcttcctccgcgacttccacaaggagaacggcgacgtgccgaagggcaaaatcttcgtgaagctcagcacccagaagcagaagtccatgaaggtcatcctcgaccggctcatgaaccagacctacagcaagggcgcgtgcatgatccacaagtacaagaacaagtggtacctttcgatcacctacaagttcaacgccatcaaggagaacaagttcgacaaggagttaatcatggggatcgacatgggcgggatcaacaccgtgtacttcgcgttcaacgagggcttcatccgctcgaacatcaagtcggacgagatcaagatgttcaacgagcgcatccggcagcggcggatcaacctcctcaagcagtccaagtattgctccaactcccggatcgggaagggccgcacgaagcgcctccagcccatcgacgtgctcagcaacaagatcgccaagttccgcaactcgacgaaccacaagtacgcgaactacatcgtgaagcagtgcctcaagcacaactgcgggcgcatccagatggagctgctcaagggcatcagcaagaacgacaagatcctcaaggactggacgtacttcgacctccaggagaaaatcaagaatcaggcgggcatccacgggatcgaggtcatcaagatcgccccggcctacacctcccagcgctgctcccagtgcggctacatctgcaaggagaaccggtgcacccaggcggtcttcgagtgcaagcagtgcgggtacaagacccacgccgactacaacgcggccaagaacatcagcatctacgacatcgagaacatcatcaacaagcagctcgcggtgcagtcgaagctgcacagcaagaagtgcatggaggagtacatcgaggagctgggctacctcgactga

SEQ ID NO: 2262 - DNA, 1356 bp, Unknown
  Bacillus sp. multi
ctcggggtgaccatcaagatcatgaagtaccagatcctctgccccatgaacgtggactggaccatcttcgagaagcacctccgcaacctcacgtaccaggtgcggacgatctccaaccgcacgatccagcagctctgggagttcgacgccctgtccttcgactacttcaaggagcgcgggacgtaccccaccgtccaggatctctacggctgcacccagaagaagattgacggctacatctaccacacgctccagagcaagtacccggacatccacaaggggaacatgagcaccacgctccagaaaatcatcaagacctggaagtcgcgccgcaacgagatccggaagggcgagatgagcatcccgagcttccgcaaccgcatccccatcgacctccacaacaacagcgtggacatcacgaaggagaagaatggggactacatcgccgggatctcgctgttcctccgggacttccacaaggagaacggcgacgtgccgaagggcaagatcttcgtgaagctctccacgcagaagcagaagtccatgaaggtgatcctggaccgcctcatgaaccagacctacagcaagggcgcgtgcatgatccacaagtacaagaacaagtggtacttgtcgatcacctacaagttcaacgcgatcaaggagaacaagttcgacaaggagttaatcatggggatcgacatgggcggcatcaacaccgtgtacttcgcgttcaacgaggggttcatccgctccaacatcaagtccgacgagatcaagatgttcaacgagcgcatccggcagcggcggatcaacctcctcaagcagagcaaatactgttccaactcccgcatcgggaagggccggacgaagcgcctccagcccatcgacgtcctctccaacaagatcgccaagttccgcaactcgacgaaccacaagtacgccaactacatcgtcaagcagtgcctcaagcacaactgcgggcgcatccagatggagctgctcaaggggatctccaagaacgacaagatcctcaaggactggacctacttcgacctccaggagaagatcaagaaccaggcgggcatccacggcatcgaggtcatcaagatcgccccggcctacaccagccagcgctgctcgcagtgcgggtacatctgcaaggagaaccgctgcacccaggccgtcttcgagtgcaagcagtgcggctacaagacccacgccgactacaacgcggccaagaacatcagcatctacgacatcgagaacatcatcaacaagcagctcgccgtccagtcgaagctgcactccaagaagtgcatggaggagtacatcgaggagctgggctacctggactag

SEQ ID NO: 2263 - DNA, 1356 bp, Unknown
  Bacillus sp. multi
ctcggcgtgaccatcaagatcatgaagtaccagatcctctgcccgatgaacgtggactggaccatcttcgagaagcacctccgcaacctcacgtaccaggtccggacgatctcgaaccgcaccatccagcagctctgggagttcgacgccctgtccttcgactacttcaaggagcgcggcacctaccccaccgtccaagacttgtacggctgcacccagaagaagatagacggctacatctaccacaccctccagtcgaagtacccggacatccacaaggggaacatgagcaccaccctccagaagatcatcaagacctggaagtcccggcgcaacgagatccggaagggcgagatgagcatcccgagcttccggaaccgcatccccatcgacctccacaacaacagcgtggacatcacgaaggagaagaacggcgactacatcgcgggcatctcgctcttcctgcgcgacttccacaaggagaacggcgacgtcccgaagggcaaaatcttcgtcaagctgtccacccagaagcagaagtccatgaaggtgatcctggaccgcctcatgaaccagacctacagcaagggcgcgtgcatgatccacaagtacaagaacaagtggtacctctctatcacctacaagttcaacgcgatcaaggagaacaagttcgacaaggagttgataatgggcatcgacatgggcgggatcaacaccgtgtacttcgcgttcaacgaggggttcatccgcagcaacatcaagtccgacgagatcaagatgttcaacgagcgcatccggcagcgccggatcaacctgctcaagcagtccaagtattgctccaacagccggatcggcaagggccgcacgaagcgcctccagcccatcgacgtcctgagcaacaagatcgccaagttccgcaactcgacgaaccacaagtacgcgaactacatcgtgaagcagtgcctcaagcacaactgcgggcgcatccagatggagctgctcaaggggatcagcaagaacgacaagatcctcaaggactggacgtacttcgacctccaggagaagattaagaaccaggcgggcatccacggcatcgaggtcatcaagatcgcgcccgcctacacgagccagcggtgctcgcagtgcggctacatctgcaaggagaaccgctgcacccaggcggtgttcgagtgcaagcagtgcgggtacaagacccacgccgactacaacgccgccaagaacatctcgatctacgacatcgagaacatcatcaacaagcagctcgccgtgcagtcgaagctccacagcaagaagtgcatggaggagtacatcgaggagctgggctacctggactga

SEQ ID NO: 2264 - DNA, 1356 bp, Unknown
  Bacillus sp. multi
ctcggggtgacgatcaagatcatgaagtaccagatcctctgccccatgaacgtggactggaccatcttcgagaagcacctccggaacctcacgtaccaagtacggacgatctcgaaccgcaccatccagcagctctgggagttcgacgcgctgtcgttcgactacttcaaggagcggggcacctacccgaccgtccaagacctctacggctgcacgcagaagaaaatagacggctacatctaccacaccctccagagcaagtacccggacatccacaaggggaacatgagcacgacgctccagaaaatcatcaagacctggaagtcccggcggaacgagatccggaagggcgagatgtccatcccgtccttccgcaaccgcatccccatcgacctgcacaacaactccgtggacatcacgaaggagaagaacggcgactacatcgccgggatctccctcttcctccgcgacttccacaaggagaacggcgacgtcccgaagggcaaaatcttcgtcaagctctccacccagaagcagaagtccatgaaggtcatcctggaccggctgatgaaccagacgtactcgaagggcgcgtgcatgatccacaagtacaagaacaagtggtacctgagcatcacctacaagttcaacgcgatcaaggagaacaagttcgacaaggagctgatcatgggcatcgacatgggcgggatcaacacggtgtacttcgcgttcaacgagggcttcatccgcagcaacatcaagtccgacgagatcaagatgttcaacgagcgcatccgccagcgccggatcaacctcctcaagcagtccaagtattgttccaacagccgcatcggcaagggccgcacgaagcgcctccagcccatcgacgtgctctccaacaagatcgccaagttccgcaactcgaccaaccacaagtacgccaactacatcgtgaagcagtgcctcaagcacaactgcgggcgcatccagatggagctgctcaaggggatctccaagaacgacaagatcctcaaggactggacgtacttcgacctccaggagaagatcaagaaccaggcgggcatccacgggatcgaggtcatcaagatcgccccggcctacacgagccagcgctgctcgcagtgcgggtacatctgcaaggagaaccgctgcacccaggccgtgttcgagtgcaagcagtgcgggtacaagacgcacgcggactacaacgcggccaagaacatctccatctacgacatcgagaacatcatcaacaagcagctcgcggtgcagtcgaagctgcactccaagaagtgcatggaggagtacatcgaggagctgggctacctcgactga

SEQ ID NO: 2265 - DNA, 1317 bp, Unknown
  Bacillus sp. multi
atgaagtaccagatcctctgcccgctgaacgtggactggaccatcttcgagaagcacctccgcaacctcacgtaccaagtccggacgatcagcaaccgcacgatccagcagctctgggagttcgacgccctcagcttcgactacttcaaggagcgcggcacgtacccgacggtccaggacttgtacggctgcacgcagaagaagatcgacgggtacatctaccacacgctccagtcgaagtaccccgacatccacaagggcaacatgagcaccaccctccagaaaatcatcaagacctggaagtcccgccggaacgagatccggaagggcgagatgtcgatcccgagcttccggaaccgcatccccatcgacctccacaacaactcggtggacatcacgaaggagaagaatggcgactacatcgcggggatctcgctgttctcccgcgacttccacaaggagaacgacgacgtgccgaagggcaaaatcttcgtgaagctggcgacgcagaagcagaagtcgatgaaggtcatcctggaccgcctcatcaaccagacctactcgaagggcgcgtgcatgatccacaagtacaagaacaagtggtatctcagcatcacctacaagttcaacgcgatcaaggagaacaagttcgacaaggaactcatcatggggatcgacctgggcggcatcaacaccgtgtacagcgccttcaacgagggcttcatccgctccaacatcaagtcggacgagatcatccggcagcgccggatcaacctgctcaagcagagcaaatattgttccaacagccgcacggggaagggccggacgaagcggctccagcccatcgacgtcctctccaacaagatcgccaagttccgcaacagcacgaaccacaagtacgccaactacatcgtgaagcagtgcctcaagcacaactgcgggcgcatccagatggagctgctcaaggggatcagcaagaacgaccgcatcctcaaggactggacgtacttcgacctccaggagaaaatcaaaaaccaggccgagatccacggcatcgaggtcatcaaggtcgccccggcctacacctcgcagcggtgcagccagtgcgggtacatctgcaaggagaaccgctgcacccaggcgacgttcgagtgcaagcagtgcggctacaagacccacgccgactacaacgcggccaagaacatctccacgtacgacatcgagaacatcatcaacaagcagctcgccgtgcagtccaagctccactccaagaaatgcatggaggagtacatcgaggagctgggctacctcgactga

SEQ ID NO: 2266 - DNA, 1317 bp, Unknown
  Bacillus sp. multi
atgaagtaccagatcctgtgcccgctcaacgtggactggaccatcttcgagaagcacctccggaacctcacgtaccaagtgcggacgatctcgaaccggacgatccagcagctctgggagttcgacgccctcagcttcgactacttcaaggagcgcggcacctaccccacggtccaggacttgtacggctgcacccagaagaaaatcgacggctacatctaccacacgctccagagcaagtacccggacatccacaagggcaacatgagcaccacgctccagaaaatcatcaagacctggaagtcccgccggaacgagatccggaagggcgagatgagcatcccgagcttccgcaaccgcatccccatcgacctgcacaacaacagcgtggacatcacgaaggagaagaatggcgactacatcgcggggatcagcctgttcagccgcgacttccacaaggagaacgacgacgtgccgaagggcaaaatcttcgtcaagctcgccacgcagaagcagaagtccatgaaggtcatcctcgaccgcctcatcaaccagacctacagcaagggcgcgtgcatgatccacaagtacaagaacaagtggtatctatccatcacctacaagttcaacgccatcaaggagaacaagttcgacaaggagcttatcatgggcatcgacctgggcgggatcaacacggtgtactccgcgttcaacgaggggttcatccggtccaacatcaagagcgacgagatcatccgccagcgccgcatcaacctgctcaagcagagcaaatactgctccaactcccgcaccgggaaggggcggacgaagcgcctccagcccatcgacgtgctctccaacaagatcgccaagttccgcaacagcacgaaccacaagtacgccaactacatcgtcaagcagtgcctcaagcacaactgcgggcgcatccagatggagctgctcaaggggatcagcaagaacgaccgcatcctcaaggactggacgtacttcgacctccaggaaaaaatcaagaatcaggcggagatccacgggatcgaggtcatcaaggtcgcgcccgcctacacgagccagcggtgctcccagtgcgggtacatctgcaaggagaaccggtgcacccaggccacgttcgagtgcaagcagtgcggctacaagacgcacgcggactacaacgccgccaagaacatctccacctacgacatcgagaacatcatcaacaagcagctcgcggtccagagcaagctgcactccaaaaagtgtatggaggagtacatcgaggagctgggctacctggactga

SEQ ID NO: 2267 - DNA, 1317 bp, Unknown
  Bacillus sp. multi
atgaagtaccagatcctctgcccgctgaacgtggactggaccatcttcgagaagcacctccgcaacctgacgtaccaagtgcggacgatctcgaaccgcaccatccagcagctctgggagttcgacgccctgtccttcgactacttcaaggagcggggcacctacccgaccgtccaagacctctatgggtgcacgcagaagaaaattgacgggtacatctaccacaccctccagtcgaagtacccggacatccacaagggcaacatgagcacgacgctccagaagataattaagacttggaagtcgcggcgcaacgagatccgcaagggcgagatgtccatcccctccttccgcaaccgcatccccatcgacctccacaacaactcggtggacatcacgaaggagaagaacggcgactacatcgcgggcatctccctgttcagccgggacttccacaaggagaacgacgacgtgccgaagggcaagattttcgtaaagctggccacccagaagcagaagtcgatgaaggtgatcctggaccggctcatcaaccagacgtactcgaagggcgcgtgcatgatccacaagtacaagaacaagtggtacttgtcgatcacgtacaagttcaacgcgatcaaggagaacaagttcgacaaggaactgattatgggcatcgacctgggcgggatcaacaccgtgtactccgccttcaacgaggggttcatccgcagcaacatcaagtccgacgagatcatccggcagcggcgcatcaacctgctcaagcagtccaagtattgctcgaactcgcgcaccgggaagggccgcacgaagcgcctccagcccatcgacgtgctgtcgaacaagatcgccaagttccgcaactcgaccaaccacaagtacgcgaactacatcgtcaagcagtgcctcaagcacaactgcgggcgcatccagatggagctgctcaagggcatcagcaagaacgaccgcatcctcaaggactggacctacttcgacctccaggaaaagattaagaatcaggccgagatccacggcatcgaggtcatcaaggtcgccccggcctacacgagccagcgctgctcgcagtgcgggtacatctgcaaggagaaccggtgcacccaggccacgttcgagtgcaagcagtgcggctacaagacccacgcggactacaacgcggccaagaacatctccacctacgacatcgagaacatcatcaacaagcagctcgccgtccagtcgaagctccactccaagaagtgcatggaggagtacatcgaggagctgggctacctcgactag

SEQ ID NO: 2268 - DNA, 1317 bp, Unknown
  Bacillus sp. multi
atgaagtaccagatcctctgcccgctcaacgtggactggacgatcttcgagaagcacctccgcaacctgacctaccaagtccggacgatcagcaaccggaccatccagcagctctgggagttcgacgcgctgtcgttcgactacttcaaggagcgcggcacgtaccccacggtccaagacctctacggctgcacccagaagaagattgacggctacatctaccacaccctccagagcaagtacccggacatccacaagggcaacatgagcaccaccctccagaaaatcatcaagacctggaagtcccgccgcaacgagatccgcaagggcgagatgagcatcccgagcttccgcaaccgcatccccatcgacctgcacaacaactcggtggacatcacgaaggagaagaatggcgactacatcgcgggcatcagcctgttctcccgcgacttccacaaggagaacgacgacgtgccgaagggcaaaatcttcgttaagctggccacgcagaagcagaagtcgatgaaggtgatcctggaccgcctcatcaaccagacctactcgaagggcgcgtgcatgatccacaagtacaagaacaagtggtacttgagcatcacctacaagttcaacgcgatcaaggagaacaagttcgacaaggagctaatcatggggatcgacctgggcggcatcaacaccgtgtacagcgccttcaacgagggcttcatccgctccaacatcaagtccgacgagatcatccggcagcgccgcatcaacctgctcaagcagagcaaatactgctccaacagccgcaccggcaagggccggaccaagcggctccagcccatcgacgtcctgtcgaacaagatcgccaagttccgcaacagcaccaaccacaagtacgcgaactacatcgtgaagcagtgcctcaagcacaactgcgggcgcatccagatggagctgctcaagggcatcagcaagaacgaccgcatcctcaaggactggacgtacttcgacctccaggagaagattaaaaaccaggcggagatccacggcatcgaggtcatcaaggtcgccccggcctacaccagccagcggtgctcccagtgcgggtacatctgcaaggagaaccgctgcacccaggccacgttcgagtgcaagcagtgcggctacaagacccacgcggactacaacgccgccaagaacatctccacctacgacatcgagaacatcatcaacaagcagctcgccgtgcagagcaagctccacagcaagaaatgcatggaggagtacatcgaggagctgggctacctcgactga

SEQ ID NO: 2269 - DNA, 1317 bp, Unknown
  Bacillus sp. multi
atgaagtaccagatcctctgcccgctcaacgtggactggacgatcttcgagaagcacctccgcaacctgacctaccaagtccggacgatcagcaaccggaccatccagcagctctgggagttcgacgccctcagcttcgactacttcaaggagcgcggcacgtaccccacggtccaggacttgtacggctgcacgcagaagaaaatcgacggctacatctaccacaccctccagtcgaagtaccccgacatccacaagggcaacatgagcacgacgctccagaaaatcatcaagacctggaagtcgcgccgcaacgagatccgcaagggcgagatgagcatcccgagcttccggaaccgcatccccatcgacctgcacaacaacagcgtggacatcacgaaggagaagaatggcgactacatcgcggggatctcgctgttctcgcgggacttccacaaggagaacgacgacgtgccgaagggcaagatattcgtcaagctggcgacccagaagcagaagtccatgaaggtcatcctggaccgcctcatcaaccagacctacagcaagggcgcgtgcatgatccacaagtacaagaacaagtggtatttgagcatcacctacaagttcaacgcgatcaaggagaacaagttcgacaaggagcttatcatggggatcgacctcggcggcatcaacaccgtgtacagcgccttcaacgaggggttcatccggagcaacatcaagtcggacgagatcatccggcagcggcgcatcaacctgctcaagcagtccaaatactgctccaacagccggacgggcaagggccgcacgaagcgcctccagcccatcgacgtgctgtcgaacaagatcgccaagttccgcaacagcaccaaccacaagtacgcgaactacatcgtgaagcagtgcctcaagcacaactgcgggcgcatccagatggagctgctcaaggggatcagcaagaacgaccgcatcctcaaggactggacctacttcgacctccaggaaaaaatcaagaatcaggcggagatccacgggatcgaggtcatcaaggtcgcgcccgcctacacgagccagcggtgctcgcagtgcggctacatctgcaaggagaaccggtgcacccaggcgacgttcgagtgcaagcagtgcggctacaagacccacgccgactacaacgcggccaagaacatctcgacgtacgacatcgagaacatcatcaacaagcagctcgcggtgcagagcaagctgcacagcaaaaagtgtatggaggagtacatcgaggagctgggctacctcgactag

SEQ ID NO: 2270 - DNA, 1335 bp, Unknown
  Bacillus sp. multi
atgaagtaccagatcctctgccccatgaacgtggactggaccatcttcgagaagcacctccgcaacctcacgtaccaagtgcggacgatctcgaaccgcaccatccagcagctctgggagttcgacgccctgtccttcgactacttcaaggagcgcggcacgtacccgaccgtccaagacctttacggctgcacccagaagaagatcgacggctacatctaccacacgctccagagcaagtacccggacatccacaagggcaacatgagcacgaccctccagaaaatcatcaagacctggaagtcccggcggaacgagatccggaagggcgagatgtccatcccgagcttccggaaccgcatccccatcgacctccacaacaacagcgtggacatcatcaaggagaagaatggggactacatcgccgggatcagcctgttcagccgcgacttccacaaggagaacggcgacgtcccgaagggcaagatcttcgtcaagctgagcaaccagaagcagaagtccatgaaggtgatcctggaccggctgatgaaccagacgtacagcaagggcgcgtgcatgatccacaagtacaagaacaagtggtacctgtccatcacgtacaagttcaacgccatcaaggagaacaagttcgacaaggagcttatcatgggcatcgacatgggcggcatcaacacggtgtacttcgcgttcaacgaggggttcatccggagcaacatcaagtcggacgagatcaagatgttcaacgagcgcatccgccagcgccgcatcaacctgctcaagcagagcaaatactgttccaacagccgcaccgggaagggccgcaccaagcgcctccagcccatcgacgtgctgagcaacaagatcgccaagttccgcaactcgaccaaccacaagtacgccaactacatcgtgaagcagtgcctcaagcacaactgcgggcgcatccagatggagctgctcaaggggatcgccaagaacgacaagatcctcaaggactggacctacttcgacctccaggagaagatcaagaaccaggccgagatccacggcatcgaggtcatcaagatcgccccggcctacacctcccagcgctgctcccagtgcggctacatctgcaaggagaaccggtgcacccaggccgtgttcgagtgcaagcagtgcggctacaagacccacgcggactacaacgcggccaagaacatcagcatctacgacatcgagaacatcatcaacaagcagctcgcggtccagagcaagctgcacagcaagaagtgcatggaggagtacatcgaggagctgggctacctggactag

SEQ ID NO: 2271 - DNA, 1335 bp, Unknown
  Bacillus sp. multi
atgaagtaccagatcctctgccccatgaacgtggactggaccatcttcgagaagcacctccgcaacctcacctaccaagtgcggacgatcagcaaccgcacgatccagcagctctgggagttcgacgcgctctcgttcgactacttcaaggagcgcggcacgtacccgaccgtccaagatctttacggctgcacgcagaagaagatagacgggtacatctaccacaccctccagtcgaagtaccccgacatccacaagggcaacatgagcacgaccctccagaaaatcatcaagacctggaagtcgcggcgcaacgagatccgcaagggcgagatgtccatcccgtccttccggaaccgcatccccatcgacctgcacaacaactccgtggacatcatcaaggagaagaacggggactacatcgcgggcatctccctgttcagccgggacttccacaaggagaacggcgacgtcccgaagggcaagatattcgtcaagctgtcgaaccagaagcagaagtccatgaaggtcatcctcgaccgcctgatgaaccagacgtactcgaagggcgcgtgcatgatccacaagtacaagaacaagtggtacctgagcatcacgtacaagttcaacgcgatcaaggagaacaagttcgacaaggagctcatcatgggcatcgacatgggcggcatcaacaccgtgtacttcgccttcaacgagggcttcatccgctccaacatcaagtccgacgagatcaagatgttcaacgagcgcatccggcagcggcggatcaacctcctcaagcagagcaaatactgctccaactcccggacgggcaaggggcggacgaagcgcctccagcccatcgacgtgctcagcaacaagatcgccaagttccgcaactcgaccaaccacaagtacgccaactacatcgtgaagcagtgcctcaagcacaactgcgggcgcatccagatggagctgctcaaggggatcgccaagaacgacaagatcctcaaggactggacgtacttcgacctccaggagaagatcaagaaccaggcggagatccacggcatcgaggtcatcaagatcgccccggcctacaccagccagcggtgctcccagtgcggctacatctgcaaggagaaccgctgcacccaggcggtgttcgagtgcaagcagtgcggctacaagacccacgccgactacaacgccgccaagaacatctccatctacgacatcgagaacatcatcaacaagcagctcgccgtgcagagcaagctgcacagcaagaagtgcatggaggagtacatcgaggagctgggctacctcgactga

SEQ ID NO: 2272 - DNA, 1335 bp, Unknown
  Bacillus sp. multi
atgaagtaccagatcctctgcccgatgaacgtggactggaccatcttcgagaagcacctccggaacctcacctaccaggtccggacgatctcgaaccggacgatccagcagctctgggagttcgacgcgctcagcttcgactacttcaaggagcgcggcacgtaccccacggtccaggacttgtacggctgcacccagaagaaaatagacggctacatctaccacaccctccagtcgaagtaccccgacatccacaagggcaacatgagcacgaccctccagaaaatcatcaagacctggaagtcgcggcgcaacgagatccggaagggcgagatgtccatcccgtcgttccgcaaccgcatccccatcgacctgcacaacaacagcgtggacatcatcaaggagaagaacggcgactacatcgcggggatcagcctgttcagccgggacttccacaaggagaacggcgacgtgccgaagggcaagatattcgtcaagctctccaaccagaagcagaagtcgatgaaggtgatcctcgaccggctcatgaaccagacgtacagcaagggcgcgtgcatgatccacaagtacaagaacaagtggtatcttagcatcacctacaagttcaacgccatcaaggagaacaagttcgacaaggagctcattatgggcatcgacatgggcggcatcaacacggtgtacttcgcgttcaacgaggggttcatccgcagcaacatcaagtccgacgagatcaagatgttcaacgagcgcatccgccagcgccgcatcaacctgctcaagcagagcaagtactgctccaactcccgcacgggcaaggggcggacgaagcgcctccagcccatcgacgtgctcagcaacaagatcgccaagttccgcaacagcaccaaccacaagtacgcgaactacatcgtgaagcagtgcctcaagcacaactgcgggcgcatccagatggagctgctcaagggcatcgccaagaacgacaagatcctcaaggactggacctacttcgacctccaggagaagatcaagaaccaggccgagatccacggcatcgaggtcatcaagatcgccccggcctacaccagccagcggtgctcgcagtgcggctacatctgcaaggagaaccggtgcacccaggccgtgttcgagtgcaagcagtgcggctacaagacccacgccgactacaacgcggccaagaacatctccatctacgacatcgagaacatcatcaacaagcagctcgccgtgcagagcaagctccacagcaagaagtgcatggaggagtacatcgaggagctgggctacctggactga

SEQ ID NO: 2273 - DNA, 1335 bp, Unknown
  Bacillus sp. multi
atgaagtaccagatcctctgcccgatgaacgtggactggaccatcttcgagaagcacctccgcaacctcacctaccaagtccggacgatctcgaaccggaccatccagcagctctgggagttcgacgccctctcgttcgactacttcaaggagcgcggcacgtaccccaccgtccaagacctgtacgggtgcacgcagaagaagatcgacggctacatctaccacacgctccagagcaagtacccggacatccacaaggggaacatgagcacgaccctccagaaaatcattaagacctggaagtcccgccgcaacgagatccggaagggcgagatgtcgatcccgagcttccgcaaccgcatccccatcgacctccacaacaactcggtggacatcatcaaggagaagaacggcgactacatcgcggggatcagcctgttctcccgcgacttccacaaggagaacggcgacgtcccgaagggcaagatattcgtcaagctgagcaaccagaagcagaagtccatgaaggtgatcctggaccgcctcatgaaccagacctacagcaagggcgcgtgcatgatccacaagtacaagaacaagtggtatctatccatcacctacaagttcaacgccatcaaggagaacaagttcgacaaggagctgattatggggatcgacatgggcggcatcaacaccgtgtacttcgcgttcaacgaggggttcatccgcagcaacatcaagtcggacgagatcaagatgttcaacgagcgcatccgccagcggcggatcaacctgctcaagcagagcaagtactgctccaactcgcggacggggaagggccgcacgaagcgcctccagcccatcgacgtgctgtcgaacaagatcgccaagttccgcaactcgacgaaccacaagtacgccaactacatcgtcaagcagtgcctcaagcacaactgcgggcgcatccagatggagctgctcaagggcatcgccaagaacgacaagatcctcaaggactggacctacttcgacctccaggagaagatcaagaaccaggcggagatccacggcatcgaggtcatcaagatcgccccggcctacaccagccagcggtgctcgcagtgcggctacatctgcaaggagaaccgctgcacccaggccgtcttcgagtgcaagcagtgcggctacaagacgcacgccgactacaacgccgccaagaacatcagcatctacgacatcgagaacatcatcaacaagcagctcgccgtgcagagcaagctccactccaagaagtgcatggaggagtacatcgaggagctgggctacctcgactga

SEQ ID NO: 2274 - DNA, 1335 bp, Unknown
  Bacillus sp. multi
atgaagtaccagatcctctgcccgatgaacgtggactggaccatcttcgagaagcacctccgcaacctcacgtaccaagtccggacgatctcgaaccgcaccatccagcagctctgggagttcgacgccctctcgttcgactacttcaaggagcgcggcacctacccgacggtccaagacctctacggctgcacccagaagaaaatcgacgggtacatctaccacaccctccagagcaagtaccccgacatccacaaggggaacatgagcaccacgctccagaaaatcatcaagacctggaagtcccgccgcaacgagatccgcaagggcgagatgagcatcccgtcgttccgcaaccgcatccccatcgacctccacaacaacagcgtggacatcatcaaggagaagaatggcgactacatcgcggggatctccctgttctcgcgcgacttccacaaggagaacggcgacgtgccgaagggcaaaatcttcgtcaagctcagcaaccagaagcagaagtccatgaaggtcatcctcgaccggctgatgaaccagacctacagcaagggcgcgtgcatgatccacaagtacaagaacaagtggtatctgagcatcacctacaagttcaacgcgatcaaggagaacaagttcgacaaggagctcatcatgggcatcgacatgggcggcatcaacacggtgtacttcgccttcaacgaggggttcatccggtcgaacatcaagagcgacgagatcaagatgttcaacgagcgcatccgccagcggcgcatcaacctcctcaagcagtccaagtattgctccaactcccgcacggggaaggggcgcacgaagcggctccagcccatcgacgtcctgtccaacaagatcgccaagttccgcaactcgaccaaccacaagtacgccaactacatcgtcaagcagtgcctcaagcacaactgcgggcgcatccagatggagctgctcaagggcatcgccaagaacgacaagatcctcaaggactggacgtacttcgacctccaggagaagatcaagaaccaggccgagatccacggcatcgaggtcatcaagatcgccccggcctacacctcccagcggtgcagccagtgcgggtacatctgcaaggagaaccggtgcacccaggcggtgttcgagtgcaagcagtgcggctacaagacccacgccgactacaacgccgccaagaacatcagcatctacgacatcgagaacatcatcaacaagcagctcgccgtgcagagcaagctccacagcaagaagtgcatggaggagtacatcgaggagctgggctacctggactga

SEQ ID NO: 2275 - DNA, 1338 bp, Unknown
  Bacillus sp. multi
ctcggcgtgaccatcaagatcatgaagtaccagatcctctgcccgctgaacgtggactggaccatcttcgagaagcacctccgcaacctgacgtaccaagtgcggacgatcagcaaccggacgatccagcagctctgggagttcgacgccctgagcttcgactacttcaaggagcgcggcacctaccccaccgtccaagatctctacggctgcacccaaaagaaaatcgacggctacatctaccacaccctccagagcaagtacccggacatccacaagggcaacatgagcacgaccctccagaaaatcatcaagacttggaagtcccgccggaacgagatccgcaagggcgagatgtcgatcccgtcgttccgcaaccgcatccccatcgacctgcacaacaacagcgtggacatcacgaaggagaagaatggggactacatcgcgggcatcagcctgttcagccgcgacttccacaaggagaacgacgacgtgccgaagggcaagatattcgtgaagctcgccacgcagaagcagaagtccatgaaggtgatcctcgaccggctcatcaaccagacctactcgaagggcgcgtgcatgatccacaagtacaagaacaagtggtacttgagcatcacctacaagttcaacgcgatcaaggagaacaagttcgacaaggagttgataatggggatcgacctcggcggcatcaacacggtgtacttcgcgttcaacgagggcttcatccgctccaacatcaagagcgacgagatcatccggcagcgccggatcaacctcctcaagcagtccaagtactgttccaactcccgcaccggcaaggggcgcaccaagcggctccagcccatcgacgtgctgtccaacaagatcgccaagttccgcaactccacgaaccacaagtacgcgaactacatcgtcaagcagtgcctcaagcacaactgcgggcgcatccagatggagctgctcaaggggatcagcaagaacgaccgcatcctcaaggactggacctacttcgacctccaggagaagattaagaatcaggccgagatccacggcatcgaggtcatcaaggtcgccccggcctacacgagccagcggtgctcccagtgcgggtacatctgcaaggagaaccgctgcacccaggccaccttcgagtgcaagcagtgcggctacaagacgcacgccgactacaacgcggccaagaacatcagcacctacgacatcgagaacatcatcaacaagcagctcgcggtgcagagcaagctgcactccaagaagtgcatggaggagtacatcgagaagctgggctacctggactga

SEQ ID NO: 2276 - DNA, 1338 bp, Unknown
  Bacillus sp. multi
ctcggcgtgacgatcaagatcatgaagtaccagatcctctgcccgctcaacgtggactggacgatcttcgagaagcacctccggaacctgacctaccaagtgcggacgatctccaaccggaccatccagcagctctgggagttcgacgccctgtccttcgactacttcaaggagcgcgggacgtaccccacggtccaagacctctacggctgcacccagaagaaaatcgacggctacatctaccacaccctccagtcgaagtaccccgacatccacaagggcaacatgagcaccacgctccagaaaatcatcaagacctggaaatcccgccgcaacgagatccgcaagggcgagatgagcatcccgtccttccgcaaccgcatccccatcgacctccacaacaacagcgtggacatcacgaaggaaaagaacggcgactacatcgcgggcatctcgctgttctcccgcgacttccataaggagaacgacgacgtgccgaagggcaagatcttcgtcaagctggccacccagaagcagaagtccatgaaggtgatcctggaccgcctcatcaaccagacgtacagcaagggcgcgtgcatgatccacaagtacaagaacaagtggtacttgagcatcacctacaagttcaacgcgatcaaggagaacaagttcgacaaggagcttattatgggcatcgacctgggcggcatcaacaccgtgtacttcgcgttcaacgaggggttcatccgctccaacatcaagtcggacgagatcatccgccagcgccggatcaacctgctcaagcagagcaaatactgttccaactcccggacggggaagggccggaccaagcggctccagcccatcgacgtgctctccaacaagatcgccaagttccgcaactcgaccaaccacaagtacgcgaactacatcgtgaagcagtgcctcaagcacaactgcgggcgcatccagatggagctgctcaagggcatctccaagaacgaccgcatcctcaaggactggacctacttcgacctccaggaaaagatcaagaatcaggcggagatccacgggatcgaggtcatcaaggtcgccccggcctacacgagccagcgctgctcgcagtgcgggtacatctgcaaggagaaccgctgcacccaggccacgttcgagtgcaagcagtgcggctacaagacgcacgcggactacaacgccgccaagaacatctccacctacgacatcgagaacatcatcaacaagcagctcgcggtccagagcaagctccacagcaagaagtgtatggaggagtacatcgagaagctcggctacctcgactga

SEQ ID NO: 2277 - DNA, 1338 bp, Unknown
  Bacillus sp. multi
ctgggcgtcacgatcaagatcatgaagtaccagatcctctgcccgctcaacgtggactggaccatcttcgagaagcacctccggaacctgacctaccaagtccggacgatctccaaccggacgatccagcagctctgggagttcgacgccctgtcgttcgactacttcaaggagcgcggcacctacccgacggtccaagacttatacggctgcacgcagaagaagatagacggctacatctaccacacgctccagagcaagtaccccgacatccacaagggcaacatgagcacgacgctccagaagatcattaagacctggaagtcccggcgcaacgagatccggaagggcgagatgtcgatccccagcttccggaaccgcatccccatcgacctccacaacaacagcgtggacatcacgaaggagaagaatggcgactacatcgccgggatctcgctgttcagccgcgacttccacaaggagaacgacgacgtgccgaagggcaagatattcgtgaagctcgccacccagaagcagaagtcgatgaaggtgatcctcgaccggctcatcaaccagacctacagcaagggcgcgtgcatgatccacaagtacaagaacaagtggtacttgtccatcacctacaagttcaacgcgatcaaggagaacaagttcgacaaggaactcataatgggcatcgacctcggcgggatcaacaccgtgtacttcgccttcaacgaggggttcatccgctcgaacatcaagtcggacgagatcatccggcagcggcgcatcaacctcctcaagcagtccaagtactgctccaactcccggacggggaagggccggacgaagcgcctccagcccatcgacgtgctcagcaacaagatcgccaagttccgcaacagcacgaaccacaagtacgccaactacatcgtgaagcagtgcctcaagcacaactgcgggcgcatccagatggagctgctcaagggcatcagcaagaacgaccgcatcctcaaggactggacctacttcgacctccaggaaaagattaagaatcaggccgagatccacgggatcgaggtcatcaaggtggccccggcctacacctcccagcggtgcagccagtgcggctacatctgcaaggagaaccggtgcacccaggcgacgttcgagtgcaagcagtgcgggtacaagacccacgcggactacaacgcggccaagaacatctccacctacgacatcgagaacatcatcaacaagcagctcgcggtgcagtccaagctgcactccaagaaatgcatggaggagtacatcgagaagctgggctacctcgactga

SEQ ID NO: 2278 - DNA, 1338 bp, Unknown
  Bacillus sp. multi
ctgggcgtgaccatcaagatcatgaagtaccagatcctctgcccgctgaacgtggactggacgatcttcgagaagcacctccggaacctcacctaccaggtgcggacgatcagcaaccggaccatccagcagctctgggagttcgacgccctgagcttcgactacttcaaggagcgcggcacgtaccccaccgtccaagacctttacgggtgcacgcagaagaagattgacggctacatctaccacacgctccagagcaagtacccggacatccacaagggcaacatgagcacgaccctccagaagatcatcaagacctggaaatctcgccgcaacgagatccgcaagggcgagatgtcgatccccagcttccgcaaccgcatccccatcgacctgcacaacaactccgtggacatcacgaaggagaagaatggcgactacatcgcggggatctcgctcttcagccgcgacttccataaggagaacgacgacgtgccgaagggcaagatattcgtgaagctggcgacgcagaagcagaagtcgatgaaggtgatcctggaccgcctcatcaaccagacctactcgaagggcgcgtgcatgatccacaagtacaagaacaagtggtacctttcgataacctacaagttcaacgcgatcaaggagaacaagttcgacaaggagcttatcatgggcatcgacctgggcgggatcaacacggtgtacttcgccttcaacgagggcttcatccgcagcaacatcaagtccgacgagatcatccggcagcgccgcatcaacctgctcaagcagtccaaatactgctcgaactcccgcaccggcaaggggcgcacgaagcgcctccagcccatcgacgtgctgagcaacaagatcgccaagttccgcaacagcaccaaccacaagtacgcgaactacatcgtcaagcagtgcctcaagcacaactgcgggcgcatccagatggagctgctcaagggcatctccaagaacgaccgcatcctcaaggactggacctacttcgacctccaggagaaaatcaagaatcaggccgagatccacggcatcgaggtcatcaaggtcgccccggcctacaccagccagcggtgctcccagtgcgggtacatctgcaaggagaaccggtgcacccaggccacgttcgagtgcaagcagtgcggctacaagacccacgcggactacaacgcggccaagaacatctcgacctacgacatcgagaacatcatcaacaagcagctcgccgtccagtcgaagctgcacagcaagaagtgtatggaggagtacatcgagaagctcggctacctggactag

SEQ ID NO: 2279 - DNA, 1338 bp, Unknown
  Bacillus sp. multi
ctcggcgtgacgatcaagatcatgaagtaccagatcctctgcccgctcaacgtggactggacgatcttcgagaagcacctccggaacctgacgtaccaagtgcggacgatctccaaccggaccatccagcagctctgggagttcgacgccctctcgttcgactacttcaaggagcgcggcacctaccccaccgtccaagacctctatggctgcacgcagaagaaaatcgacgggtacatctaccacaccctccagagcaagtacccggacatccacaaggggaacatgagcacgaccctccagaaaatcatcaagacctggaagtcccggcggaacgagatccgcaagggcgagatgtcgatccccagcttccgcaaccgcatccccatcgacctccacaacaacagcgtggacatcacgaaggagaagaacggcgactacatcgcgggcatcagcctgttcagccgcgacttccacaaggagaacgacgacgtgccgaagggcaaaatcttcgtgaagctggccacgcagaagcagaagtccatgaaggtcatcctggaccgcctcatcaaccagacctacagcaagggcgcgtgcatgatccacaagtacaagaacaagtggtatctctcaatcacctacaagttcaacgcgatcaaggagaacaagttcgacaaggaacttatcatgggcatcgacctgggcgggatcaacaccgtgtacttcgcgttcaacgagggcttcatccgcagcaacatcaagtccgacgagatcatccggcagcggcgcatcaacctcctcaagcagagcaaatattgttccaactcccgcacggggaaggggcgcacgaagcggctccagcccatcgacgtcctgtccaacaagatcgccaagttccgcaacagcacgaaccacaagtacgccaactacatcgtcaagcagtgcctcaagcacaactgcgggcgcatccagatggagctgctcaaggggatcagcaagaacgaccgcatcctcaaggactggacctacttcgacctccaggagaaaatcaagaaccaggccgagatccacggcatcgaggtcatcaaggtcgcgcccgcctacacctcgcagcggtgctcgcagtgcggctacatctgcaaggagaaccgctgcacccaggccaccttcgagtgcaagcagtgcggctacaagacccacgcggactacaacgcggccaagaacatctccacgtacgacatcgagaacatcatcaacaagcagctcgccgtccagtcgaagctccacagcaagaaatgcatggaggagtacatcgagaagctcggctacctcgactga

SEQ ID NO: 2280 - DNA, 1338 bp, Paenibacillus sp. novel
ctcggcgtcacgatcaagatcatgaagtaccagatcctctgcccgctcaacgtggactggacgatcttcgagaagcacctccgcaacctgacctaccaagtgaggaccatcagcaaccggaccatccagcagctctgggagttcgacgccctgagcttcgactacttcaaggagcgcggcacgtaccccacggtccaggacttatacggctgcacgcagaagaagatcgacggctacatctaccacacgctccagagcaagtacccggacatccacaaggggaacatgagcaccacgctccagaaaatcatcaagacctggaaaagccgccgcaacgagatccgcaagggcgagatgagcatcccctcgttccgcaaccgcatccccatcgacctgcacaacaacagcgtggacatcacgaaggaaaagaacggggactacatcgccgggatctccctgttcagccgcgacttccataaggagaacgacgacgtgccgaagggcaagatattcgtaaagctcgccacccagaagcagaagtccatgaaggtcatcctggaccgcctcatcaaccagacctacagcaagggcgcgtgcatgatccacaagtacaagaacaagtggtatcttagcatcacctacaagttcaacgccatcaaggagaacaagttcgacaaggagttgataatgggcatcgacctcggcggcatcaacaccgtgtacagcgcgttcaacgagggcttcatccggtccaacatcaagtccgacgagatcatccgccagcgccgcatcaacctcctcaagcagtccaagtattgctccaactcccggacgggcaagggccggacgaagcgcctccagcccatcgacgtcctgtcgaacaagatcgccaagttccgcaacagcacgaaccacaagtacgccaactacatcgtcaagcagtgcctcaagcacaactgcgggcgcatccagatggagctgctcaaggggatctccaagaacgaccgcatcctcaaggactggacctacttcgacctccaggagaaaattaagaaccaggccgagatccacgggatcgaggtcatcaaggtcgccccggcctacaccagccagcggtgctcccagtgcggctacatctgcaaggagaaccggtgcacccaggccaccttcgagtgcaagcagtgcggctacaagacccacgccgactacaacgcggccaagaacatctccacctacgacatcgagaacatcatcaacaagcagctcgcggtgcagtccaagctgcactccaagaagtgcatggaggagtacatcgaggagctgggctacctggactga

SEQ ID NO: 2281 - DNA, 1338 bp, Paenibacillus sp. novel
ctcggcgtgacgatcaagatcatgaagtaccagatcctctgcccgctcaacgtggactggaccatcttcgagaagcacctccggaacctcacctaccaagtccggacgatctccaaccggaccatccagcagctctgggagttcgacgccctgtccttcgactacttcaaggagcgcggcacgtaccccaccgtccaggatctttatggctgcacccagaagaaaattgacgggtacatctaccacacgctccagtcgaagtaccccgacatccacaagggcaacatgagcaccaccctccagaaaatcatcaagacctggaagtcacgccggaacgagatccggaagggcgagatgtccatccccagcttccggaaccgcatccccatcgacctgcacaacaacagcgtggacatcacgaaggagaagaacggcgactacatcgccgggatctcgctgttcagccgggacttccacaaggagaacgacgacgtgccgaagggcaagattttcgtaaagctggccacccagaagcagaagtccatgaaggtgatcctcgaccggctcatcaaccagacctactcgaagggcgcgtgcatgatccacaagtacaagaacaagtggtatctctcgatcacgtacaagttcaacgcgatcaaggagaacaagttcgacaaggagctaatcatggggatcgacctcggcgggatcaacacggtgtactccgccttcaacgaggggttcatccgctcgaacatcaagtccgacgagatcatccggcagcggcgcatcaacctgctcaagcagtccaagtactgttccaacagccgcacggggaagggccggacgaagcggctccagcccatcgacgtgctctccaacaagatcgccaagttccgcaactcgacgaaccacaagtacgccaactacatcgtcaagcagtgcctcaagcacaactgcgggcgcatccagatggagctgctcaagggcatcagcaagaacgaccgcatcctcaaggactggacctacttcgacctccaggagaaaattaagaatcaggccgagatccacgggatcgaggtcatcaaggtggccccggcctacacctcccagcggtgcagccagtgcggctacatctgcaaggagaaccggtgcacccaggccacgttcgagtgcaagcagtgcgggtacaagacgcacgcggactacaacgccgccaagaacatctccacctacgacatcgagaacatcatcaacaagcagctcgccgtgcagagcaagctgcacagcaagaagtgtatggaggagtacatcgaggagctgggctacctcgactag

SEQ ID NO: 2282 - DNA, 1338 bp, Paenibacillus sp. novel
ctgggcgtcacgatcaagatcatgaagtaccagatcctctgcccgctgaacgtggactggaccatcttcgagaagcacctccggaacctcacctaccaagtgcggacgatctcgaaccggaccatccagcagctctgggagttcgacgccctgtccttcgactacttcaaggagcgcgggacgtaccccaccgtccaagacctctacggctgcacgcagaagaaaattgacgggtacatctaccacacgctccagagcaagtacccggacatccacaagggcaacatgagcaccacgctccagaagattatcaaaacctggaagtcccgccgcaacgagatccgcaagggcgagatgagcatcccctccttccggaaccgcatccccatcgacctccacaacaacagcgtggacatcacgaaggagaagaatggggactacatcgcggggatctccctgttcagccgcgacttccacaaggagaacgacgacgtgccgaagggcaagatattcgttaagctggccacccagaagcagaagtcgatgaaggtgatcctggaccgcctcatcaaccagacgtactcgaagggcgcgtgcatgatccacaagtacaagaacaagtggtacttgagcatcacctacaagttcaacgccatcaaggagaacaagttcgacaaggaactaattatggggatcgacctcggcgggatcaacaccgtgtactcggccttcaacgaggggttcatccgctccaacatcaagtcggacgagatcatccgccagcgccggatcaacctcctcaagcagtccaaatactgttccaactcccgcaccggcaagggccgcacgaagcggctccagcccatcgacgtcctgtccaacaagatcgccaagttccgcaactcgaccaaccacaagtacgcgaactacatcgtgaagcagtgcctcaagcacaactgcgggcgcatccagatggagctgctcaagggcatcagcaagaacgaccgcatcctcaaggactggacgtacttcgacctccaggagaaaatcaagaaccaggccgagatccacgggatcgaggtcatcaaggtcgcgcccgcctacaccagccagcgctgctcccagtgcggctacatctgcaaggagaaccggtgcacccaggcgacgttcgagtgcaagcagtgcgggtacaagacgcacgccgactacaacgccgccaagaacatctcgacgtacgacatcgagaacatcatcaacaagcagctcgcggtccagagcaagctccactccaagaaatgcatggaggagtacatcgaggagctgggctacctcgactag

SEQ ID NO: 2283 - DNA, 1338 bp, Paenibacillus sp. novel
ctcggggtgacgatcaagatcatgaagtaccagatcctgtgcccgctgaacgtggactggaccatcttcgagaagcacctccggaacctcacgtaccaagtccggaccatcagcaaccgcacgatccagcagctctgggagttcgacgccctctcgttcgactacttcaaggagcgcggcacctaccccaccgtccaggacctgtacggctgcacccagaagaaaattgacggctacatctaccacaccctccagagcaagtacccggacatccacaagggcaacatgagcaccacgctccagaagattatcaagacatggaagtcccgccggaacgagatccgcaagggcgagatgtccatcccgtccttccggaaccgcatccccatcgacctccacaacaacagcgtggacattacgaaagagaagaatggcgactacatcgccgggatcagcctgttctcgcgcgacttccacaaggagaacgacgacgtgccgaagggcaaaattttcgttaagctggcgacgcagaagcagaagtccatgaaggtcatcctggaccgcctcatcaaccagacgtacagcaagggcgcgtgcatgatccacaagtacaagaacaagtggtacttgtccatcacgtacaagttcaacgccatcaaggagaacaagttcgacaaggagctgataatgggcatcgacctgggcggcatcaacaccgtgtacagcgccttcaacgagggcttcatccggtcgaacatcaagagcgacgagatcatccgccagcgccggatcaacctgctcaagcagtccaagtattgttccaactcccggacggggaagggccgcaccaagcgcctccagcccatcgacgtcctgagcaacaagatcgccaagttccgcaacagcacgaaccacaagtacgccaactacatcgtcaagcagtgcctcaagcacaactgcgggcgcatccagatggagctgctcaagggcatctccaagaacgaccgcatcctcaaggactggacgtacttcgacctccaggagaaaatcaaaaaccaggcggagatccacgggatcgaggtcatcaaggtcgccccggcctacacctcccagcgctgctcccagtgcggctacatctgcaaggagaaccggtgcacccaggcgacgttcgagtgcaagcagtgcggctacaagacgcacgcggactacaacgccgccaagaacatctcgacgtacgacatcgagaacatcatcaacaagcagctcgcggtgcagtccaagctccactccaagaagtgcatggaggagtacatcgaggagctgggctacctcgactga

SEQ ID NO: 2284 - DNA, 1338 bp, Paenibacillus sp. novel
ctcggggtgaccatcaagatcatgaagtaccagatcctctgcccgctcaacgtggactggacgatcttcgagaagcacctccgcaacctgacgtaccaagtgcggacgatctccaaccgcaccatccagcagctctgggagttcgacgccctgtcgttcgactacttcaaggagcgcgggacgtaccccaccgtccaggacttgtacggctgcacgcagaagaaaatcgacggctacatctaccacaccctccagagcaagtaccccgacatccacaaggggaacatgagcaccacgctccagaaaatcatcaagacctggaagtcccggcgcaacgagatccggaagggcgagatgtccatcccgtccttccgcaaccgcatccccatcgacctgcacaacaacagcgtggacatcacgaaggagaagaatggggactacatcgcggggatctcgctgttctcccgcgacttccacaaggagaacgacgacgtgccgaagggcaagatattcgtgaagctcgccacccagaagcagaagtccatgaaggtgatcctggaccgcctcatcaaccagacctactcgaagggcgcgtgcatgatccacaagtacaagaacaagtggtacttgagcatcacgtacaagttcaacgccatcaaggagaacaagttcgacaaggagcttatcatgggcatcgacctcggcggcatcaacaccgtgtacagcgccttcaacgagggcttcatccgcagcaacatcaagtcggacgagatcatccgccagcggcggatcaacctcctcaagcagagcaagtattgctccaacagccgcacggggaagggccgcacgaagcgcctccagcccatcgacgtgctctcgaacaagatcgccaagttccgcaacagcaccaaccacaagtacgccaactacatcgtcaagcagtgcctcaagcacaactgcgggcgcatccagatggagctgctcaagggcatctccaagaacgaccgcatcctcaaggactggacctacttcgacctccaggaaaaaatcaagaaccaggccgagatccacgggatcgaggtcatcaaggtcgcgcccgcctacaccagccagcggtgctcgcagtgcggctacatctgcaaggagaaccggtgcacccaggccacgttcgagtgcaagcagtgcggctacaagacgcacgccgactacaacgccgccaagaacatcagcacctacgacatcgagaacatcatcaacaagcagctcgcggtgcagtccaagctgcacagcaagaagtgtatggaggagtacatcgaggagctgggctacctcgactga

SEQ ID NO: 2285 - DNA, 1335 bp, Bacillus thuringiensis
atgaagtaccagatcctctgccccatgaacgtggactggaccatcttcgagaagcacctccggaacctgacgtaccaagttcggacgatctccaaccgcacgatccagcagctctgggagttcgacgcgctctccttcgactacttcaaggagcgcggcacctacccgaccgtccaggatctctacggctgcacgcagaagaagattgacggctacatctaccacaccctccagtcgaagtacccggacatccacaaggggaacatgagcacgacgctccagaagatcattaagacctggaagtcccgccggaacgagatccgcaagggcgagatgtcgatcccgtccttccgcaaccgcatccccatcgacctgcacaacaactcggtggacatcaagaaggagaagaacggcgactacatcgccgggatctccctgttctcccgcgacttccacaaggagaactccgacgtgccgaagggcaagatcttcgtcaagctggccaccaagaagcagaagtcgatgaagatcatcctggaccgcctcatgaaccagacgtacagcaagggcgcgtgcatgatccacaagtacaagaacaagtggtatctgagcatcacctacaagttcaacgcgatcaaggagaacaagttcgacaaggatctcatcatgggcatcgacatgggcggcatcaacaccgtgtacttcgccttcaacgagggcttcatccgcagcaacatcaagagcgacgagatcaaggcgttcaacgagaagatccgccagcggcgcatcaacctcctcaagcagtccaactactgctccaactcgcgcaccggcaagggccgggcgaagcggctccagcccatcgacgtcctgagcaacaagatcgccaagttccgcaactccacgaaccacaagtacgccaactacatcatcaagcagtgcctcaagcacaactgcgggcgcatccagatagagctgctgaaggggatctccaagaacgacaaggtgctcaaggactggacctacttcgacctccaggagaagattaagaaccaggcggaggtccacggcatcgaggtcatcaaggtggcctcggcctacacgagccagcggtgctcccagtgcggctacatctgcaaggagaaccgctgcacccaggccgtcttcgagtgcaagcagtgcgggtacaagacccacgccgactacaacgccgccaagaacatcgccacctacgacatcgagaacatcatcaacaaacagctcgccgtccagagcaagctccactccaagaagtgcatggaggagtacatcgaggagctgggctacctcgactga

SEQ ID NO: 2286 - DNA, 1335 bp, Bacillus thuringiensis
atgaagtaccagatcctctgccccatgaacgtggactggacgatcttcgagaagcacctccggaacctgacctaccaggtgcggacgatcagcaaccgcaccatccagcagctctgggagttcgacgccctctccttcgactacttcaaggagcgcggcacctacccgacggtccaagacctttacggctgcacgcagaagaagatcgacggctacatctaccacaccctccagagcaagtaccccgacatccacaagggcaacatgagcaccacgctccagaaaatcatcaagacctggaagtcccgccggaacgagatccggaagggcgagatgtccatcccgagcttccgcaaccgcatccccatcgacctgcacaacaactccgtggacatcaagaaggagaagaatggcgactacatcgcgggcatcagcctgttcagccgcgacttccacaaggagaactccgacgtgccgaagggcaagatattcgtcaagctggcgaccaagaagcagaagtcgatgaagatcatcctcgaccgcctgatgaaccagacctacagcaagggcgcgtgcatgatccacaagtacaagaacaagtggtacttgagcatcacgtacaagttcaacgccatcaaggagaacaagttcgacaaagacctcatcatgggcatcgacatgggcgggatcaacacggtgtacttcgccttcaacgagggcttcatccgctccaacatcaagtcggacgagatcaaggcgttcaacgagaaaatacgccagcggcgcatcaacctcctcaagcagtcgaactactgctcgaacagccgcacgggcaagggccgggccaagcgcctccagcccatcgacgtgctcagcaacaagatcgccaagttccgcaacagcacgaaccacaagtacgcgaactacatcatcaagcagtgcctcaagcacaactgcgggcgcatccagattgagctgctcaaggggatcagcaagaacgacaaggtgctcaaggactggacctacttcgacctccaggagaagatcaagaaccaggccgaggtccacggcatcgaggtcatcaaggtggcgtccgcctacaccagccagcgctgctcccagtgcggctacatctgcaaggagaaccggtgcacccaggcggtgttcgagtgcaagcagtgcggctacaagacccacgccgactacaacgccgccaagaacatcgccacgtacgacatcgagaacatcatcaacaagcagctcgccgtgcagagcaagctccacagcaagaagtgcatggaggagtacatcgaggagctgggctacctcgactga

SEQ ID NO: 2287 - DNA, 1335 bp, Bacillus thuringiensis
atgaagtaccagatcctctgcccgatgaacgtggactggaccatcttcgagaagcacctccggaacctcacctaccaggtgcggacgatctccaaccgcaccatccagcagctctgggagttcgacgcgctctccttcgactacttcaaggagcgcggcacgtaccccaccgtccaggacttgtacggctgcacccagaagaaaatcgacgggtacatctaccacaccctccagagcaagtacccggacatccacaaggggaacatgagcaccacgctccagaaaatcatcaagacctggaagtcccgccgcaacgagatccggaagggcgagatgtcgatcccctccttccgcaaccgcatccccatcgacctgcacaacaactcggtggacatcaagaaggagaagaacggggactacatcgcgggcatctcgctgttcagccgcgacttccacaaggagaactcggacgtcccgaagggcaagatcttcgtcaagctcgccaccaagaaacagaagtccatgaagatcatcctggaccggctgatgaaccagacgtacagcaagggcgcgtgcatgatccacaagtacaagaacaagtggtacttgagcatcacctacaagttcaacgccatcaaggagaacaagttcgacaaggatctcataatgggcatcgacatgggcgggatcaacaccgtgtacttcgccttcaacgaggggttcatccggagcaacatcaagagcgacgagatcaaggcgttcaacgagaaaatccgccagcggcggatcaacctgctcaagcagtcgaactactgctccaactcccgcaccggcaagggccgcgcgaagcggctccagcccatcgacgtcctgtcgaacaagatcgccaagttccgcaacagcaccaaccacaagtacgcgaactacatcatcaagcagtgcctcaagcacaactgcgggcgcatccagatcgagctgctcaaggggatctccaagaacgacaaggtgctcaaggactggacctacttcgacctccaggagaagatcaagaaccaggcggaggtccacgggatcgaggtcatcaaggtggcgtcggcctacacgagccagcggtgctcccagtgcgggtacatctgcaaggagaaccgctgcacccaggccgtcttcgagtgcaagcagtgcgggtacaagacgcacgcggactacaacgcggccaagaacatcgccacctacgacatcgagaacatcatcaacaagcagcttgcggtgcagtccaagctgcactccaagaaatgcatggaggagtacatcgaggagctgggctacctggactag

SEQ ID NO: 2288 - DNA, 1335 bp, Bacillus thuringiensis
atgaagtaccagatcctctgcccgatgaacgtggactggaccatcttcgagaagcacctccgcaacctcacctaccaggtgcggacgatctccaaccggaccatccagcagctctgggagttcgacgccctgagcttcgactacttcaaggagcggggcacgtaccccaccgtccaagacctctacggctgcacccagaagaagatcgacgggtacatctaccacacgctccagagcaagtaccccgacatccacaagggcaacatgagcaccacgctccagaaaatcatcaagacctggaagtcccgccggaacgagatccgcaagggcgagatgtccatcccgtccttccgcaaccgcatccccatcgacctccacaacaacagcgtggacatcaagaaggagaagaacggggactacatcgcgggcatcagcctgttcagccgcgacttccacaaggagaactcggacgtgccgaagggcaagatattcgtgaagctggcgaccaagaagcagaagtcgatgaagatcatcctcgaccgcctcatgaaccagacctactcgaagggcgcgtgcatgatccacaagtacaagaacaagtggtacctgagcatcacctacaagttcaacgccatcaaggagaacaagttcgacaaggacctgataatgggcatcgacatgggcgggatcaacaccgtgtacttcgccttcaacgagggcttcatccggtccaacatcaagagcgacgagatcaaggcgttcaacgagaaaatccgccagcgccgcatcaacctcctcaagcagtccaactactgctccaactcccgcaccgggaagggccgggccaagcgcctccagcccatcgacgtgctcagcaacaagatcgccaagttccgcaactccacgaaccacaagtacgccaactacatcatcaagcagtgcctcaagcacaactgcgggcgcatccagatcgagcttctcaaggggatctccaagaacgacaaggtgctcaaggactggacctacttcgacctccaggagaagattaagaaccaggccgaggtccacgggatcgaggtcatcaaggtcgcgtcggcctacaccagccagcggtgctcccagtgcggctacatctgcaaggagaaccgctgcacccaggcggtgttcgagtgcaagcagtgcggctacaagacccacgccgactacaacgcggccaagaacatcgccacgtacgacatcgagaacatcatcaacaagcaacttgcggtgcagagcaagctccactccaagaaatgcatggaggagtacatcgaggagctgggctacctggactga

SEQ ID NO: 2289 - DNA, 1335 bp, Bacillus thuringiensis
atgaagtaccagatcctctgccccatgaacgtggactggaccatcttcgagaagcacctccggaacctgacctaccaagttcggacgatcagcaaccgcacgatccagcagctctgggagttcgacgcgctctcgttcgactacttcaaggagcgcggcacctaccccacggtccaggatctctacggctgcacccagaagaagatcgacggctacatctaccacaccctccagagcaagtaccccgacatccacaaggggaacatgagcaccaccctccagaaaatcatcaagacctggaagtcccggcgcaacgagatccgcaagggcgagatgagcatcccctccttccggaaccgcatccccatcgacctccacaacaactcggtggacatcaagaaggagaagaatggcgactacatcgcggggatcagcctcttcagccgcgacttccacaaggagaactcggacgtcccgaagggcaagatcttcgtcaagctggcgaccaagaaacagaagtcgatgaagatcatcctcgaccggctcatgaaccagacgtactcgaagggcgcgtgcatgatccacaagtacaagaacaagtggtatctcagcatcacgtacaagttcaacgcgatcaaggagaacaagttcgacaaggacctgatcatgggcatcgacatgggcggcatcaacaccgtgtacttcgcgttcaacgaggggttcatccgctccaacatcaagagcgacgagatcaaggcgttcaacgagaagatccgccagcgccgcatcaacctcctcaagcagtcgaactactgctccaacagccgcaccggcaagggccgggccaagcgcctccagcccatcgacgtgctcagcaacaagatcgccaagttccgcaacagcaccaaccacaagtacgcgaactacatcatcaagcagtgcctcaagcacaactgcgggcgcatccagatcgaactcctcaaggggatcagcaagaacgacaaggtgctcaaggactggacctacttcgacctccaggagaagatcaagaatcaggcggaggtccacggcatcgaggtcatcaaggtggccagcgcctacaccagccagcggtgctcccagtgcgggtacatctgcaaggagaaccgctgcacccaggccgtgttcgagtgcaagcagtgcggctacaagacccacgcggactacaacgcggccaagaacatcgccacctacgacatcgagaacatcatcaacaagcagttggccgtgcagtcgaagctgcactccaagaagtgcatggaggagtacatcgaggagctgggctacctggactag

SEQ ID NO: 2290 - DNA, 1356 bp, Unknown
  Bacillus sp. multi
ctcggggtgacgatcaagatcatgaagtaccagatcctctgccccatgaacgtggactggacgatcttcgagaagcacctccgcaacctgacgtaccaggtgcggacgatctcgaaccggacgatccagcagctctgggagttcgacgccctgagcttcgactacttcaaggccatcgggacgtaccccaccgtccaggacttgtacggctgcacgcagaagaaaatcgacggctacatctaccacaccctccagtcgaagtacccggacatccacaagggcaacatgagcaccaccctccagaagattatcaagacctggaagtcccgccgcaacgagatccgcaagggcgagatgtccatcccgtccttccgcaaccgcatccccatcgacctccacaacaactccgtggacatcaagaaggagaagaacggggactacatcgcgggcatctccctgttctcgcgcgacttccacaaggagaacagcgacgtcccgaagggcaagatattcgtgaagctcgccaccaagaagcagaagtcgatgaagatcatcctcgaccggctgatgaaccagacctactcgaagggcgcgtgcatgatccacaagtacaagaacaagtggtacctctcgattacctacaagttcaacgccatcaaggagaacaacttcgacaaggagctgataatgggcatcgacatgggcgggatcaacaccgtgtacttcgccttcaacgaggggttcatccgcagcaacatcaagtcggacgagatcaaggcgttcaacgagaaaatccggcagcggcggatcaacctgctcaagcagtccaactactgctccaactcccgcacggggaaggggcgggccaagcgcctccagcccatcgacgtgctctccaacaagatcgccaagttccgcaacagcacgaaccacaagtacgcgaactacatcatcaagcagtgcctcaagcacaactgcgggcgcatccagatcgagcttctcaaggggatctccaagaacgacaaggtgctcaaggactggacgtacttcgacctccaggaaaagatcaagaaccaggcggaggtgcacgggatcgaggtcatcaaggtggcgtccgcctacaccagccagcgctgctcccagtgcggctacatctgcaaggagaaccgctgcacccaggcggtcttcgagtgcaagcagtgcgggtacaagacccacgcggactacaacgccgccaagaacatcgccacgtacgacatcgagaacatcatcaacaagcagctcgccgtgcagtcgaagctgcactccaagaagtgcatggaggagtacatcgaggagctgggctacctcgactga

SEQ ID NO: 2291 - DNA, 1356 bp, Unknown
  Bacillus sp. multi
ctgggcgtcacgatcaagatcatgaagtaccagatcctctgcccgatgaacgtggactggacgatcttcgagaagcacctccgcaacctcacctaccaagtccggacgatcagcaaccgcacgatccagcagctctgggagttcgacgcgctctccttcgactacttcaaggccatcggcacgtaccccaccgtccaggatctgtacggctgcacgcagaagaaaatagacggctacatctaccacacgctccagtcgaagtaccccgacatccacaaggggaacatgagcaccacgctccagaagatcatcaagacctggaagtcccgccgcaacgagatccgcaagggcgagatgtccatcccgtcgttccgcaaccgcatccccatcgacctgcacaacaactccgtggacatcaagaaggagaagaatggcgactacatcgccgggatctccctgttctcccgcgacttccacaaggagaactcggacgtcccgaagggcaagatcttcgtcaagctcgccaccaagaagcagaagtccatgaagatcatcctcgaccggctcatgaaccagacgtacagcaagggcgcgtgcatgatccacaagtacaagaacaagtggtacttgtccatcacgtacaagttcaacgccatcaaggagaacaacttcgacaaggagcttatcatggggatcgacatgggcggcatcaacaccgtgtacttcgccttcaacgaggggttcatccgcagcaacatcaagtccgacgagatcaaggcgttcaacgagaagatccgccagcgccggatcaacctcctcaagcagagcaactactgctccaactcgcgcacggggaagggccgcgcgaagcgcctccagcccatcgacgtgctgtcgaacaagatcgccaagttccgcaactccacgaaccacaagtacgcgaactacatcatcaagcagtgcctcaagcacaactgcgggcgcatccagatcgagctgctcaaggggatcagcaagaacgacaaggtgctcaaggactggacgtacttcgacctccaggagaagatcaagaaccaggcggaggtgcacgggatcgaggtcatcaaggtcgccagcgcctacaccagccagcggtgctcgcagtgcgggtacatctgcaaggagaaccgctgcacccaggccgtgttcgagtgcaagcagtgcggctacaagacccacgcggactacaacgccgccaagaacatcgccacctacgacatcgagaacatcatcaacaagcagttggcggtgcagagcaagctccactccaagaaatgcatggaggagtacatcgaggagctgggctacctcgactag

SEQ ID NO: 2292 - DNA, 1356 bp, Unknown
  Bacillus sp. multi
ctcggggtgacgatcaagatcatgaagtaccagatcctctgccccatgaacgtggactggacgatcttcgagaagcacctccgcaacctgacctaccaggtgcggacgatctcgaaccgcaccatccagcagctctgggagttcgacgcgctgtccttcgactacttcaaggccatcgggacgtacccgaccgtccaagacctctacggctgcacccagaagaaaatcgacgggtacatctaccacaccctccagagcaagtaccccgacatccacaaggggaacatgagcaccacgctccagaaaatcatcaagacctggaagtcccgccgcaacgagatccgcaagggcgagatgtccatcccctccttccgcaaccgcatccccatcgacctgcacaacaactccgtggacatcaagaaggagaagaacggcgactacatcgcgggcatctccctgttcagccgcgacttccacaaggagaactcggacgtgccgaagggcaagatcttcgtgaagctggccaccaagaagcagaagtcgatgaagatcatcctcgaccgcctcatgaaccagacgtacagcaagggcgcgtgcatgatccacaagtacaagaacaagtggtacctgtcgatcacctacaagttcaacgccatcaaggagaacaacttcgacaaggagctaatcatgggcatcgacatgggcgggatcaacacggtgtacttcgccttcaacgagggcttcatccgctccaacatcaagagcgacgagatcaaggcgttcaacgagaagatacgccagcgccgcatcaacctcctcaagcagagcaactactgctccaactcccgcaccggcaagggccgcgcgaagcgcctccagcccatcgacgtgctcagcaacaagatcgccaagttccgcaacagcacgaaccacaagtacgcgaactacatcatcaagcagtgcctcaagcacaactgcgggcgcatccagatcgagctgctcaaggggatcagcaagaacgacaaggtgctcaaggactggacctacttcgacctccaggagaagattaagaaccaggcggaggtccacgggatcgaggtcatcaaggtggccagcgcctacacgagccagcgctgctcccagtgcggctacatctgcaaggagaaccggtgcacccaggcggtcttcgagtgcaagcagtgcgggtacaagacccacgccgactacaacgcggccaagaacatcgccacctacgacatcgagaacatcatcaacaagcaattggccgtgcagtccaagctccactccaagaaatgcatggaggagtacatcgaggagctgggctacctcgactga

SEQ ID NO: 2293 - DNA, 1356 bp, Unknown
  Bacillus sp. multi
ctgggcgtcaccatcaagatcatgaagtaccagatcctctgcccgatgaacgtggactggacgatcttcgagaagcacctccggaacctcacctaccaggtgcggacgatctcgaaccgcaccatccagcagctctgggagttcgacgcgctctccttcgactacttcaaggccatcgggacgtacccgaccgtccaggatctctacggctgcacgcagaagaaaatcgacggctacatctaccacacgctccagtcgaagtaccccgacatccacaagggcaacatgagcacgaccctccagaagatcatcaagacctggaagtcccggcgcaacgagatccgcaagggcgagatgagcatcccgtccttccgcaaccgcatccccatcgacctccacaacaacagcgtggacatcaagaaggagaagaatggcgactacatcgcgggcatctccctgttcagccgcgacttccacaaggagaactcggacgtcccgaagggcaagatattcgtcaagctggcgaccaagaaacagaagtccatgaagatcatcctggaccgcctcatgaaccagacctacagcaagggcgcgtgcatgatccacaagtacaagaacaagtggtacctctcgatcacctacaagttcaacgccatcaaggagaacaacttcgacaaggaactgatcatggggatcgacatgggcggcatcaacaccgtgtacttcgccttcaacgagggcttcatccgctccaacatcaagagcgacgagatcaaggcgttcaacgagaaaatccgccagcgccggatcaacctgctcaagcagagcaactactgctcgaactcgcgcacgggcaagggccgggccaagcgcctccagcccatcgacgtcctgtccaacaagatcgccaagttccgcaacagcaccaaccacaagtacgcgaactacatcatcaagcagtgcctcaagcacaactgcgggcgcatccagatcgagctgctcaaggggatcagcaagaacgacaaggtgctcaaggactggacgtacttcgacctccaggagaagattaagaaccaggcggaggtgcacggcatcgaggtcatcaaggtggccagcgcctacacctcgcagcggtgctcgcagtgcggctacatctgcaaggagaaccgctgcacccaggcggtcttcgagtgcaagcagtgcggctacaagacgcacgccgactacaacgcggccaagaacatcgccacgtacgacatcgagaacatcatcaacaagcaactggcggtccagagcaagctccacagcaagaagtgcatggaggagtacatcgaggagctgggctacctcgactag

SEQ ID NO: 2294 - DNA, 1356 bp, Unknown
  Bacillus sp. multi
ctgggcgtgaccatcaagatcatgaagtaccagatcctctgccccatgaacgtggactggacgatcttcgagaagcacctccggaacctgacctaccaagtgcggacgatctcgaaccgcaccatccagcagctctgggagttcgacgccctgtccttcgactacttcaaggccatcggcacgtacccgacggtccaggacctgtacggctgcacgcagaagaaaatcgacggctacatctaccacaccctccagagcaagtacccggacatccacaagggcaacatgagcaccacgctccagaagatcatcaagacctggaagtcccggcgcaacgagatccggaagggcgagatgtccatccccagcttccggaaccgcatccccatcgacctccacaacaactccgtggacatcaagaaggagaagaacggcgactacatcgccgggatctcgctgttcagccgcgacttccacaaggagaactcggacgtcccgaagggcaagatattcgtcaagctggccaccaagaagcagaagtccatgaagatcatcctcgaccggctgatgaaccagacctactcgaagggcgcgtgcatgatccacaagtacaagaacaagtggtacctcagcatcacctacaagttcaacgcgatcaaggagaacaacttcgacaaggagcttatcatggggatcgacatgggcgggatcaacaccgtgtacttcgccttcaacgaggggttcatccgctccaacatcaagtccgacgagatcaaggcgttcaacgagaagatccggcagcggcgcatcaacctcctcaagcagagcaactactgctccaactcccgcaccggcaagggccgcgccaagcgcctccagcccatcgacgtcctgtccaacaagatcgccaagttccgcaactccaccaaccacaagtacgcgaactacatcatcaagcagtgcctcaagcacaactgcgggcgcatccagatcgaactgcttaaggggatcagcaagaacgacaaggtgctcaaggactggacctacttcgacctccaggagaagattaagaaccaggccgaggtgcacgggatcgaggtcatcaaggtggccagcgcctacacgagccagcggtgctcccagtgcgggtacatctgcaaggagaaccgctgcacccaggccgtgttcgagtgcaagcagtgcgggtacaagacccacgccgactacaacgccgccaagaacatcgccacctacgacatcgagaacatcatcaacaagcagcttgctgtgcagagcaagctccactccaagaagtgcatggaggagtacatcgaggagctgggctacctggactag

SEQ ID NO: 2295 - DNA, 1335 bp, Unknown
  Bacillus sp. multi
atgaagtaccagatcctctgccccatgaacgtggactggaccatcttcgagaagcacctccggaacctcacctaccaagtgcggacgatcagcaaccgcaccatccagcagctctgggagttcgacgcgctctccttcgactacttcaaggccatcggcacgtaccccaccgtccaggacctctacggctgcacccagaagaaaatcgacgggtacatctaccacaccctccagtcgaagtacccggacatccacaaggggaacatgagcaccacgctccagaaaatcatcaagacctggaagtcccggcggaacgagatccgcaagggcgagatgtcgatcccgtccttccggaaccgcatccccatcgacctccacaacaactccgtggacatcaagaaggagaagaacggcgactacatcgcgggcatctccctgttcagccgcgacttccacaaggagaactcggacgtcccgaagggcaaaatcttcgtcaagctggccaccaagaaacagaagtcgatgaagatcatcctcgaccggctcatgaaccagacgtacagcaagggcgcgtgcatgatccacaagtacaagaacaagtggtacttgagcataacctacaagttcaacgccatcaaggagaacaacttcgacaaggagcttattatggggatcgacatgggcggcatcaacaccgtgtacttcgccttcaacgagggcttcatccgcagcaacatcaagtcggacgagatcaaggcgttcaacgagaagatccgccagcgccgcatcaacctgctcaagcagtcgaactactgctccaactcccgcaccgggaagggccgcgccaagcggctccagcccatcgacgtgctctccaacaagatcgccaagttccgcaactccacgaaccacaagtacgcgaactacatcatcaagcagtgcctcaagcacaactgcgggcgcatccagatcgagctgctcaaggggatcagcaagaacgacaaggtgctcaaggactggacctacttcgacctccaggagaagatcaagaaccaggcggaggtgcacgggatcgaggtcatcaaggtcgccagcgcctacacctcccagcggtgctcgcagtgcggctacatctgcaaggagaaccgctgcacccaggcggtgttcgagtgcaagcagtgcggctacaagacgcacgcggactacaacgcggccaagaacatcgccacgtacgacatcgagaacatcatcaacaagcagctggccgtgcagagcaagctccactccaagaagtgcatggaggagtacatcgaggagctgggctacctcgactga

SEQ ID NO: 2296 - DNA, 1335 bp, Unknown
  Bacillus sp. multi
atgaagtaccagatcctctgccccatgaacgtggactggaccatcttcgagaagcacctccggaacctgacgtaccaggtgcggacgatctccaaccgcaccatccagcagctctgggagttcgacgcgctcagcttcgactacttcaaggccatcggcacctacccgacggtccaagacctgtacggctgcacccagaagaaaatcgacggctacatctaccacacgctccagtcgaagtacccggacatccacaagggcaacatgagcacgaccctccagaaaatcatcaagacctggaagtcgcggcgcaacgagatccgcaagggcgagatgagcatcccgagcttccgcaaccgcatccccatcgacctccacaacaactcggtggacatcaagaaggagaagaacggggactacatcgccgggatctccctcttcagccgggacttccacaaggagaactccgacgtgccgaagggcaagatattcgtgaagctcgccaccaagaagcagaagtccatgaagatcatcctggaccgcctgatgaaccagacctactcgaagggcgcgtgcatgatccacaagtacaagaacaagtggtatttgagcatcacctacaagttcaacgcgatcaaggagaacaacttcgacaaggagctcattatgggcatcgacatgggcggcatcaacaccgtgtacttcgccttcaacgagggcttcatccgctcgaacatcaagagcgacgagatcaaggcgttcaacgagaagatccgccagcggcggatcaacctcctcaagcagtccaactactgctcgaacagccgcacgggcaagggccgggccaagcggctccagcccatcgacgtcctctccaacaagatcgccaagttccgcaacagcacgaaccacaagtacgcgaactacatcatcaagcagtgcctcaagcacaactgcgggcgcatccagatagagctcctcaaggggatcagcaagaacgacaaggtgctcaaggactggacctacttcgacctccaggagaagatcaagaaccaggcggaggtgcacgggatcgaggtcatcaaggtggccagcgcctacaccagccagcgctgctcccagtgcgggtacatctgcaaggagaaccgctgcacccaggcggtgttcgagtgcaagcagtgcgggtacaagacccacgccgactacaacgcggccaagaacatcgccacctacgacatcgagaacatcatcaacaagcaactcgccgtccagagcaagctccacagcaagaagtgcatggaggagtacatcgaggagctgggctacctggactga

SEQ ID NO: 2297 - DNA, 1335 bp, Unknown
  Bacillus sp. multi
atgaagtaccagatcctctgccccatgaacgtggactggacgatcttcgagaagcacctccggaacctgacctaccaggtgcggacgatctccaaccgcacgatccagcagctctgggagttcgacgcgctgagcttcgactacttcaaggccatcggcacctacccgaccgtccaagacctctacggctgcacgcagaagaagatcgacggctacatctaccacacgctccagagcaagtacccggacatccacaagggcaacatgagcacgaccctccagaagatcatcaagacctggaagtcccgccgcaacgagatccgcaagggcgagatgagcatcccgtccttccggaaccgcatccccatcgacctccacaacaactcggtggacatcaagaaggagaagaatggcgactacatcgccgggatcagcctcttcagccgcgacttccacaaggagaactcggacgtgccgaagggcaagatattcgtaaagctggccaccaagaagcagaagtcgatgaagatcatcctcgaccggctcatgaaccagacctacagcaagggcgcgtgcatgatccacaagtacaagaacaagtggtacctctccatcacctacaagttcaacgccatcaaggagaacaacttcgacaaggagctgattatgggcatcgacatgggcggcatcaacaccgtgtacttcgccttcaacgaggggttcatccgcagcaacatcaagtcggacgagatcaaggcgttcaacgagaaaatccggcagcggcgcatcaacctcctcaagcagagcaactactgctccaactcccgcaccggcaagggccgggcgaagcggctccagcccatcgacgtgctctccaacaagatcgccaagttccgcaacagcacgaaccacaagtacgccaactacatcatcaagcagtgcctcaagcacaactgcgggcgcatccagatcgagctactcaaggggatcagcaagaacgacaaggtgctcaaggactggacctacttcgacctccaggagaaaatcaagaatcaggccgaggtgcacgggatcgaggtcatcaaggtggcctccgcctacacctcgcagcggtgctcccagtgcggctacatctgcaaggagaaccggtgcacccaggccgtgttcgagtgcaagcagtgcggctacaagacccacgcggactacaacgccgccaagaacatcgccacgtacgacatcgagaacatcatcaacaagcagctcgccgtgcagtcgaagctgcactccaagaagtgcatggaggagtacatcgaggagctgggctacctggactag

SEQ ID NO: 2298 - DNA, 1335 bp, Unknown
  Bacillus sp. multi
atgaagtaccagatcctctgcccgatgaacgtggactggaccatcttcgagaagcacctccgcaacctgacctaccaagtccggacgatcagcaaccgcacgatccagcagctctgggagttcgacgcgctgtccttcgactacttcaaggccatcggcacctaccccacggtccaagatctgtacggctgcacgcagaagaaaatcgacggctacatctaccacaccctccagagcaagtaccccgacatccacaagggcaacatgagcaccaccctccagaagatcatcaagacctggaagtcccgccgcaacgagatccggaagggcgagatgagcatcccgtcgttccgcaaccgcatccccatcgacctccacaacaacagcgtggacatcaagaaggagaagaacggggactacatcgccgggatcagcctgttctcgcgcgacttccacaaggagaacagcgacgtcccgaagggcaagatcttcgtgaagctcgccaccaagaaacagaagtccatgaagatcatcctcgaccgcctgatgaaccagacgtacagcaagggcgcgtgcatgatccacaagtacaagaacaagtggtacttgtccatcacctacaagttcaacgccatcaaggagaacaacttcgacaaggagctgattatggggatcgacatgggcggcatcaacaccgtgtacttcgccttcaacgagggcttcatccggagcaacatcaagtccgacgagatcaaggcgttcaacgagaagattcggcagcgccggatcaacctgctcaagcagtccaactactgctcgaactcccgcacggggaagggccgcgcgaagcgcctccagcccatcgacgtcctctcgaacaagatcgccaagttccgcaactccaccaaccacaagtacgccaactacatcatcaagcagtgcctcaagcacaactgcgggcgcatccagatcgagctgctcaaggggatcagcaagaacgacaaggtgctcaaggactggacctacttcgacctccaggagaagatcaagaaccaggccgaggtccacgggatcgaggtcatcaaggtcgccagcgcctacacgagccagcggtgctcgcagtgcggctacatctgcaaggagaaccggtgcacccaggcggtcttcgagtgcaagcagtgcggctacaagacccacgccgactacaacgccgccaagaacatcgccacctacgacatcgagaacatcatcaacaaacagctcgccgtgcagagcaagctccactccaagaagtgcatggaggagtacatcgaggagctgggctacctggactga

SEQ ID NO: 2299 - DNA, 1335 bp, Unknown
  Bacillus sp. multi
atgaagtaccagatcctctgccccatgaacgtggactggacgatcttcgagaagcacctccgcaacctcacctaccaagtgcggacgatcagcaaccggaccatccagcagctctgggagttcgacgcgctctccttcgactacttcaaggccatcgggacgtaccccacggtccaggacctttacggctgcacccagaagaaaatcgacggctacatctaccacacgctccagtcgaagtaccccgacatccacaaggggaacatgagcacgaccctccagaagattatcaagacctggaagtcgcgccgcaacgagatccggaagggcgagatgtccatcccgtccttccgcaaccgcatccccatcgacctccacaacaactcggtggacatcaagaaggagaagaacggcgactacatcgcggggatcagcctcttcagccgggacttccacaaggagaacagcgacgtcccgaagggcaagatattcgtcaagctcgccaccaagaagcagaagtccatgaagatcatcctggaccggctgatgaaccagacctacagcaagggcgcgtgcatgatccacaagtacaagaacaagtggtatctctccatcacctacaagttcaacgccatcaaggagaacaacttcgacaaggagttgatcatggggatcgacatgggcggcatcaacaccgtgtacttcgccttcaacgaggggttcatccgcagcaacatcaagtccgacgagatcaaggcgttcaacgagaagatccggcagcgccggatcaacctgctcaagcagagcaactactgctccaacagccgcaccggcaaggggcgggccaagcgcctccagcccatcgacgtcctcagcaacaagatcgccaagttccgcaactccacgaaccacaagtacgcgaactacatcatcaagcagtgcctcaagcacaactgcgggcgcatccagatcgagctgctcaaggggatctccaagaacgacaaggtgctcaaggactggacctacttcgacctccaggagaagattaagaaccaggccgaggtccacggcatcgaggtcatcaaggtcgcgtccgcctacacgagccagcggtgctcgcagtgcggctacatctgcaaggagaaccgctgcacccaggcggtgttcgagtgcaagcagtgcggctacaagacccacgcggactacaacgccgccaagaacatcgccacgtacgacatcgagaacatcatcaacaagcaactggcggtccagagcaagctccacagcaagaagtgcatggaggagtacatcgaggagctgggctacctcgactga

SEQ ID NO: 2300 - DNA, 1335 bp, Unknown
  Bacillus sp. multi
atgaagtaccagatcctctgcccgatgaacgtggactggacgatcttcgagaagcacctccggaacctcacctaccaagtccggacgatctcgaaccggacgatccagcagctctgggagttcgacgccctctcgttcgactacttcaaggccatcggcacctacccgacggtccaagatctctacgggtgcacgcagaagaagatcgacgggtacatctaccacaccctccagtcgaagtaccccgacatccacaagggcaacatgagcaccacgctccagaagatcatcaagacctggaagtcccgccgcaacgagatccggaagggcgagatgtccatcccgagcttccggaaccgcatccccatcgacctgcacaacaactccgtggacatcaagaaggagaagaacggcgactacatcgccgggatctcgctgttcctccgcgacttccacaaggagaactcggacgtcccgaagggcaagatattcgtgaagctggccaccaagaagcagaagtccatgaagatcatcctcgaccgcctgatgaaccagacctactcgaagggcgcgtgcatgatccacaagtacaagaacaagtggtacttgtccatcacctacaagttcaacgccatcaaggagaacaacttcgacaaggagcttattatggggatcgacatgggcggcatcaacaccgtgtacttcgccttcaacgagggcttcatccgctcgaacatcaagagcgacgagatcaaggcgttcaacgagaagatccgccagcgccgcatcaacctcctcaagcagtccaactactgctccaacagccgcacgggcaagggccgcgccaagcgcctccagcccatcgacgtcctcagcaacaagatcgccaagttccgcaacagcaccaaccacaagtacgccaactacatcatcaagcagtgcctcaagcacaactgcgggcgcatccagatcgagctgcttaaggggatctccaagaacgacaaggtgctcaaggactggacgtacttcgacctccaggagaagatcaagaaccaggcggaggtccacggcatcgaggtcatcaaggtcgcgtccgcctacacgagccagcggtgctcgcagtgcggctacatctgcaaggagaaccggtgcacccaggccgtgttcgagtgcaagcagtgcggctacaagacgcacgcggactacaacgccgccaagaacatcgccacctacgacatcgagaacatcatcaacaagcagttggcggtgcagagcaagctccactccaagaagtgcatggaggagtacatcgaggagctgggctacctcgactag

SEQ ID NO: 2301 - DNA, 1335 bp, Unknown
  Bacillus sp. multi
atgaagtaccagatcctctgccccatgaacgtggactggaccatcttcgagaagcacctccgcaacctgacctaccaggtgcggacgatctccaaccggaccatccagcagctctgggagttcgacgcgctctcgttcgactacttcaaggccatcggcacctaccccaccgtccaggatctctacggctgcacgcagaagaagatcgacggctacatctaccacaccctccagagcaagtacccggacatccacaaggggaacatgagcaccaccctccagaagattatcaagacctggaagtcccgccgcaacgagatccgcaagggcgagatgtccatcccgtccttccgcaaccgcatccccatcgacctccacaacaactccgtggacatcaagaaggagaagaacggggactacatcgcggggatctccctcttcctccgcgacttccacaaggagaactcggacgtgccgaagggcaaaatcttcgtgaagctggcgaccaagaagcagaagtccatgaagatcatcctcgaccggctgatgaaccagacgtacagcaagggcgcgtgcatgatccacaagtacaagaacaagtggtacttgtcgatcacctacaagttcaacgcgatcaaggagaacaacttcgacaaggaactaatcatgggcatcgacatgggcgggatcaacaccgtgtacttcgccttcaacgagggcttcatccgctcgaacatcaagtccgacgagatcaaggcgttcaacgagaagatccgccagcgccgcatcaacctgctcaagcagagcaactactgctcgaactcccggacgggcaagggccgcgcgaagcgcctccagcccatcgacgtgctgagcaacaagatcgccaagttccgcaacagcaccaaccacaagtacgccaactacatcatcaagcagtgcctcaagcacaactgcgggcgcatccagatcgagctgttgaaggggatctccaagaacgacaaggtgctcaaggactggacctacttcgacctccaggagaagatcaagaaccaggccgaggtgcacggcatcgaggtcatcaaggtggcgtccgcctacaccagccagcgctgctcccagtgcgggtacatctgcaaggagaaccggtgcacccaggccgtcttcgagtgcaagcagtgcggctacaagacccacgcggactacaacgcggccaagaacatcgccacgtacgacatcgagaacatcatcaacaagcagttagcggtccagagcaagctccacagcaagaagtgcatggaggagtacatcgaggagctgggctacctggactag

SEQ ID NO: 2302 - DNA, 1335 bp, Unknown
  Bacillus sp. multi
atgaagtaccagatcctctgcccgatgaacgtggactggaccatcttcgagaagcacctccggaacctgacgtaccaggttcggacgatcagcaaccgcaccatccagcagctctgggagttcgacgcgctctccttcgactacttcaaggccatcggcacctaccccaccgtccaggacctgtacgggtgcacgcagaagaaaatcgacggctacatctaccacaccctccagtcgaagtacccggacatccacaaggggaacatgagcacgaccctccagaaaatcatcaagacctggaagtcccgccggaacgagatccgcaagggcgagatgtcgatcccgtccttccggaaccgcatccccatcgacctccacaacaactccgtggacatcaagaaggagaagaacggcgactacatcgcggggatcagcctgttcctccgcgacttccacaaggagaacagcgacgtgccgaagggcaagatcttcgtcaagctcgccaccaagaagcagaagtcgatgaagatcatcctcgaccgcctcatgaaccagacctactcgaagggcgcgtgcatgatccacaagtacaagaacaagtggtacttgtccatcacctacaagttcaacgccatcaaggagaacaacttcgacaaggagttgattatggggatcgacatgggcgggatcaacaccgtgtacttcgccttcaacgaggggttcatccggtccaacatcaagtcggacgagatcaaggcgttcaacgagaaaatccgccagcggcgcatcaacctcctcaagcagtccaactactgctcgaactcccgcacgggcaagggccgcgccaagcgcctccagcccatcgacgtcctgtcgaacaagatcgccaagttccgcaactccaccaaccacaagtacgcgaactacatcatcaagcagtgcctcaagcacaactgcgggcgcatccagatcgagctgctcaaggggatcagcaagaacgacaaggtgctcaaggactggacgtacttcgacctccaggagaaaatcaagaaccaggccgaggtccacggcatcgaggtcatcaaggtggcgtccgcctacacctcgcagcggtgctcccagtgcgggtacatctgcaaggagaaccgctgcacccaggccgtcttcgagtgcaagcagtgcgggtacaagacgcacgccgactacaacgccgccaagaacatcgccacctacgacatcgagaacatcatcaacaagcaactcgccgtccagagcaagctccacagcaagaagtgcatggaggagtacatcgaggagctgggctacctggactga

SEQ ID NO: 2303 - DNA, 1335 bp, Unknown
  Bacillus sp. multi
atgaagtaccagatcctctgccccatgaacgtggactggaccatcttcgagaagcacctccggaacctgacgtaccaggtgcggacgatctcgaaccgcaccatccagcagctctgggagttcgacgcgctctcgttcgactacttcaaggccatcggcacgtacccgaccgtccaagacctctacggctgcacccagaagaaaattgacgggtacatctaccacaccctccagagcaagtaccccgacatccacaagggcaacatgagcaccacgctccagaaaatcatcaagacctggaagtcccgccgcaacgagatccggaagggcgagatgtccatcccgtccttccgcaaccgcatccccatcgacctgcacaacaactccgtggacatcaagaaggagaagaatggggactacatcgcgggcatcagcctgttcctgcgcgacttccacaaggagaacagcgacgtcccgaagggcaagatcttcgtgaagctcgccaccaagaagcagaagtccatgaagatcatcctcgaccgcctcatgaaccagacgtacagcaagggcgcgtgcatgatccacaagtacaagaacaagtggtacctgtcgatcacctacaagttcaacgcgatcaaggagaacaacttcgacaaggagctgataatgggcatcgacatgggcgggatcaacaccgtgtacttcgccttcaacgaggggttcatccggagcaacatcaagtcggacgagatcaaggcgttcaacgagaaaatccgccagcgccgcatcaacctcctcaagcagtccaactactgctcgaactcgcgcaccggcaagggccgggcgaagcgcctccagcccatcgacgtgctctcgaacaagatcgccaagttccgcaactccaccaaccacaagtacgcgaactacatcatcaagcagtgcctcaagcacaactgcgggcgcatccagatcgagctactgaaggggatctccaagaacgacaaggtgctcaaggactggacgtacttcgacctccaggagaagatcaagaaccaggccgaggtccacggcatcgaggtcatcaaggtggcgagcgcctacacgagccagcgctgctcgcagtgcggctacatctgcaaggagaaccggtgcacccaggcggtcttcgagtgcaagcagtgcggctacaagacccacgcggactacaacgcggccaagaacatcgccacgtacgacatcgagaacatcatcaacaagcaactggcggtgcagtccaagctccacagcaagaagtgcatggaggagtacatcgaggagctgggctacctggactga

SEQ ID NO: 2304 - DNA, 1335 bp, Unknown
  Bacillus sp. multi
atgaagtaccagatcctctgcccgatgaacgtggactggacgatcttcgagaagcacctccgcaacctgacctaccaagtgcggacgatctccaaccgcaccatccagcagctctgggagttcgacgcgctgtccttcgactacttcaaggccatcggcacctacccgacggtccaagacctgtacgggtgcacgcagaagaagatcgacggctacatctaccacacgctccagagcaagtaccccgacatccacaagggcaacatgagcaccacgctccagaaaatcatcaagacctggaagtcccgccgcaacgagatccgcaagggcgagatgagcatcccgtccttccgcaaccgcatccccatcgacctccacaacaactcggtggacatcaagaaggagaagaatggcgactacatcgcgggcatcagcctgttcctgcgcgacttccacaaggagaactccgacgtcccgaagggcaagatattcgtgaagctcgccaccaagaaacagaagtccatgaagatcatcctcgaccgcctgatgaaccagacctactcgaagggcgcgtgcatgatccacaagtacaagaacaagtggtatctgagcatcacctacaagttcaacgccatcaaggagaacaacttcgacaaggaactgatcatgggcatcgacatgggcggcatcaacacggtgtacttcgccttcaacgaggggttcatccgctccaacatcaagtcggacgagatcaaggcgttcaacgagaagatccggcagcgccggatcaacctgctcaagcagtcgaactactgctccaactcgcgcaccgggaagggccgcgccaagcgcctccagcccatcgacgtgctgtccaacaagatcgccaagttccgcaacagcaccaaccacaagtacgcgaactacatcatcaagcagtgcctcaagcacaactgcgggcgcatccagatcgagctgctgaaggggatcagcaagaacgacaaggtgctcaaggactggacctacttcgacctccaggagaagatcaagaaccaggcggaggtgcacgggatcgaggtcatcaaggtggccagcgcctacacgagccagcggtgcagccagtgcggctacatctgcaaggagaaccgctgcacccaggccgtgttcgagtgcaagcagtgcgggtacaagacccacgcggactacaacgcggccaagaacatcgccacgtacgacatcgagaacatcatcaacaagcaactcgcggtccagagcaagctccactccaagaagtgcatggaggagtacatcgaggagctgggctacctcgactag

SEQ ID NO: 2305 - DNA, 1335 bp, Unknown
  Bacillus sp. multi
atgaagtaccagatcctctgccccatgaacgtggactggacgatcttcgagaagcacctccggaacctcacctaccaggttcggacgatctccaaccgcacgatccagcagctctgggagttcgacgccctgtcgttcgactacttcaaggccatcggcacctacccgaccgtccaagacctctacggctgcacgcagaagaagattgacggctacatctaccacatcctccagtcgaagtacccggacatccacaaggggaacatgagcaccaccctccagaaaatcatcaagacctggaagtcccggcgcaacgagatccgcaagggcgagatgagcatcccgtccttccgcaaccgcatccccatcgacctccacaacaacagcgtggacatcaagaaggagaagaacggggactacatcgcgggcatcagcctcttcagccgcgacttccacaaggagaacagcgacgtcccgaagggcaagatcttcgtcaagctggcgaccaagaagcagaagtccatgaagatcatcctcgaccgcctcatgaaccagacgtactcgaagggcgcgtgcatgatccacaagtacaagaacaagtggtatctgtccatcacctacaagttcaacgcgatcaaggagaacaacttcgacaaggagctgatcatgggcatcgacatgggcggcatcaacaccgtgtacttcgccttcaacgagggcttcatccggagcaacatcaagagcgacgagatcaaggcgttcaacgagaaaatccgccagcgccgcatcaacctcctcaagcagtccaactactgctcgaactcgcgcacggggaagggccgggccaagcagctccagcccatcgacgtcctctcgaacaagatcgccaagttccgcaacagcacgaaccacaagtacgcgaactacatcatcaagcagtgcctcaagcacaactgcgggcgcatccagatcgagctgctcaaggggatcagcaagaacgacaaggtgctcaaggactggacctacttcgacctccaggagaagatcaagaaccaggccgaggtgcacggcatcgaggtcatcaaggtggcctccgcctacaccagccagcggtgctcccagtgcggctacatctgcaaggagaaccgctgcacccaggcggtgttcgagtgcaagcagtgcggctacaagacccacgccgactacaacgccgccaagaacatcgccacctacgacatcgagaacatcatcaacaagcagttggcggtccagagcaagctccacagcaagaagtgcatggaggagtacatcgaggagctgggctacctggactag

SEQ ID NO: 2306 - DNA, 1335 bp, Unknown
  Bacillus sp. multi
atgaagtaccagatcctctgccccatgaacgtggactggaccatcttcgagaagcacctccgcaacctgacctaccaggtgcggacgatctccaaccgcaccatccagcagctctgggagttcgacgccctgagcttcgactacttcaaggccatcggcacctacccgaccgtccaagacctgtacgggtgcacgcagaagaagatcgacgggtacatctaccacatcctccagtcgaagtaccccgacatccacaaggggaacatgagcaccacgctccagaagatcatcaagacctggaagtcccgccgcaacgagatccggaagggcgagatgagcatccccagcttccggaaccgcatccccatcgacctccacaacaactcggtggacatcaagaaggagaagaacggggactacatcgcgggcatcagcctgttcagccgcgacttccacaaggagaactcggacgtgccgaagggcaagatattcgttaagctcgccaccaagaagcagaagtccatgaagatcatcctggaccgcctgatgaaccagacctacagcaagggcgcgtgcatgatccacaagtacaagaacaagtggtatctctccatcacctacaagttcaacgccatcaaggagaacaacttcgacaaggagttaatcatgggcatcgacatgggcggcatcaacaccgtgtacttcgccttcaacgagggcttcatccgctcgaacatcaagtcggacgagatcaaggcgttcaacgagaagatccgccagcgccgcatcaacctcctcaagcagagcaactactgctccaactcccggacgggcaagggccgggccaagcagctccagcccatcgacgtgctctccaacaagatcgccaagttccgcaacagcacgaaccacaagtacgcgaactacatcatcaagcagtgcctcaagcacaactgcgggcgcatccagatcgagcttctcaaggggatcagcaagaacgacaaggtgctcaaggactggacctacttcgacctccaggagaagatcaagaaccaggccgaggtccacggcatcgaggtcatcaaggtggcctccgcctacacgagccagcgctgctcccagtgcgggtacatctgcaaggagaaccggtgcacccaggcggtgttcgagtgcaagcagtgcggctacaagacccacgccgactacaacgcggccaagaacatcgccacctacgacatcgagaacatcatcaacaagcagctcgcggtgcagtccaagctccacagcaagaagtgcatggaggagtacatcgaggagctgggctacctcgactag

SEQ ID NO: 2307 - DNA, 1335 bp, Unknown
  Bacillus sp. multi
atgaagtaccagatcctctgcccgatgaacgtggactggacgatcttcgagaagcacctccgcaacctgacctaccaggtgcggacgatctccaaccggaccatccagcagctctgggagttcgacgccctgtccttcgactacttcaaggccatcggcacctaccccacggtccaggacttgtacggctgcacgcagaagaagattgacggctacatctaccacatcctccagtcgaagtacccggacatccacaaggggaacatgagcacgaccctccagaagatcatcaagacctggaagtcccgccggaacgagatccgcaagggcgagatgtccatcccgtccttccggaaccgcatccccatcgacctgcacaacaactccgtggacatcaagaaggagaagaacggggactacatcgcgggcatcagcctcttcagccgcgacttccacaaggagaacagcgacgtcccgaagggcaagatattcgtgaagctggcgaccaagaagcagaagtccatgaagatcatcctggaccgcctgatgaaccagacgtacagcaagggcgcgtgcatgatccacaagtacaagaacaagtggtatctctccatcacctacaagttcaacgccatcaaggagaacaacttcgacaaggagctaatcatgggcatcgacatgggcggcatcaacaccgtgtacttcgccttcaacgagggcttcatccggagcaacatcaagagcgacgagatcaaggcgttcaacgagaagatccgccagcggcggatcaacctcctcaagcagtcgaactactgctccaactcgcgcaccggcaagggccgcgccaagcagctccagcccatcgacgtcctgagcaacaagatcgccaagttccgcaactccaccaaccacaagtacgccaactacatcatcaagcagtgcctcaagcacaactgcgggcgcatccagatcgagctgctcaaggggatctccaagaacgacaaggtgctcaaggactggacgtacttcgacctccaggagaagattaagaaccaggccgaggtccacgggatcgaggtcatcaaggtcgccagcgcctacacgagccagcggtgctcccagtgcgggtacatctgcaaggagaaccggtgcacccaggccgtcttcgagtgcaagcagtgcgggtacaagacgcacgccgactacaacgccgccaagaacatcgccacctacgacatcgagaacatcatcaacaagcagttggcggtgcagtcgaagctgcactccaagaagtgcatggaggagtacatcgaggagctgggctacctggactag

SEQ ID NO: 2308 - DNA, 1335 bp, Unknown
  Bacillus sp. multi
atgaagtaccagatcctctgccccatgaacgtggactggaccatcttcgagaagcacctccgcaacctcacgtaccaagtccggacgatctccaaccggaccatccagcagctctgggagttcgacgcgctctcgttcgactacttcaaggccatcggcacctaccccacggtccaggacttgtacggctgcacccagaagaagatcgacgggtacatctaccacatcctccagagcaagtaccccgacatccacaaggggaacatgagcaccaccctccagaaaatcatcaagacctggaagtcccgccggaacgagatccggaagggcgagatgagcatcccgagcttccgcaaccgcatccccatcgacctccacaacaacagcgtggacatcaagaaggagaagaacggggactacatcgcgggcatctcgctcttcagccgcgacttccacaaggagaacagcgacgtgccgaagggcaagatattcgtgaagctggcgaccaagaagcagaagtccatgaagatcatcctcgaccgcctgatgaaccagacctacagcaagggcgcgtgcatgatccacaagtacaagaacaagtggtacctgagcatcacctacaagttcaacgccatcaaggagaacaacttcgacaaggagctaatcatggggatcgacatgggcggcatcaacaccgtgtacttcgccttcaacgaggggttcatccggagcaacatcaagtccgacgagatcaaggcgttcaacgagaagattcgccagcgccggatcaacctcctcaagcagtccaactactgctccaactcgcgcacgggcaagggccgcgccaagcagctccagcccatcgacgtcctcagcaacaagatcgccaagttccgcaacagcaccaaccacaagtacgcgaactacatcatcaagcagtgcctcaagcacaactgcgggcgcatccagatcgagctcctcaaggggatctccaagaacgacaaggtgctcaaggactggacctacttcgacctccaggagaagatcaagaaccaggccgaggtccacgggatcgaggtcatcaaggtggccagcgcctacacctcccagcggtgcagccagtgcggctacatctgcaaggagaaccggtgcacccaggccgtcttcgagtgcaagcagtgcggctacaagacccacgcggactacaacgcggccaagaacatcgccacctacgacatcgagaacatcatcaacaagcagcttgccgtgcagagcaagctccacagcaagaagtgcatggaggagtacatcgaggagctgggctacctcgactga

SEQ ID NO: 2309 - DNA, 1335 bp, Unknown
  Bacillus sp. multi
atgaagtaccagatcctctgcccgatgaacgtggactggaccatcttcgagaagcacctccgcaacctgacctaccaagtgcggacgatctcgaaccgcacgatccagcagctctgggagttcgacgccctctcgttcgactacttcaaggccatcgggacgtacccgaccgtccaggacttgtacggctgcacccagaagaagatcgacggctacatctaccacatcctccagtcgaagtaccccgacatccacaaggggaacatgagcacgaccctccagaaaatcatcaagacctggaagtcccggcgcaacgagatccgcaagggcgagatgtccatcccgtccttccgcaaccgcatccccatcgacctccacaacaacagcgtggacatcaagaaggagaagaacggcgactacatcgcgggcatcagcctgttctcccgcgacttccacaaggagaactccgacgtcccgaagggcaaaatcttcgtgaagctggccaccaagaagcagaagtccatgaagatcatcctggaccgcctcatgaaccagacctacagcaagggcgcgtgcatgatccacaagtacaagaacaagtggtacctcagcatcacctacaagttcaacgcgatcaaggagaacaacttcgacaaggagctgatcatgggcatcgacatgggcgggatcaacaccgtgtacttcgccttcaacgagggcttcatccggtccaacatcaagtccgacgagatcaaggcgttcaacgagaagatacggcagcggcgcatcaacctcctcaagcagtcgaactactgctccaactcccgcaccggcaaggggcgggccaagcagctccagcccatcgacgtcctgagcaacaagatcgccaagttccgcaacagcaccaaccacaagtacgccaactacatcatcaagcagtgcctcaagcacaactgcgggcgcatccagatcgaactgctcaaggggatctccaagaacgacaaggtgctcaaggactggacgtacttcgacctccaggagaagatcaagaatcaggccgaggtccacgggatcgaggtcatcaaggtcgccagcgcctacaccagccagcgctgctcccagtgcggctacatctgcaaggagaaccgctgcacccaggccgtgttcgagtgcaagcagtgcggctacaagacccacgcggactacaacgcggccaagaacatcgccacctacgacatcgagaacatcatcaacaagcagctcgcggtgcagtccaagctccacagcaagaagtgcatggaggagtacatcgaggagctgggctacctcgactag

SEQ ID NO: 2310 - DNA, 1314 bp, Unknown
  Bacillus sp. multi
ctgggcgtcaccatcaagatcatgaagtaccagatcctctgcccgctgaacgtggactggaccatcttcgagaagcacctccgcaacctcacctaccaagtgcggacgatctccaaccgcaccatccagcagctctgggagttcgacgccctgtcgttcgactacttcaaggagcgcggcacctaccccacggtccaggacttgtacggctgcacccagaagaaaatcgacggctacatctaccacaccctccagtcgaagtacccggacatccacaagggcaacatgagcaccaccctccagaaaatcatcaagacctggaagtcccgccgcaacgagatccgcaagggcgagatgagcatcccctccttccgcaaccgcatccccatcgacctccacaacaactccgtggacatcacgaaggagaaaaatggcgactacatcgcggggatctccctgttcagccgcgacttccacaaggagaacgacgacgtgccgaagggcaagatattcgtgaagctggccacccagaagcagaagtccatgaaggtcatcctggaccggctcatcaaccagacctactcgaagggcgcgtgcatgatccacaagtacaagaacaagtggtatctgtccatcacctacaagttcaacgccatcaaggagaacaagttcgacaaggagcttatcatgggcatcgacctcggcgggatcaacacggtgtactccgcgttcaacgagggcttcatccggagcaacatcaagtccgacgagatcatccgccagcgccggatcaacctcctcaagcagtccaagtattgttccaactcccgcaccggcaaggggcgcaccaagcggctccagcccatcgacgtgctcagcaacaagatcgccaagttccgcaactccacgaaccacaagtacgccaactacatcgtcaagcagtgcctcaagcacaactgcgggcgcatccagatggagctgctcaagggcatctccaagaacgaccgcatcctcaaggactggacctacttcgacctccaggagaagatcaaaaaccaggccgagatccacgggatcgaggtcatcaaggtcgccccggcctacacctcccagcggtgctcccagtgcggctacatctgcaaggagaaccgctgcacccaggccacgttcgagtgcaagcagtgcgggtacaagacccacgccgactacaacgcggccaagaacatctccacctacgacatcgagaacatcatcaacaagcagctcgccgtgcagagcaagctgcacagcaagaacgtctggaagtccatctga

SEQ ID NO: 2311 - DNA, 1314 bp, Unknown
  Bacillus sp. multi
ctgggcgtcacgatcaagatcatgaagtaccagatcctgtgcccgctcaacgtggactggacgatcttcgagaagcacctccggaacctcacctaccaagtccggacgatctcgaaccgcaccatccagcagctctgggagttcgacgcgctgtccttcgactacttcaaggagcgcggcacgtacccgaccgtccaagacctttacggctgcacgcagaagaaaatcgacgggtacatctaccacacgctccagagcaagtacccggacatccacaagggcaacatgagcaccacgctccagaaaatcatcaagacctggaagtcccggcgcaacgagatccgcaagggcgagatgtccatcccctccttccgcaaccgcatccccatcgacctccacaacaactccgtggacatcacgaaggagaagaacggcgactacatcgcggggatcagcctgttctcgcgcgacttccacaaggagaacgacgacgtgccgaagggcaagatattcgtgaagctggccacccagaagcagaagtccatgaaggtcatcctggaccggctcatcaaccagacgtacagcaagggcgcgtgcatgatccacaagtacaagaacaagtggtacttgtccatcacctacaagttcaacgcgatcaaggagaacaagttcgacaaggagcttatcatgggcatcgacctgggcgggatcaacaccgtgtacagcgccttcaacgagggcttcatccgctccaacatcaagtccgacgagatcatccggcagcggcggatcaacctgctcaagcagtccaaatattgttccaactcgcgcacgggcaaggggcggacgaagcgcctccagcccatcgacgtcctgtcgaacaagatcgccaagttccgcaactccaccaaccacaagtacgccaactacatcgtcaagcagtgcctcaagcacaactgcgggcgcatccagatggagctgctcaaggggatcagcaagaacgaccgcatcctcaaggactggacgtacttcgacctccaggaaaaaatcaagaatcaggcggagatccacggcatcgaggtcatcaaggtcgcgcccgcctacacctcccagcggtgctcgcagtgcgggtacatctgcaaggagaaccggtgcacccaggcgacgttcgagtgcaagcagtgcgggtacaagacgcacgccgactacaacgcggccaagaacatctccacctacgacatcgagaacatcatcaacaagcagctcgccgtgcagtcgaagctgcactccaagaacgtctggaagtcgatctga

SEQ ID NO: 2312 - DNA, 1314 bp, Unknown
  Bacillus sp. multi
ctcggcgtgacgatcaagatcatgaagtaccagatcctgtgcccgctcaacgtggactggaccatcttcgagaagcacctccggaacctgacctaccaagtccggacgatctccaaccgcaccatccagcagctctgggagttcgacgcgctcagcttcgactacttcaaggagcggggcacctaccccaccgtccaagatttgtacggctgcacccagaagaagatcgacggctacatctaccacaccctccagagcaagtacccggacatccacaaggggaacatgagcaccaccctccagaaaatcatcaagacttggaaatcccggcgcaacgagatccgcaagggcgagatgtcgatcccctccttccgcaaccgcatccccatcgacctccacaacaacagcgtggacatcacgaaggagaaaaatggggactacatcgcgggcatcagcctgttcagccgggacttccacaaggagaacgacgacgtgccgaagggcaaaatcttcgtcaagctggccacccagaagcagaagtccatgaaggtcatcctggaccggctcatcaaccagacgtactcgaagggcgcgtgcatgatccacaagtacaagaacaagtggtatctgtcgatcacctacaagttcaacgccatcaaggagaacaagttcgacaaggaactaattatggggatcgacctcggcggcatcaacacggtgtactccgcgttcaacgaggggttcatccgcagcaacatcaagtccgacgagatcatccgccagcgccgcatcaacctgctcaagcagagcaagtattgctcgaactcgcgcacgggcaaggggcggaccaagcggctccagcccatcgacgtcctgtccaacaagatcgccaagttccgcaactccaccaaccacaagtacgccaactacatcgtgaagcagtgcctcaagcacaactgcgggcgcatccagatggagctgctcaagggcatcagcaagaacgaccgcatcctcaaggactggacctacttcgacctccaggagaagataaagaaccaggccgagatccacggcatcgaggtcatcaaggtggccccggcctacacctcgcagcggtgctcgcagtgcggctacatctgcaaggagaaccggtgcacccaggcgacgttcgagtgcaagcagtgcggctacaagacccacgcggactacaacgcggccaagaacatctcgacgtacgacatcgagaacatcatcaacaagcagctcgccgtccagtcgaagctgcactccaagaacgtctggaagtccatctag

SEQ ID NO: 2313 - DNA, 1314 bp, Unknown
  Bacillus sp. multi
ctcggcgtgaccatcaagatcatgaagtaccagatcctctgcccgctcaacgtggactggacgatcttcgagaagcacctccggaacctgacctaccaagtccggacgatctccaaccgcacgatccagcagctctgggagttcgacgcgctctcgttcgactacttcaaggagcgcggcacgtacccgaccgtccaagacctgtacggctgcacgcagaagaaaattgacggctacatctaccacacgctccagagcaagtaccccgacatccacaagggcaacatgagcaccacgctccagaaaatcatcaagacctggaagtcccgccgcaacgagatccgcaagggcgagatgtcgatcccgtcgttccgcaaccgcatccccatcgacctccacaacaacagcgtggacatcacgaaggagaagaacggggactacatcgcggggatcagcctgttctcccgcgacttccacaaggagaacgacgacgtgccgaagggcaagatattcgtcaaactggcgacccagaagcagaagtccatgaaggtgatcctggaccggctcatcaaccagacctacagcaagggcgcgtgcatgatccacaagtacaagaacaagtggtacttgtccatcacctacaagttcaacgccatcaaggagaacaagttcgacaaggagttgataatgggcatcgacctcggcggcatcaacaccgtgtactcggccttcaacgaggggttcatccggtcgaacatcaagagcgacgagatcatccggcagcggcgcatcaacctcctcaagcagagcaaatattgttccaactcccgcacggggaaggggcggacgaagcgcctccagcccatcgacgtcctctcgaacaagatcgccaagttccgcaactccacgaaccacaagtacgccaactacatcgtcaagcagtgcctcaagcacaactgcgggcgcatccagatggagctgctcaaggggatcagcaagaacgaccgcatcctcaaggactggacctacttcgacctccaggagaagattaagaatcaggcggagatccacgggatcgaggtcatcaaggtggccccggcctacacctcccagcgctgctcccagtgcgggtacatctgcaaggagaaccggtgcacccaggccacgttcgagtgcaagcagtgcgggtacaagacgcacgccgactacaacgccgccaagaacatcagcacctacgacatcgagaacatcatcaacaagcagctcgccgtccagagcaagctccacagcaagaacgtctggaagtcgatctga

SEQ ID NO: 2314 - DNA, 1314 bp, Unknown
  Bacillus sp. multi
ctcggcgtgaccatcaagatcatgaagtaccagatcctctgcccgctgaacgtggactggaccatcttcgagaagcacctccgcaacctcacgtaccaagtgcggacgatctcgaaccggaccatccagcagctctgggagttcgacgccctgtccttcgactacttcaaggagcggggcacctaccccaccgtccaagatctctacgggtgcacgcagaagaaaattgacggctacatctaccacaccctccagagcaagtaccccgacatccacaagggcaacatgagcaccaccctccagaagataattaagacatggaagtcccgccgcaacgagatccggaagggcgagatgagcatcccgagcttccggaaccgcatccccatcgacctgcacaacaactcggtggacatcacgaaggagaagaatggcgactacatcgcggggatctccctgttcagccgcgacttccacaaggagaacgacgacgtgccgaagggcaagatattcgtcaagctggccacccagaagcagaagtccatgaaggtgatcctggaccgcctcatcaaccagacctacagcaagggcgcgtgcatgatccacaagtacaagaacaagtggtatctgagcatcacctacaagttcaacgccatcaaggagaacaagttcgacaaggagttgataatggggatcgacctgggcgggatcaacaccgtgtactccgcgttcaacgagggcttcatccgcagcaacatcaagtccgacgagatcatccgccagcggcggatcaacctcctcaagcagtccaagtattgttccaacagccggacgggcaagggccgcaccaagcgcctccagcccatcgacgtcctgtccaacaagatcgccaagttccgcaacagcacgaaccacaagtacgcgaactacatcgtgaagcagtgcctcaagcacaactgcgggcgcatccagatggagctgctcaagggcatcagcaagaacgaccgcatcctcaaggactggacctacttcgacctccaggaaaagatcaagaaccaggcggagatccacggcatcgaggtcatcaaggtggccccggcctacaccagccagcgctgctcgcagtgcgggtacatctgcaaggagaaccggtgcacccaggcgacgttcgagtgcaagcagtgcgggtacaagacccacgcggactacaacgcggccaagaacatctcgacgtacgacatcgagaacatcatcaacaagcagctcgcggtccagagcaagctccactccaagaacgtctggaagtcgatctag

SEQ ID NO: 2315 - DNA, 1347 bp, Unknown
  Bacillus sp. multi
atgaagtaccagatcctctgcccgatgaacgtggactggaccatcttcgagaagcacctccgcaacctgacctaccaagtccggacgatcagcaaccgcaccatccagcagctctgggagttcgacgccctctccttcgactacttcaaggccatcggcacgtacccgacggtccaagacctctacggctgcacgcagaagaaaatcgacggctacatctaccacacgctccagagcaagtaccccgacatccacaaggggaacatgagcaccaccctccagaaaatcatcaagacctggaagtcccgccggaacgagatccgcaagggcgagatgtcgatcccgagcttccgcaaccgcatccccatcgacctgcacaacaactccgtggacatcaagaaggagaagaacggcgactacatcgcggggatcagcctcttcagccgcgacttccacaaggagaactcggacgtgccgaagggcaagatcttcgtgaagctggccaccaagaagcagaagtccatgaagatcatcctcgaccgcctcatgaaccagacctacagcaagggcgcgtgcatgatccacaagtacaagaacaagtggtacctttccatcacctacaagttcaacgccatcaaggagaacaacttcgacaaggagctcatcatgggcatcgacatgggcggcatcaacaccgtgtacttcgcgttcaacgagggcttcatccggtccaacatcaagtccgacgagatcaaggcgttcaacgagaaaatccgccagcggcgcatcaacctgctcaagcagagcaactactgctccaactcgcgcaccgggaaggggcgggccaagcgcctccagcccatcgacgtgctgtcgaacaagatcgccaagttccgcaacagcaccaaccacaagtacgcgaactacatcatcaagcagtgcctcaagcacaactgcgggcgcatccagatcgagctcctcaaggggatcagcaagaacgacaaggtgctcaaggactggacctacttcgacctccaggagaaaatcaagaatcaggccgaggtgcacgggatcgaggtcatcaaggtggcctccgcctacacctcccagcggtgctcccagtgcggctacatctgcaaggagaaccgctgcacccaggccgtgttcgagtgcaagcagtgcgggtacaagacccacgccgactacaacgccgccaagaacatcgccacgtacgacatcgagaacatcatcaacaagcagctcgccgtgcagagcaagctccactccaagaagtgcatggaggagtacatcgaggagtacatcgaggagctgggctacctcgactag

SEQ ID NO: 2316 - DNA, 1347 bp, Unknown
  Bacillus sp. multi
atgaagtaccagatcctctgccccatgaacgtggactggacgatcttcgagaagcacctccggaacctgacgtaccaggtgcggacgatctccaaccggacgatccagcagctctgggagttcgacgcgctctccttcgactacttcaaggccatcggcacgtaccccacggtccaggacttgtacggctgcacccagaagaagatagacggctacatctaccacaccctccagagcaagtaccccgacatccacaaggggaacatgagcaccaccctccagaaaatcatcaagacctggaagtcccggcgcaacgagatccgcaagggcgagatgtcgatcccgagcttccggaaccgcatccccatcgacctccacaacaacagcgtggacatcaagaaggagaagaatggcgactacatcgcgggcatctcgctgttcagccgcgacttccacaaggagaactccgacgtgccgaagggcaagatattcgtgaagctcgccaccaagaagcagaagtccatgaagatcatcctggaccgcctcatgaaccagacctactcgaagggcgcgtgcatgatccacaagtacaagaacaagtggtatctgtccatcacgtacaagttcaacgccatcaaggagaacaacttcgacaaggagctgataatgggcatcgacatgggcggcatcaacaccgtgtacttcgcgttcaacgagggcttcatccgctccaacatcaagtccgacgagatcaaggcgttcaacgagaagatccggcagcggcggatcaacctcctcaagcagagcaactactgctccaactcgcggacgggcaagggccgggccaagcgcctccagcccatcgacgtcctgagcaacaagatcgccaagttccgcaactccaccaaccacaagtacgccaactacatcatcaagcagtgcctcaagcacaactgcgggcgcatccagatcgagctactcaaggggatctccaagaacgacaaggtgctcaaggactggacgtacttcgacctccaggagaagatcaagaaccaggcggaggtgcacggcatcgaggtcatcaaggtggcgagcgcctacacctcccagcggtgctcccagtgcggctacatctgcaaggagaaccgctgcacccaggcggtcttcgagtgcaagcagtgcggctacaagacgcacgcggactacaacgccgccaagaacatcgccacgtacgacatcgagaacatcatcaacaagcagctcgccgtccagagcaagctccactccaagaagtgcatggaggagtacatcgaggagtacatcgaggagctgggctacctggactga

SEQ ID NO: 2317 - DNA, 1347 bp, Unknown
  Bacillus sp. multi
atgaagtaccagatcctctgccccatgaacgtggactggaccatcttcgagaagcacctccgcaacctgacctaccaggtccggacgatctccaaccgcacgatccagcagctctgggagttcgacgccctctcgttcgactacttcaaggccatcggcacgtacccgaccgtccaggatctctacggctgcacgcagaagaagatcgacgggtacatctaccacaccctccagagcaagtacccggacatccacaaggggaacatgagcaccacgctccagaagatcatcaagacctggaagtcccgccgcaacgagatccggaagggcgagatgagcatcccctccttccgcaaccgcatccccatcgacctgcacaacaactccgtggacatcaagaaggagaagaacggcgactacatcgccgggatctccctgttcagccgcgacttccacaaggagaactccgacgtgccgaagggcaagatattcgtgaagctggcgaccaagaaacagaagtcgatgaagatcatcctggaccggctcatgaaccagacgtactcgaagggcgcgtgcatgatccacaagtacaagaacaagtggtatctctccatcacctacaagttcaacgcgatcaaggagaacaacttcgacaaggagcttatcatgggcatcgacatgggcggcatcaacaccgtgtacttcgcgttcaacgaggggttcatccgcagcaacatcaagtcggacgagatcaaggcgttcaacgagaaaatccgccagcgccgcatcaacctcctcaagcagtccaactactgctccaacagccgcacggggaaggggcgggcgaagcgcctccagcccatcgacgtcctgagcaacaagatcgccaagttccgcaacagcaccaaccacaagtacgccaactacatcatcaagcagtgcctcaagcacaactgcgggcgcatccagatcgagctgctcaaggggatcagcaagaacgacaaggtgctcaaggactggacctacttcgacctccaggaaaagatcaagaaccaggccgaggtccacgggatcgaggtcatcaaggtcgccagcgcctacaccagccagcggtgctcccagtgcggctacatctgcaaggagaaccgctgcacccaggcggtgttcgagtgcaagcagtgcggctacaagacccacgccgactacaacgccgccaagaacatcgccacgtacgacatcgagaacatcatcaacaagcaactcgcggtgcagagcaagctccactccaagaagtgcatggaggagtacatcgaggagtacatcgaggagctgggctacctggactag

SEQ ID NO: 2318 - DNA, 1347 bp, Unknown
  Bacillus sp. multi
atgaagtaccagatcctctgccccatgaacgtggactggacgatcttcgagaagcacctccgcaacctcacctaccaagtgcggacgatctccaaccggacgatccagcagctctgggagttcgacgcgctgagcttcgactacttcaaggccatcggcacctacccgaccgtccaagacctgtacggctgcacccagaagaagatcgacgggtacatctaccacacgctccagtcgaagtaccccgacatccacaagggcaacatgagcacgacgctccagaaaatcattaagacctggaagtcccgccgcaacgagatccggaagggcgagatgtcgatcccgagcttccggaaccgcatccccatcgacctgcacaacaactccgtggacatcaagaaggagaagaacggcgactacatcgcggggatcagcctcttcagccgcgacttccacaaggagaacagcgacgtcccgaagggcaagatattcgtgaagctggcgaccaagaagcagaagtccatgaagatcatcctcgaccggctgatgaaccagacctactcgaagggcgcgtgcatgatccacaagtacaagaacaagtggtatctctccatcacctacaagttcaacgccatcaaggagaacaacttcgacaaggagctaatcatgggcatcgacatgggcgggatcaacaccgtgtacttcgcgttcaacgaggggttcatccgctccaacatcaagagcgacgagatcaaggcgttcaacgagaagatccgccagcgccgcatcaacctcctcaagcagtcgaactactgctccaactcccgcaccggcaagggccgggcgaagcgcctccagcccatcgacgtcctctccaacaagatcgccaagttccgcaacagcacgaaccacaagtacgcgaactacatcatcaagcagtgcctcaagcacaactgcgggcgcatccagatcgagttgctgaaggggatcagcaagaacgacaaggtgctcaaggactggacctacttcgacctccaggagaagatcaagaaccaggcggaggtgcacgggatcgaggtcatcaaggtggcctcggcctacaccagccagcggtgctcccagtgcgggtacatctgcaaggagaaccggtgcacccaggccgtgttcgagtgcaagcagtgcggctacaagacccacgcggactacaacgccgccaagaacatcgccacgtacgacatcgagaacatcatcaacaagcagctggccgtccagagcaagctccactccaagaagtgcatggaggagtacatcgaggagtacatcgaggagctgggctacctcgactag

SEQ ID NO: 2319 - DNA, 1347 bp, Unknown
  Bacillus sp. multi
atgaagtaccagatcctctgcccgatgaacgtggactggacgatcttcgagaagcacctccgcaacctgacctaccaagtgcggacgatctccaaccgcaccatccagcagctctgggagttcgacgccctctccttcgactacttcaaggccatcggcacgtaccccaccgtccaggatctctacggctgcacgcagaagaaaatcgacgggtacatctaccacacgctccagagcaagtaccccgacatccacaaggggaacatgagcaccaccctccagaagattatcaagacctggaagtcccgccgcaacgagatccgcaagggcgagatgagcatcccgagcttccgcaaccgcatccccatcgacctgcacaacaactccgtggacatcaagaaggagaagaacggcgactacatcgcggggatcagcctgttctcccgcgacttccacaaggagaactcggacgtcccgaagggcaagatcttcgtgaagctggcgaccaagaagcagaagtccatgaagatcatcctggaccggctcatgaaccagacctacagcaagggcgcgtgcatgatccacaagtacaagaacaagtggtacctgtctatcacctacaagttcaacgcgatcaaggagaacaacttcgacaaggagctaatcatggggatcgacatgggcggcatcaacaccgtgtacttcgccttcaacgaggggttcatccgctccaacatcaagtccgacgagatcaaggcgttcaacgagaaaatccgccagcgccggatcaacctgctcaagcagtccaactactgctccaactcccggacgggcaagggccgcgccaagcgcctccagcccatcgacgtcctgagcaacaagatcgccaagttccgcaacagcaccaaccacaagtacgccaactacatcatcaagcagtgcctcaagcacaactgcgggcgcatccagatcgagcttctgaaggggatcagcaagaacgacaaggtgctcaaggactggacctacttcgacctccaggagaagatcaagaaccaggccgaggtccacggcatcgaggtcatcaaggtggcgtcggcctacaccagccagcggtgctcccagtgcgggtacatctgcaaggagaaccggtgcacccaggccgtgttcgagtgcaagcagtgcggctacaagacgcacgccgactacaacgccgccaagaacatcgccacgtacgacatcgagaacatcatcaacaagcagctcgccgtccagagcaagctccacagcaagaagtgcatggaggagtacatcgaggagtacatcgaggagctgggctacctcgactga

SEQ ID NO: 2320 - DNA, 1191 bp, Unknown
  Bacillus sp. multi
atgctgtacccgctgacgaccctcaagaaggaagggcacaccctcctcagcaagatttgcatgggcgtgcaccggcgcaagctcatggcgatctaccacaccctccagagcaagtaccccgacatccacaaggggaacatgagcacgacgctccagaagattatcaagacatggaaatctcgccgcaacgagatccgcaagggcgagatgtcgatcccgtccttccggaaccgcatccccatcgacctgcacaacaactccgtggacatcacgaaggagaagaacggggactacatcgccgggatcagcctcttcctccgcgactttcacaaggagaacgacgacgtgccgaagggcaaaatcttcgtcaagctcgccacccagaagcagaagtccatgaaggtgatcctggaccgcctcatcaaccagacctacagcaagggcgcgtgcatgatccacaagtacaagaacaagtggtatctgagcatcacctacaagttcaacgccatcaaggagaacaagttcgacaaggagcttatcatgggcatcgacctgggcggcatcaacaccgtgtacttcgccttcaacgagggcttcatccgctcgaacatcaagtccgacgagatcatccgccagcgccgcatcaacctgctcaagcagagcaaatactgttccaactcccgcaccgggaagggccgcaccaagcgcctccagcccatcgacgtgctgtccaacaagatcgccaagttccgcaacagcaccaaccacaagtacgcgaactacatcgtcaagcagtgcctcaagcacaactgcgggcgcatccagatggagctgctcaagggcatctccaagaacgaccgcatcctcaaggactggacgtacttcgacctccaggaaaagattaagaaccaggccgagatccacggcatcgaggtcatcaaggtcgcgcccgcctacaccagccagcgctgctcccagtgcgggtacatctgcaaggagaaccgctgcacccaggccacgttcgagtgcaagcagtgcggctacaagacccacgcggactacaacgccgccaagaacatctccacgtacgacatcgagaacatcatcaacaagcagctcgccgtgcagagcaagctgcactccaagaagtgcatggaggagtacatcgagaagctcggctacctggactag

SEQ ID NO: 2321 - DNA, 1191 bp, Unknown
  Bacillus sp. multi
atgctctacccgctcacgacgctcaagaaggaagggcacaccctgctctccaaaatctgcatgggcgtccaccgccgcaagctcatggcgatctaccacaccctccagtccaagtaccccgacatccacaagggcaacatgagcaccaccctccagaagattattaaaacctggaagtcccgccgcaacgagatccgcaagggcgagatgtccatcccgtccttccggaaccgcatccccatcgacctgcacaacaactccgtggacatcacgaaggagaagaacggcgactacatcgccgggatcagcctgttcctccgcgacttccacaaggagaacgacgacgtgccgaagggcaagatattcgtgaagctcgccacgcagaagcagaagtcgatgaaggtcatcctcgaccggctcatcaaccagacctacagcaagggcgcgtgcatgatccacaagtacaagaacaagtggtatctcagcatcacctacaagttcaacgcgatcaaggagaacaagttcgacaaggaactgattatgggcatcgacctcggcgggatcaacacggtgtacttcgcgttcaacgaggggttcatccggtccaacatcaagtccgacgagatcatccggcagcggcggatcaacctgctcaagcagtccaagtattgttccaacagccggacggggaaggggcgcaccaagcgcctccagcccatcgacgtcctgagcaacaagatcgccaagttccgcaactccaccaaccacaagtacgcgaactacatcgtcaagcagtgcctcaagcacaactgcgggcgcatccagatggagctgctcaaggggatcagcaagaacgaccgcatcctcaaggactggacctacttcgacctccaggagaaaattaagaaccaggccgagatccacggcatcgaggtcatcaaggtcgcgcccgcctacaccagccagcggtgcagccagtgcggctacatctgcaaggagaaccgctgcacccaggcgacgttcgagtgcaagcagtgcggctacaagacccacgccgactacaacgcggccaagaacatctcgacctacgacatcgagaacatcatcaacaagcagctcgccgtccagagcaagctgcacagcaagaaatgcatggaggagtacatcgagaagctgggctacctggactga

SEQ ID NO: 2322 - DNA, 1191 bp, Unknown
  Bacillus sp. multi
atgctctacccgctgaccacgctcaagaaggaaggccacaccctcctgagcaaaatatgtatgggcgtccaccggcgcaagctcatggcgatctaccacacgctccagagcaagtaccccgacatccacaaggggaacatgagcacgacgctccagaaaatcatcaagacctggaagtcccgccgcaacgagatccgcaagggcgagatgagcatcccgagcttccgcaaccgcatccccatcgacctccacaacaacagcgtggacatcacgaaggagaagaatggcgactacatcgccgggatctcgctgttcctccgcgacttccacaaggagaacgacgacgtgccgaagggcaagatattcgtcaagctggccacgcagaagcagaagtccatgaaggtgatcctggaccgcctcatcaaccagacgtactcgaagggcgcgtgcatgatccacaagtacaagaacaagtggtatctcagcatcacctacaagttcaacgccatcaaggagaacaagttcgacaaggagcttattatggggatcgacctgggcggcatcaacaccgtgtacttcgccttcaacgagggcttcatccggagcaacatcaagagcgacgagatcatccgccagcgccggatcaacctgctcaagcagagcaaatactgctcgaactcgcgcacgggcaagggccgcaccaagcgcctccagcccatcgacgtgctcagcaacaagatcgccaagttccgcaactccacgaaccacaagtacgcgaactacatcgtcaagcagtgcctcaagcacaactgcgggcgcatccagatggagctgctcaaggggatcagcaagaacgaccgcatcctcaaggactggacgtacttcgacctccaggaaaagattaagaatcaggcggagatccacggcatcgaggtcatcaaggtggccccggcctacacctcccagcgctgctcccagtgcggctacatctgcaaggagaaccgctgcacccaggcgacgttcgagtgcaagcagtgcggctacaagacgcacgcggactacaacgcggccaagaacatcagcacctacgacatcgagaacatcatcaacaagcagctcgcggtgcagagcaagctgcactccaagaagtgcatggaggagtacatcgagaagctcggctacctggactga

SEQ ID NO: 2323 - DNA, 1191 bp, Unknown
  Bacillus sp. multi
atgctctacccgctgaccacgctcaagaaagagggtcacacgctgctcagcaaaatctgcatgggcgtccaccgccgcaagctcatggccatctaccacaccctccagagcaagtaccccgacatccacaagggcaacatgagcacgaccctccagaagattattaagacctggaaatcccgccgcaacgagatccggaagggcgagatgtcgatcccgagcttccgcaaccgcatccccatcgacctgcacaacaacagcgtggacatcacgaaggagaagaatggggactacatcgcgggcatcagcctgttcctgcgcgacttccacaaggagaacgacgacgtgccgaagggcaaaatcttcgtcaagctcgccacgcagaagcagaagtccatgaaggtgatcctcgaccgcctcatcaaccagacgtactcgaagggcgcgtgcatgatccacaagtacaagaacaagtggtatttgagcatcacctacaagttcaacgcgatcaaggagaacaagttcgacaaggagctgataatgggcatcgacctgggcggcatcaacacggtgtacttcgcgttcaacgaggggttcatccgcagcaacatcaagagcgacgagatcatccgccagcgccgcatcaacctgctcaagcagtccaagtattgctccaactcccggacgggcaagggccggacgaagcggctccagcccatcgacgtcctgtccaacaagatcgccaagttccgcaacagcaccaaccacaagtacgccaactacatcgtcaagcagtgcctcaagcacaactgcgggcgcatccagatggagctgctcaaggggatctccaagaacgaccgcatcctcaaggactggacctacttcgacctccaggagaagattaagaaccaggccgagatccacggcatcgaggtcatcaaggtcgccccggcctacacctcccagcgctgctcgcagtgcggctacatctgcaaggagaaccggtgcacccaggccacgttcgagtgcaagcagtgcggctacaagacccacgcggactacaacgcggccaagaacatctcgacgtacgacatcgagaacatcatcaacaagcagctcgccgtccagagcaagctccacagcaagaaatgcatggaggagtacatcgagaagctgggctacctcgactga

SEQ ID NO: 2324 - DNA, 1191 bp, Unknown
  Bacillus sp. multi
atgctctacccgctgacgacgctcaagaaggaggggcacaccctcctgagcaagatttgcatgggcgtccaccggcgcaagctcatggccatctaccacacgctccagtcgaagtacccggacatccacaaggggaacatgagcaccacgctccagaaaatcatcaagacctggaagtcgcgccggaacgagatccggaagggcgagatgtccatcccgagcttccgcaaccgcatccccatcgacctgcacaacaactcggtggacatcacgaaggaaaagaacggcgactacatcgccgggatcagcctgttcctccgggacttccacaaggagaacgacgacgtgccgaagggcaagatattcgtcaagctcgccacccagaagcagaagtcgatgaaggtgatcctggaccgcctcatcaaccagacctacagcaagggcgcgtgcatgatccacaagtacaagaacaagtggtatctcagtattacctacaagttcaacgcgatcaaggagaacaagttcgacaaggagttgataatgggcatcgacctcggcgggatcaacacggtgtacttcgccttcaacgagggcttcatccgctcgaacatcaagtcggacgagatcatccggcagcgccgcatcaacctgctcaagcagtccaaatattgttccaactcccgcacgggcaagggccggaccaagcgcctccagcccatcgacgtcctctccaacaagatcgccaagttccgcaactccaccaaccacaagtacgccaactacatcgtcaagcagtgcctcaagcacaactgcgggcgcatccagatggagctgctcaaggggatctccaagaacgaccgcatcctcaaggactggacctacttcgacctccaggagaaaatcaagaaccaggccgagatccacgggatcgaggtcatcaaggtcgccccggcctacacgagccagcgctgctcccagtgcgggtacatctgcaaggagaaccggtgcacccaggcgacgttcgagtgcaagcagtgcggctacaagacgcacgccgactacaacgccgccaagaacatcagcacgtacgacatcgagaacatcatcaacaagcagctcgccgtgcagtcgaagctccactccaagaaatgcatggaggagtacatcgagaagctgggctacctggactag

SEQ ID NO: 2325 - DNA, 1353 bp, Unknown
  Bacillus sp. multi
ctctcgacggtggtcaaggtgatgaagtaccagatcgtctgcccggtcaacatcgagtggaaggtgttcgagacgtacctgcggaccctcacctaccaagttcgaaccatcggcaaccgcaccatccagaagctctgggagttcgacaaccagagcctcaaccacttcaaggagaacggcgtgtacccctccacccagcagctctacgggtgcacgcagaagactatcagcggctacatctacgaccagctcaagttcgagtacctggacatcaacaaggccaacatgagcacgaccctccagaaaaccatcaagacgtggaacagccgcaagaaggaaatctggagcggcgagatgagcatcccctcgttccgcaacaacctccccatcgacatccacggcaactccatccagctcacgaaggagaagtccggcgactacatcgccaacctgtccctgttctcctcctccttcatccgcgagaacgagctgtcctccggcaagatcctcgtcaagctgtccacgcgcaagcagaacagcatgaaggtcatcctggaccgcctgatcgacggcacctacgcgaagggcgcgtccatgctccacaagtacaagaacaagtggtacttgagcgtgacctacaaggccaacgccatcgaggagtccaagttcgacgaggacttcatcatgggcatcgacatgggcaaggtgaacgtgctgtacttcgccttcaacaaggggttcatccggggctccatctccggggaggagatcgaggcgttccgcaagaagattgagcaccggcgcatctccctcctgcgccagggcaagtattgctccgagaaccgcatcggcaagggccgcaagaagcgcatcaagccggtggacgtgctcaacgacaaggtggcgcgcttccgcaactcgaccaaccacaagtacgccaactacatcgtccagcagtgcctcaagtacaagtgcggctgcatacaactcgagaatctccaggggatctcgaaggagcagaccttcctcaagaactggacgtacttcgacctccaggagaagatcgagaatcaggcgaaccagtacgggatcaaggtcgtgaagatcgccccgagctacaccagccagcgctgctcggagtgcggctacatccacaagaacaaccgccaggaccagagcaccttcgagtgccagcagtgcaacctcaaggtccacgcggactacaacgcggccaagaacatcagcatctacaacatcgagaagctgatccagaagcagctcaagctccaggagaagctgaacagcaagaagtatacggagcagtacaaggagcagatcgagaacatcacctga

SEQ ID NO: 2326 - DNA, 1353 bp, Unknown
  Bacillus sp. multi
ctctccaccgtggtcaaggtgatgaagtaccagatcgtgtgccccgtcaacatcgagtggaaggtcttcgagacgtacctccggaccctgacctaccaagtccggaccatcgggaaccgcaccatccagaagctctgggagttcgacaaccagtccctcaaccacttcaaggagaacggcgtgtacccctcgacgcagcagctctacggctgcacccagaaaactatcagcggctacatctacgaccagctcaagttcgagtacctggacatcaacaaggccaacatgagcaccaccctccagaaaaccatcaagacctggaactcccgcaagaaggaaatatggagcggggagatgtccatcccctccttccggaacaacctgcccatcgacatccacgggaacagcatccagctcacgaaggagaagtccggcgactacatcgccaacctgagcctcttcagctcctcgttcatccgggagaacgagctgtcgtccggcaagatcctggtgaagctcagcacccggaagcagaactccatgaaggtgatcctcgaccgcctcatcgacggcacctacgcgaagggcgcgtccatgctgcacaagtacaagaacaagtggtatctgagcgtcacctacaaggcgaacgccatcgaggagtccaagttcgacgaggacttcatcatggggatcgacatggggaaggtcaacgtgctgtacttcgcgttcaacaagggcttcatccggggcagcatctccggggaggagatcgaggcgttccgcaagaaaatcgagcaccggcggatcagcctcctgcgccagggcaaatactgttccgagaaccgcatcgggaagggccgcaagaagcgcatcaagccggtggacgtcctcaacgacaaggtggcgcgcttccggaactccaccaaccacaagtacgcgaactacatcgtccagcagtgcctcaagtacaagtgcgggtgcattcaactcgagaacctccaggggatctcgaaggagcagaccttcctcaagaactggacgtacttcgacctccaggagaaaatcgagaaccaggccaaccagtacgggatcaaggtggtcaagatcgcgccgagctacacctcccagcgctgctcggagtgcgggtacatccacaagaacaaccgccaggaccagtccaccttcgagtgccagcagtgcaacctcaaggtgcacgccgactacaacgcggccaagaacatctccatctacaacatcgagaagctcatccagaagcagctcaagctccaggagaagctgaactccaagaaatacaccgagcagtacaaggagcagatcgagaacatcacctga

SEQ ID NO: 2327 - DNA, 1353 bp, Unknown
  Bacillus sp. multi
ctgagcaccgtcgtgaaggtgatgaagtaccagatcgtgtgcccggtgaacatcgagtggaaggtcttcgagacctacctccgcaccctcacctaccaagtgcgtaccataggcaatcgcaccatccagaagctctgggagttcgacaaccagtccctgaaccacttcaaggagaacggggtgtacccgtccacccagcagctctacggctgcacccagaaaacgatcagcggctacatctacgaccagctcaagttcgagtacctggacatcaacaaggcgaacatgagcacgaccctccagaagacaatcaagacctggaactcccgcaagaaggagatttggagcggcgagatgagcatcccctcgttccgcaacaacctccccatcgacatccacggcaacagcatccagctcacgaaggagaagtccggggactacatcgccaacctgtcgctgttcagctcgtccttcatccgggagaacgagctgtcctccgggaagatcctcgtgaagctgagcacccgcaagcagaactccatgaaggtgatcctggaccggctgatcgacggcacgtacgcgaagggcgcgtccatgctgcacaagtacaagaacaagtggtacttgagcgtgacgtacaaggcgaacgccatcgaggagtccaagttcgacgaggacttcatcatgggcatcgacatgggcaaggtcaacgtgctctacttcgccttcaacaaggggttcatccggggctccatcagcggcgaggagatcgaggcgttccgcaagaagattgagcaccggcggatcagcctcctccgccagggcaaatactgctcggagaaccggatcgggaaggggcgcaagaaacgcatcaagcccgtggacgtgctcaacgacaaggtggcgcggttccgcaactccacgaaccacaagtacgccaactacatcgtccagcagtgcctcaagtacaagtgcggctgcatccagttggaaaacctccagggcatcagcaaggagcagaccttcctcaagaactggacgtacttcgacctccaggagaaaatcgagaaccaggccaaccagtacgggatcaaggtcgtgaagatcgcgccgtcctacacctcccagcgctgctccgagtgcggctacatccacaagaacaaccgccaggaccagagcacgttcgagtgccagcagtgcaacctcaaggtgcacgccgactacaacgcggccaagaacatctccatctacaacatcgagaagctgatccagaagcagctcaagctccaggagaagctgaactccaagaagtacaccgagcagtacaaggagcagatcgagaacatcacctag

SEQ ID NO: 2328 - DNA, 1353 bp, Unknown
  Bacillus sp. multi
ctgtccacggtggtgaaggtcatgaagtaccagatcgtgtgccccgtcaacatcgagtggaaggtcttcgagacctacctccgcaccctcacctaccaagttcgcaccatcgggaaccgcaccatccagaagctgtgggagttcgacaaccagagcctgaaccacttcaaggagaacggggtgtacccctccacccagcagctctacggctgcacgcagaagacaatcagcggctacatctacgaccagctcaagttcgagtacctggacatcaacaaggcgaacatgagcacgaccctccaaaagaccatcaagacgtggaactcccgcaagaaggagatatggagcggcgagatgtccatcccgtccttccgcaacaacctgcccatcgacatccacggcaacagcatccagctcacgaaggagaagtccggcgactacatcgccaacctgagcctgttctcctcctcgttcatccgcgagaacgagctgagcagcggcaagatcctggtcaagctgtccacccggaagcagaacagcatgaaggtgatcctcgaccggctgatcgacgggacgtacgcgaagggcgcgtcgatgctccacaagtacaagaacaagtggtaccttagcgtcacctacaaggccaacgccatcgaggagtccaagttcgacgaggacttcatcatggggatcgacatgggcaaggtcaacgtcctctacttcgccttcaacaagggcttcatccggggctccatctccggggaggagatcgaggcgttccgcaagaagatcgagcaccgccggatctcgctcctccgccagggcaaatactgttcggagaaccggatcggcaaggggcgcaagaagcgcatcaagcccgtggacgtgctcaacgacaaggtggcgcgcttccgcaacagcaccaaccacaagtacgccaactacatcgtgcagcagtgcctcaagtacaagtgcggctgcatacagcttgagaatctccagggcatcagcaaggagcagacgttcctcaagaactggacgtacttcgacctccaggagaagattgagaaccaggcgaaccagtacgggatcaaggtggtcaagatcgcgccgagctacacctcccagcgctgctccgagtgcggctacatccacaagaacaaccgccaggaccagtccaccttcgagtgccagcagtgcaacctcaaggtgcacgcggactacaacgccgccaagaacatcagcatctacaacatcgagaagctgatccagaagcagctcaagctccaggagaagctgaactccaagaaatacacagagcagtacaaggagcagatcgagaacatcacgtga

SEQ ID NO: 2329 - DNA, 1353 bp, Unknown
  Bacillus sp. multi
ctcagcacggtcgtgaaggtgatgaagtaccagatcgtgtgccccgtgaacatcgagtggaaggtgttcgagacgtacctgcggaccctcacgtaccaagttcgcaccatcgggaaccggacgatccagaagctctgggagttcgacaaccagagcctgaaccacttcaaggagaacggcgtgtaccccagcacccagcagctctacggctgcacccagaaaacaatcagcggctacatctacgaccagctcaagttcgagtacctcgacatcaacaaggccaacatgagcaccaccctccagaaaaccatcaagacgtggaacagccgcaagaaggagatctggagcggggagatgagcatccccagcttccgcaacaacctccccatcgacatccacggcaactcgatccagctcacgaaggagaagtccggcgactacatcgccaacctctccctgttcagctccagcttcatccgcgagaacgagctgtcgtcggggaagatcctcgtgaagctcagcacccggaagcagaactcgatgaaggtcatcctggaccggctcatcgacggcacctacgcgaagggcgcgtccatgctgcacaagtacaagaacaagtggtatctcagcgtcacctacaaggccaacgccatcgaggagagcaagttcgacgaggacttcatcatgggcatcgacatgggcaaggtgaacgtgctctacttcgcgttcaacaagggcttcatccggggcagcatcagcggcgaggagatcgaggcgttccgcaagaagattgagcaccgccgcatctcgctgctgcgccagggcaaatactgttccgagaaccggatcgggaaggggcgcaagaaacgcatcaagccggtggacgtcctcaacgacaaggtggcccgcttccgcaacagcacgaaccacaagtacgccaactacatcgtgcagcagtgcctcaagtacaagtgcgggtgcattcaattggagaacctccagggcatcagcaaggagcagacgttcctcaagaactggacctacttcgacctccaggagaagattgagaaccaggcgaaccagtacggcatcaaggtggtcaagatcgcgccgagctacaccagccagcgctgctcggagtgcggctacatccacaagaacaaccgccaggaccagtccaccttcgagtgccagcagtgcaacctcaaggtgcacgccgactacaacgcggccaagaacatctccatctacaacatcgagaagctgatccagaagcagctcaagctccaggagaagctgaactccaagaagtacacggagcagtacaaggagcagatcgagaacatcacctga

SEQ ID NO: 2330 - DNA, 1332 bp, Unknown
  Bacillus sp. multi
atgaagtaccagatcgtgtgcccggtcaacatcgagtggaagaccttcgagatctacctgcggaccctctcctaccacttccggaccatcggcaaccggacgatccagaagctgtgggagtacgacaaccagtcgctcaagcacttcaaggacaccgggcagtacccgtccgcccagcagctctacggctgcacccagaagacgatctccggctacatctacgaccagctcaaggaggagtaccaggacatcaacaaggcgaacatgagcacgaccctccagaagaccatccgcacgtggaactcccgcaagaaggaaatctggagcggcgagatgagcatccccagcttccggaacaacctccccatcgacatccacgggaactccatccagatcatcaaggagaagtccggcgactacatcgcgtccgtgtccctgttctcgtccaagttcatcaacgagaacgacctgccgaacgggaagatcctggtcaagctgtccacccggaagcagaactcgatgaaggtgatcctcgaccgcatcatcgacagcacctacgcgaagggcgcgtgcatgctccacaagcacaagaagaaatggtacctgtccatcacctacaagtcgaacatcaaggaggagctaaagttcgacgaagacctaatcatgggcatcgacatggggaagatcaacgtcctgtacttcgccttcaacaaggggctcgtgcgcggcgcgatctccggcgaggagatcgaggcgttccgcaagaaaatcgagcaccggcgcatctcgctgctccgccagggcaagtactgctccgggaaccgcatcgggaagggccgggagaagcgcatcaagcccatcgacgtgctgaacgacaaggtggccaagttccgcaacgccaccaaccacaagtacgccaactacatcgtgcagcagtgcctcaagtacaactgcggcacgatccagctagaggacttgaaggggatcagcaaggagcagaccttcctcaagaactggacctacttcgacctccaggagaagatcaagaaccaggcgaaccagtacggcgtcaaggtggtcaagatcgccccgtcctacaccagccagcggtgctccgagtgcgggtacatccacaagaacaaccgccaggaccagtccacgttcgagtgccagcagtgcagcttcaaggtgcacgcggactacaacgcggccaagaacatcagcgtgtacaacatcgagaaggtgatccagaagcagctagagctacaggagaagctcaaccagacgaagtacaaggagcagtacatcgagcagatgaagaacatcaactga

SEQ ID NO: 2331 - DNA, 1332 bp, Unknown
  Bacillus sp. multi
atgaagtaccagatcgtgtgccccgtcaacatcgagtggaagaccttcgaaatctatctccggaccctcagctaccacttccgcaccatcgggaaccggacgatccagaagctctgggagtacgacaaccagtccctcaagcacttcaaggacaccgggcagtaccccagcgcccagcagctctacggctgcacgcagaagaccatcagcggctacatctacgaccagctcaaggaggagtaccaggacatcaacaaggccaacatgagcacgaccctccagaagaccatccgcacctggaactcgcgcaagaaggagatttggagcggcgagatgtccatcccctccttccgcaacaacctccccatcgacatccacgggaactcgatccagatcatcaaggagaagtccggggactacatcgccagcgtgagcctgttctcctcgaagttcatcaacgagaacgacctcccgaacgggaagatcctggtcaagctcagcacccggaagcagaactccatgaaggtcatcctggaccgcatcatcgactccacctacgcgaagggcgcgtgcatgctccacaagcacaagaagaagtggtacctcagtatcacctacaagtccaacatcaaggaggagttgaagttcgacgaggacttaatcatggggatcgacatggggaagatcaacgtcctgtacttcgccttcaacaaggggctcgtgcgcggcgcgatcagcggggaggagatcgaggcgttccgcaagaaaatcgagcaccggcggatctccctcctccgccagggcaagtactgctcgggcaaccgcatcggcaaggggcgggagaagcggatcaagcccatcgacgtgctcaacgacaaggtggcgaagttccgcaacgcgaccaaccacaagtacgcgaactacatcgtgcagcagtgcctcaagtacaactgcggcacgatccagctcgaggatctcaaggggatcagcaaggagcagacgttcctcaagaactggacctacttcgacctccaggagaagatcaagaaccaggcgaaccagtacggcgtcaaggtggtcaagatcgcgccgagctacacgagccagcggtgctccgagtgcggctacatccacaagaacaaccgccaggaccagagcaccttcgagtgccagcagtgctccttcaaggtgcacgcggactacaacgccgccaagaacatctcggtgtacaacatcgagaaggtgatccagaagcagcttgagctccaggagaagctgaaccagaccaagtacaaggagcagtacatcgagcagatgaagaacatcaactga

SEQ ID NO: 2332 - DNA, 1332 bp, Unknown
  Bacillus sp. multi
atgaagtaccagatcgtgtgcccggtcaacatcgagtggaagacgttcgaaatctacctccggacgctctcctaccacttccggaccatcgggaaccggacgatccagaagctctgggagtacgacaaccagagcctcaagcacttcaaggacacggggcagtacccctcggcgcagcagctctacggctgcacgcagaagaccatctccgggtacatctacgaccagctcaaggaggagtaccaggacatcaacaaggcgaacatgagcacgaccctccagaaaaccatccgcacctggaacagccgcaagaaggagatctggagcggggagatgagcatcccctccttccgcaacaacctccccatcgacatccacgggaactccatccagatcatcaaggagaagtcgggcgactacatcgcgtcggtcagcctgttctcctcgaagttcatcaacgagaacgacctccccaacggcaagatcctggtgaagctctcgacgcgcaagcagaacagcatgaaggtgatcctcgaccgcatcatcgactccacctacgcgaagggcgcgtgcatgctgcacaagcacaagaagaagtggtacctatccatcacctacaagagcaacatcaaggaggagctgaagttcgacgaggatctcatcatgggcatcgacatgggcaagatcaacgtcctctacttcgccttcaacaagggcctcgtgcgcggggcgatctcgggcgaggagatcgaggcgttccgcaagaagatcgagcaccggcggatctccctcctccgccaggggaagtactgctcgggcaaccgcatcggcaagggccgggagaagcggatcaagcccatcgacgtgctgaacgacaaggtggccaagttccgcaacgccacgaaccacaagtacgcgaactacatcgtccagcagtgcctcaagtacaactgcggcacgatccagctcgaagacttgaaggggatcagcaaggagcagacgttcctcaagaactggacgtacttcgacctccaggagaagattaagaaccaggccaaccagtacggggtgaaggtggtgaagatcgccccgagctacaccagccagcgctgctcggagtgcgggtacatccacaagaacaaccgccaggaccagtccacgttcgagtgccagcagtgctcgttcaaggtgcacgccgactacaacgcggccaagaacatcagcgtgtacaacatcgagaaggtcatccagaagcagcttgagttgcaggagaagctgaaccagaccaagtacaaggagcagtacatcgagcagatgaagaatatcaactga

SEQ ID NO: 2333 - DNA, 1332 bp, Unknown
  Bacillus sp. multi
atgaagtaccagatcgtctgcccggtgaacatcgagtggaagaccttcgaaatctacctgcggaccctctcctaccacttccgcaccatcgggaaccgcaccatccagaagctgtgggagtacgacaaccagtcgctcaagcacttcaaggacaccggccagtacccgtcggcgcagcagctctacggctgcacccagaagacgatcagcgggtacatctacgaccagctcaaggaggagtaccaggacatcaacaaggccaacatgagcaccaccctccagaagaccatccggacctggaactcccgcaagaaggaaatctggagcggggagatgtccatccccagcttccggaacaacctgcccatcgacatccacggcaacagcatccagatcatcaaggagaagtccggcgactacatcgcgtccgtgtcgctcttcagcagcaagttcatcaacgagaacgacctgccgaacggcaagatcctggtcaagctctccacgcgcaagcagaactccatgaaggtgatcctggaccggatcatcgactcgacctacgcgaagggcgcgtgcatgctccacaagcacaagaagaagtggtacctctccatcacctacaagtcgaacatcaaggaggagcttaagttcgacgaggacctaatcatggggatcgacatgggcaagatcaacgtcctctacttcgcgttcaacaaggggctggtgcgcggcgcgatctccggggaggagatcgaggcgttccgcaagaagatcgagcaccggcggatctcgctgctgcgccagggcaagtactgctcgggcaaccgcatcgggaagggccgcgagaagcgcatcaagcccatcgacgtgctcaacgacaaggtggccaagttccgcaacgcgacgaaccacaagtacgcgaactacatcgtccagcagtgcctcaagtacaactgcgggaccatccaactagaggacttgaaagggatcagcaaggagcagaccttcctcaagaactggacctacttcgacctccaggagaagatcaagaaccaggccaaccagtacggcgtcaaggtggtcaagatcgcgccctcctacacgagccagcggtgctccgagtgcggctacatccacaagaacaaccgccaggaccagtccaccttcgagtgccagcagtgcagcttcaaggtgcacgccgactacaacgcggccaagaacatctcggtgtacaacatcgagaaggtgatccagaagcagcttgaactccaggagaagctgaaccagaccaagtacaaggagcagtacatcgagcagatgaagaacatcaactga

SEQ ID NO: 2334 - DNA, 1332 bp, Unknown
  Bacillus sp. multi
atgaagtaccagatcgtgtgccccgtcaacatcgagtggaagaccttcgagatctacctccggaccctctcctaccacttccgcaccatcgggaaccgcacgatccagaagctctgggagtacgacaaccagtcgctcaagcacttcaaggacacgggccagtacccgagcgcgcagcagctctacggctgcacgcagaagaccatctcggggtacatctacgaccagctcaaggaggagtaccaggacatcaacaaggcgaacatgagcaccaccctccagaagacgatccggacgtggaactcgcgcaagaaggagatttggagcggcgagatgtccatcccgtcgttccgcaacaacctccccatcgacatccacggcaactcgatccagatcatcaaggagaagtcgggcgactacatcgccagcgtgtccctgttctcctcgaagttcatcaacgagaacgacctgcccaacgggaagatcctggtgaagctctcgacccgcaagcagaactccatgaaggtgatcctggaccgcatcatcgactccacctacgcgaagggcgcgtgcatgctccacaagcacaagaagaagtggtacctttccatcacctacaagagcaacatcaaggaggagctgaaattcgacgaggacctcatcatggggatcgacatgggcaagatcaacgtcctgtacttcgcgttcaacaaggggctcgtgcgcggcgcgatctccggcgaggagatcgaggcgttccgcaagaaaatcgagcaccggcgcatctccctcctccgccagggcaagtattgctccggcaaccggatcggcaaggggcgggagaagcggatcaagcccatcgacgtgctgaacgacaaggtggccaagttccgcaacgcgaccaaccacaagtacgcgaactacatcgtgcagcagtgcctcaagtacaactgcggcaccatccagttggaggatctgaaggggatctcgaaggagcagaccttcctcaagaactggacgtacttcgacctccaggagaagatcaagaaccaggcgaaccagtacggggtgaaggtggtcaagatcgcgccgagctacacgagccagcgctgctcggagtgcgggtacatccacaagaacaaccgccaggaccagagcaccttcgagtgccagcagtgcagcttcaaggtgcacgccgactacaacgccgccaagaacatcagcgtgtacaacatcgagaaggtcatccagaagcaactggagctacaggagaagctgaaccagacgaagtacaaggagcagtacatcgagcagatgaagaatatcaactga

SEQ ID NO: 2335 - DNA, 1362 bp, Unknown
  Bacillus sp. multi
gtgacgtacctctccatcgccgtcaaggtcatgaagtaccagatcgtgtgccccgtcaacatcgagtggaagaccttcgagatctacctccggacgctctcctaccacttccgcaccatcgggaaccggacgatccagaagctctgggagtacgacaaccagtccctcaagcacttcaaggacaccgggcagtacccctcggcgcagcagctctacggctgcacccagaagaccatctccggctacatctacgaccagctcaaggaggagtaccaggacatcaacaaggccaacatgagcacgaccctccagaagacgatccgcacgtggaactcccgcaagaaggagatatggagcggcgagatgagcatcccgtccttccgcaacaacctccccatcgacatccacggcaactccatccagatcatcaaggagaagtccggcgactacatcgcctcggtgtccctgttctccagcaagttcatcaacgagaacgacctcccgaacggcaagatcctggtcaagctgagcacgcggaagcagaacagcatgaaggtgatcctggaccgcatcatcgactccacctacgcgaagggcgcgtgtatgttacacaagcacaagaagaagtggtacttgagcatcacgtacaagtccaacatcaaggaggagctcaagttcgacgaggacctcatcatgggcatcgacatgggcaagatcaacgtcctctacttcgcgttcaacaagggcctggtgcgcggggccatcagcggggaggagatcgaggcgttccgcaagaagattgagcaccgccgcatcagcctcctgcgccaggggaaatactgctccggcaaccgcatcggcaagggccgcgagaagcgcatcaagcccatcgacgtcctgaacgacaaggtggccaagttccgcaacgcgaccaaccacaagtacgccaactacatcgtgcagcagtgcctcaagtacaactgcggcaccatccaactggaagacctcaaggggatcagcaaggagcagacgttcctcaagaactggacgtacttcgacctccaggagaagatcaagaaccaggcgaaccagtacggcgtcaaggtggtcaagatcgcgccgtcctacaccagccagcgctgctcggagtgcggctacatccacaagaacaaccgccaggaccagagcaccttcgagtgccagcagtgcagcttcaaggtgcacgccgactacaacgccgccaagaacatcagcgtgtacaacatcgagaaggtcatccagaagcagttggaactccaggagaagctgaaccagacgaagtacaaggagcagtacatcgagcagatgaagaacatcaactga

SEQ ID NO: 2336 - DNA, 1362 bp, Unknown
  Bacillus sp. multi
gtgacctacctctccatcgccgtcaaggtgatgaagtaccagatcgtgtgccccgtgaacatcgagtggaagaccttcgagatctacctccggaccctgagctaccacttccgcaccatcgggaaccggacgatccagaagctctgggagtacgacaaccagtccctcaagcacttcaaggacaccgggcagtaccccagcgcgcagcagctctacggctgcacccagaaaactatcagcgggtacatctacgaccagctcaaggaggagtaccaggacatcaacaaggcgaacatgagcacgaccctccagaaaaccatccgcacctggaacagccgcaagaaggagatatggagcggcgagatgtccatccccagcttccggaacaacctccccatcgacatccacggcaacagcatccagatcatcaaggagaagtcgggcgactacatcgcgtccgtcagcctcttcagcagcaagttcatcaacgagaacgacctcccgaacgggaagatcctggtcaagctctccacccggaagcagaactcgatgaaggtgatcctcgaccgcatcatcgactcgacctacgcgaagggcgcgtgcatgctccacaagcacaagaagaagtggtacctgtcgatcacctacaagagcaacatcaaggaggagctgaagttcgacgaggaccttatcatgggcatcgacatggggaagatcaacgtcctgtacttcgccttcaacaagggcctggtgcggggcgcgatctccggggaggagatcgaggcgttccgcaagaagattgagcaccgccgcatctccctgctgcgccaggggaaatactgctcgggcaaccgcatcgggaagggccgggagaagcgcatcaagcccatcgacgtgctcaacgacaaggtggccaagttccgcaacgcgaccaaccacaagtacgccaactacatcgtccagcagtgcctcaagtacaactgcggcacgatccagcttgaggatctgaaggggatcagcaaggagcagacgttcctcaagaactggacctacttcgacctccaggagaagatcaagaaccaggcgaaccagtacggcgtgaaggtcgtcaagatcgccccgtcctacacctcccagcgctgctcggagtgcgggtacatccacaagaacaaccgccaggaccagtccacgttcgagtgccagcagtgcagcttcaaggtccacgccgactacaacgccgccaagaacatctccgtgtacaacatcgagaaggtgatccagaagcagctagagctacaggagaagctgaaccagacgaagtacaaggagcagtacatcgagcagatgaagaacatcaactga

SEQ ID NO: 2337 - DNA, 1362 bp, Unknown
  Bacillus sp. multi
gtgacgtacctcagcatcgccgtcaaggtgatgaagtaccagatcgtgtgccccgtcaacatcgagtggaagaccttcgaaatctacctgcggacgctcagctaccacttccgcaccatcgggaaccggacgatccagaagctctgggagtacgacaaccagtccctcaagcacttcaaggacaccgggcagtaccccagcgcgcagcagctctacggctgcacccagaaaactatctccggctacatctacgaccagctcaaggaggagtaccaggacatcaacaaggccaacatgagcaccaccctccagaaaaccatccgcacctggaactcccgcaagaaggaaatctggagcggcgagatgagcatcccgtccttccggaacaacctccccatcgacatccacggcaactccatccagatcatcaaggagaagtcgggcgactacatcgccagcgtgagcctgttctcctccaagttcatcaacgagaacgacctccccaacggcaagatcctggtcaagctgtccacccggaagcagaactcgatgaaggtcatcctcgaccggatcatcgactcgacgtacgcgaagggcgcgtgtatgctccacaagcacaagaagaagtggtacctcagcatcacctacaagagcaacatcaaggaggagctcaagttcgacgaggacctcatcatggggatcgacatggggaagatcaacgtgctctacttcgcgttcaacaaggggctcgtgcggggcgcgatctccggcgaggagatcgaggcgttccgcaagaaaatcgagcaccggcggatctccctcctgcgccagggcaagtactgctcgggcaaccgcatcggcaagggccgcgagaagcgcatcaagcccatcgacgtgctcaacgacaaggtggcgaagttccgcaacgccaccaaccacaagtacgccaactacatcgtccagcagtgcctcaagtacaactgcggcaccatccagctcgaggacttgaaggggatcagcaaggagcagaccttcctcaagaactggacctacttcgacctccaggagaagattaagaaccaggcgaaccagtacggggtcaaggtggtcaagatcgcgccgagctacaccagccagcggtgcagcgagtgcggctacatccacaagaacaaccgccaggaccagtccaccttcgagtgccagcagtgctccttcaaggtgcacgcggactacaacgccgccaagaacatcagcgtgtacaacatcgagaaggtgatccagaagcagcttgagttgcaggagaagctgaaccagacgaagtacaaggagcagtacatcgagcagatgaagaacatcaactga

SEQ ID NO: 2338 - DNA, 1362 bp, Unknown
  Bacillus sp. multi
gtgacgtacctctccatcgcggtcaaggtgatgaagtaccagatcgtctgcccggtgaacatcgagtggaagacgttcgaaatctacctccggacgctgagctaccacttccgcaccatcgggaaccgcaccatccagaagctgtgggagtacgacaaccagtccctcaagcacttcaaggacacgggccagtacccctcggcccagcagctctacggctgcacccaaaagacgatcagcggctacatctacgaccagctcaaggaggagtaccaggacatcaacaaggcgaacatgagcaccaccctccagaaaaccatccggacgtggaactcgcgcaagaaggagatctggagcggcgagatgagcatcccctccttccgcaacaacctccccatcgacatccacggcaactcgatccagatcatcaaggagaagtccggcgactacatcgcgtccgtctccctgttctcgtccaagttcatcaacgagaacgacctccccaacggcaagatcctggtgaagctctccacccgcaagcagaacagcatgaaggtgatcctggaccgcatcatcgactcgacctacgcgaagggcgcgtgcatgttgcacaagcacaagaagaagtggtatctgtccatcacctacaagagcaacatcaaggaggagctgaagttcgacgaagacctcatcatggggatcgacatggggaagatcaacgtgctgtacttcgccttcaacaagggcctggtccggggcgcgatctcgggcgaggagatcgaggcgttccgcaagaaaatcgagcaccggcggatctccctgctgcgccagggcaagtactgctccggcaaccgcatcggcaaggggcgcgagaagcgcatcaagcccatcgacgtcctgaacgacaaggtggccaagttccgcaacgccaccaaccacaagtacgccaactacatcgtgcagcagtgcctcaagtacaactgcgggaccatccagctcgaagacctcaaggggatctcgaaggagcagacgttcctcaagaactggacctacttcgacctccaggagaagattaagaaccaggcgaaccagtacggcgtcaaggtggtgaagatcgcgccctcctacacctcccagcggtgctccgagtgcggctacatccacaagaacaaccgccaggaccagtccacgttcgagtgccagcagtgcagcttcaaggtccacgcggactacaacgccgccaagaacatcagcgtgtacaacatcgagaaggtcatccagaagcagttggaactccaggagaagctgaaccagaccaagtacaaggagcagtacatcgagcagatgaagaacatcaactga

SEQ ID NO: 2339 - DNA, 1362 bp, Unknown
  Bacillus sp. multi
gtgacctacctgtccatcgccgtcaaggtcatgaagtaccagatcgtgtgccccgtcaacatcgagtggaagacgttcgagatctacctgcggacgctctcgtaccacttccgcaccatcggcaaccgcacgatccagaagctgtgggagtacgacaaccagtccctcaagcacttcaaggacacggggcagtacccctccgcgcagcagctctacggctgcacccagaagaccatcagcggctacatctacgaccagctcaaggaggagtaccaggacatcaacaaggcgaacatgagcacgaccctccagaaaacaatccggacgtggaacagccgcaagaaggaaatctggagcggcgagatgtccatcccctccttccgcaacaacctccccatcgacatccacggcaacagcatccagatcatcaaggagaagtccggcgactacatcgccagcgtctccctgttctcctccaagttcatcaacgagaacgacctcccgaacggcaagatcctggtgaagctcagcacgcgcaagcagaacagcatgaaggtgatcctcgaccgcatcatcgacagcacgtacgcgaagggcgcgtgcatgctgcacaagcacaagaagaagtggtacctgagcatcacctacaagagcaacatcaaggaggagctaaagttcgacgaggacctcatcatgggcatcgacatggggaagatcaacgtcctgtacttcgcgttcaacaaggggctcgtgcgcggggccatcagcggcgaggagatcgaggcgttccgcaagaaaatcgagcaccggcgcatctcgctgctccgccagggcaagtactgctccgggaaccggatcggcaagggccgcgagaagcgcatcaagcccatcgacgtgctcaacgacaaggtggccaagttccgcaacgccaccaaccacaagtacgccaactacatcgtgcagcagtgcctcaagtacaactgcgggacgatccagcttgaagacctgaaggggatcagcaaggagcagacgttcctcaagaactggacctacttcgacctccaggagaagattaagaaccaggcgaaccagtacggcgtgaaggtcgtcaagatcgccccgagctacaccagccagcgctgctcggagtgcgggtacatccacaagaacaaccgccaggaccagagcaccttcgagtgccagcagtgctccttcaaggtgcacgcggactacaacgcggccaagaacatcagcgtgtacaacatcgagaaggtcatccagaagcaactggagttgcaggagaagctgaaccagaccaagtacaaggagcagtacatcgagcagatgaagaatatcaactga

SEQ ID NO: 2340 - DNA, 1353 bp, Unknown
  Bacillus sp. multi
ctgtccatcgccgtgaaggtcatgaagtaccagatcgtgtgcccggtgaacatcgagtggaagacgttcgagatctacctgcggaccctcagctaccacttccgcaccatcggcaaccggacgatccagaagctgtgggagtacgacaaccagagcctcaagcacttcaaggacaccggccagtacccctcggcgcagcagctctacggctgcacgcagaaaaccatctcggggtacatctacgaccagctcaaggaggagtaccaggacatcaacaaggccaacatgagcacgaccctccagaagactatccgcacgtggaactcccgcaagaaggagatctggagcggcgagatgagcatccccagcttccgcaacaacctgcccatcgacatccacgggaactccatccagatcatcaaggagaagtccggcgactacatcgcctccgtgtcgctcttcagcagcaagttcatcaacgagaacgacctccccaacggcaagatcctggtgaagctcagcacccggaagcagaactccatgaaggtgatcctcgaccgcatcatcgactcgacctacgcgaagggcgcgtgcatgctacacaagcacaagaagaagtggtatctgtccatcacctacaagtccaacatcaaggaggagcttaagttcgacgaggacttgataatgggcatcgacatggggaagatcaacgtgctgtacttcgccttcaacaagggcctggtgcggggcgcgatctccggcgaggagatcgaggcgttccgcaagaagatagagcaccggcgcatctccctcctgcgccaggggaagtactgctcgggcaaccgcatcggcaagggccgcgagaagcgcatcaagcccatcgacgtcctgaacgacaaggtggccaagttccgcaacgccaccaaccacaagtacgccaactacatcgtgcagcagtgcctcaagtacaactgcggcaccatacagctcgaggatctcaaagggatcagcaaggagcagaccttcctcaagaactggacgtacttcgacctccaggagaagatcaagaaccaggcgaaccagtacggcgtcaaggtcgtgaagatcgccccgtcctacacgagccagcggtgctccgagtgcggctacatccacaagaacaaccgccaggaccagagcaccttcgagtgccagcagtgctcgttcaaggtgcacgccgactacaacgccgccaagaacatcagcgtgtacaacatcgagaaggtcatccagaagcagctggagctgcaggagaagctgaaccagacgaagtacaaggagcagtacatcgagcagatgaagaacatcaactga

SEQ ID NO: 2341 - DNA, 1353 bp, Unknown
  Bacillus sp. multi
ctctccatcgccgtgaaggtgatgaagtaccagatcgtgtgcccggtcaacatcgagtggaagacgttcgaaatctacctgcggacgctcagctaccacttccgcaccatcggcaaccggaccatccagaagctctgggagtacgacaaccagtcgctcaagcacttcaaggacaccggccagtacccgagcgcccagcagctctacggctgcacccagaaaacgatctccggctacatctacgaccagctcaaggaggagtaccaggacatcaacaaggccaacatgagcaccaccctccaaaagacaatccgcacctggaacagccgcaagaaggagatctggagcggcgagatgagcatcccgtccttccggaacaacctgcccatcgacatccacggcaactccatccagatcatcaaggagaagtccggcgactacatcgcgtccgtgtccctgttcagcagcaagttcatcaacgagaacgacctccccaacgggaagatcctggtgaagctcagcacgcggaagcagaacagcatgaaggtcatcctggaccgcatcatcgacagcacctacgcgaagggcgcgtgcatgctccacaagcacaagaagaagtggtatctgtccatcacctacaagagcaacatcaaggaggagctaaagttcgacgaggacctcatcatggggatcgacatggggaagatcaacgtgctgtacttcgccttcaacaaggggctggtgcggggcgcgatcagcggcgaggagatcgaggcgttccgcaagaaaatagagcaccgccgcatcagcctcctgcgccagggcaaatactgctcggggaaccggatcggcaaggggcgggagaagcggatcaagcccatcgacgtcctgaacgacaaggtggcgaagttccgcaacgccaccaaccacaagtacgcgaactacatcgtccagcagtgcctcaagtacaactgcgggacgatccagttggaggacttgaaggggatctcgaaggagcagacgttcctcaagaactggacgtacttcgacctccaggagaagatcaagaaccaggcgaaccagtacggggtcaaggtcgtcaagatcgcgccgagctacaccagccagcgctgctccgagtgcgggtacatccacaagaacaaccgccaggaccagtccacgttcgagtgccagcagtgcagcttcaaggtgcacgccgactacaacgccgccaagaacatcagcgtgtacaacatcgagaaggtgatccagaagcagctggagctgcaggagaagctgaaccagaccaagtacaaggagcagtacatcgagcagatgaagaacatcaactga

SEQ ID NO: 2342 - DNA, 1353 bp, Unknown
  Bacillus sp. multi
ctctccatcgccgtgaaggtgatgaagtaccagatcgtgtgccccgtcaacatcgagtggaagaccttcgagatctacctccggaccctcagctaccacttccgcaccatcgggaaccgcacgatccagaagctctgggagtacgacaaccagtccctcaagcacttcaaggacaccggccagtacccctccgcgcagcagctctacggctgcacccagaagactatcagcggctacatctacgaccagctcaaggaggagtaccaggacatcaacaaggcgaacatgagcacgaccctccagaaaaccatccggacctggaacagccgcaagaaggagatctggagcggggagatgagcatcccgtccttccgcaacaacctgcccatcgacatccacggcaacagcatccagatcatcaaggagaagtccggcgactacatcgcgtccgtcagcctcttcagcagcaagttcatcaacgagaacgacctcccgaacggcaagatcctggtcaagctgtccacccgcaagcagaacagcatgaaggtcatcctcgaccgcatcatcgactccacgtacgcgaagggcgcgtgcatgctgcacaagcacaagaagaagtggtatctgagcatcacctacaagagcaacatcaaggaggagttgaagttcgacgaagacctgattatgggcatcgacatgggcaagatcaacgtgctctacttcgccttcaacaaggggctcgtgcgcggggcgatctccggcgaggagatcgaggcgttccgcaagaaaatcgagcaccggcggatcagcctgctccgccagggcaagtattgctccggcaaccgcatcggcaagggccgcgagaagcggatcaagcccatcgacgtgctgaacgacaaggtggccaagttccgcaacgccacgaaccacaagtacgcgaactacatcgtgcagcagtgcctcaagtacaactgcggcaccattcagctggaggacctcaaggggatctcgaaggagcagacgttcctcaagaactggacctacttcgacctccaggagaagatcaagaaccaggcgaaccagtacggcgtgaaggtggtcaagatcgcgccgagctacacgagccagcggtgctccgagtgcgggtacatccacaagaacaaccgccaggaccagagcacgttcgagtgccagcagtgcagcttcaaggtccacgccgactacaacgcggccaagaacatctcggtgtacaacatcgagaaggtgatccagaagcagcttgagctccaggagaagctgaaccagaccaagtacaaggagcagtacatcgagcagatgaagaatatcaactga

SEQ ID NO: 2343 - DNA, 1353 bp, Unknown
  Bacillus sp. multi
ctgtccatcgcggtcaaggtcatgaagtaccagatcgtgtgccccgtcaacatcgagtggaagacgttcgaaatctacctccggaccctctcctaccacttccggaccatcgggaaccggacgatccagaagctgtgggagtacgacaaccagtccctcaagcacttcaaggacacggggcagtacccgtccgcccagcagctctacggctgcacgcagaaaacgatctccggctacatctacgaccagctcaaggaggagtaccaggacatcaacaaggcgaacatgagcaccaccctccagaaaaccatccggacctggaactcccgcaagaaggagatctggagcggcgagatgagcatcccgtccttccgcaacaacctccccatcgacatccacggcaactccatccagatcatcaaggagaagtccggggactacatcgcgtccgtgtcgctgttcagctcgaagttcatcaacgagaacgacctcccgaacggcaagatcctggtgaagctcagcacgcgcaagcagaactccatgaaggtgatcctggaccgcatcatcgacagcacctacgcgaagggcgcgtgcatgctccacaagcacaagaagaagtggtacttgtccatcacctacaagagcaacatcaaggaggagttgaagttcgacgaggacctcatcatgggcatcgacatgggcaagatcaacgtgctgtacttcgccttcaacaagggcctggtgcgcggcgcgatctccggcgaggagatcgaggcgttccgcaagaagatcgagcaccgccgcatctcgctcctccgccagggcaaatactgctcgggcaaccgcatcggcaaggggcgcgagaagcgcatcaagcccatcgacgtcctcaacgacaaggtggccaagttccgcaacgccacgaaccacaagtacgcgaactacatcgtgcagcagtgcctcaagtacaactgcgggaccatccagcttgaagacttgaaggggatcagcaaggagcagacgttcctcaagaactggacctacttcgacctccaggagaagatcaagaaccaggcgaaccagtacggggtgaaggtggtcaagatcgcgccgagctacacgagccagcggtgcagcgagtgcgggtacatccacaagaacaaccgccaggaccagtccacgttcgagtgccagcagtgctccttcaaggtccacgccgactacaacgccgccaagaacatcagcgtgtacaacatcgagaaggtgatccagaagcagctagaactgcaggagaagctgaaccagaccaagtacaaggagcagtacatcgagcagatgaagaacatcaactga

SEQ ID NO: 2344 - DNA, 1353 bp, Unknown
  Bacillus sp. multi
ctgtccatcgcggtcaaggtgatgaagtaccagatcgtgtgcccggtcaacatcgagtggaagaccttcgaaatctacctgcggaccctcagctaccacttccggaccatcggcaaccgcaccatccagaagctctgggagtacgacaaccagagcctcaagcacttcaaggacacggggcagtacccgtccgcccagcagctctacggctgcacccagaaaaccatcagcggctacatctacgaccagctcaaggaggagtaccaggacatcaacaaggccaacatgagcacgaccctccagaaaacgatccggacctggaactcgcgcaagaaggagatctggagcggcgagatgagcatcccgtcgttccgcaacaacctgcccatcgacatccacgggaacagcatccagatcatcaaggagaagtcgggcgactacatcgccagcgtgtccctgttcagcagcaagttcatcaacgagaacgacctccccaacggcaagatcctggtgaagctgtccacgcggaagcagaactcgatgaaggtcatcctcgaccggatcatcgactcgacgtacgcgaagggcgcgtgcatgttgcacaagcacaagaagaagtggtacctgtccatcacctacaagtcgaacatcaaggaggagcttaagttcgacgaggacctgatcatgggcatcgacatgggcaagatcaacgtgctctacttcgccttcaacaagggcctcgtgcggggcgcgatctccggcgaggagatcgaggcgttccgcaagaagattgagcaccggcggatctccctcctccgccagggcaagtactgctccggcaaccggatcggcaaggggcgggagaagcgcatcaagcccatcgacgtcctgaacgacaaggtggccaagttccgcaacgcgaccaaccacaagtacgccaactacatcgtgcagcagtgcctcaagtacaactgcggcaccatacagctcgaagacctcaaggggatctcgaaggagcagacgttcctcaagaactggacgtacttcgacctccaggagaagatcaagaaccaggccaaccagtacggggtcaaggtcgtgaagatcgccccgtcctacacctcccagcgctgctccgagtgcgggtacatccacaagaacaaccgccaggaccagagcaccttcgagtgccagcagtgcagcttcaaggtgcacgcggactacaacgccgccaagaacatcagcgtgtacaacatcgagaaggtcatccagaagcagttggagctacaggagaagctgaaccagaccaagtacaaggagcagtacatcgagcagatgaagaacattaactga

SEQ ID NO: 2345 - DNA, 1332 bp, Unknown
  Bacillus sp. multi
atgaagtaccagatcgtgtgcccggtgaacatcgagtggaaggcgttcgagatctacctccggaccctctcctaccacttccgcaccatcgggaaccgcacgatccagaagctgtgggagtacgacaaccagagcctcaagcacttcaaggacaccggccagtacccctcggcccagcagctctacggctgcacccagaaaacgatctccggctacatctacgaccagctcaaggaggagtaccaggacatcaacaaggcgaacatgagcaccaccctccagaagaccatcaagacctggaactcccgcaagaaggaaatctggagcggcgagatgagcatccccagcttccgcaacaacctgcccatcgacatccacggcaactccatccagatcatcaaggagaagtccggggactacatcgcgtccgtgagcctgttctccagcaagttcatcaaggagaacgacctgcccaacggcaagatcctcgtgaagctcagcacccggaagcagaactccatgaaggtcatcctcgaccggatcatcgactccacctacgcgaagggcgcgtgcatgctccacaagcacaagaagaagtggtatctgagcatcacctacaagtcgaacatcaaggaggagctcaagttcgacaaggaccttatcatggggatcgacatgggcaagatcaacgtgctctacttcgccttcaacaagggcctggtgcgcggggccatcagcggcgaggagatcgaggcgttccgcaagaagatcgagcaccgccgcatctcgctgctccgccaggggaagtactgctccgggaaccgcatcgggaagggccgcgagaagcgcatcaagcccatcgacgtcctcaacgacaaggtggcgaagttccgcaacgccacgaaccacaagtacgccaactacatcgtgcagcagtgcctcaagtacaactgcgggacgatccaactcgaagacctgaaggggatcagcaaggagcagaccttcctcaagaactggacctacttcgacctccaggagaagatcaagaaccaggccaaccagtacggcgtgaaggtggtcaagatcgaccccagctacaccagccagcggtgcagcgagtgcggctacatccacaagaacaaccgccaggaccagagcaccttcgagtgccagcagtgctccttcaaggtccacgccgactacaacgccgccaagaacatctccatgtacaacatcgagaaggtgatccagaagcagctagagttgcaggagaagctgaacctgaccaagtacaaggagcagtacctggagcagatggagaacatcaactag

SEQ ID NO: 2346 - DNA, 1332 bp, Unknown
  Bacillus sp. multi
atgaagtaccagatcgtctgcccggtgaacatcgagtggaaggcgttcgagatatacctgcggaccctcagctaccacttccggaccatcgggaaccgcacgatccagaagctgtgggagtacgacaaccagagcctcaagcacttcaaggacaccggccagtacccctccgcgcagcagctctacggctgcacccagaagacgatcagcggctacatctacgaccagctcaaggaggagtaccaggacatcaacaaggcgaacatgagcaccaccctccagaagacgatcaagacctggaactcgcgcaagaaggagatctggagcggcgagatgagcatcccctccttccggaacaacctccccatcgacatccacggcaactccatccagatcatcaaggagaagtcgggcgactacatcgcctcggtcagcctgttctcctccaagttcatcaaggagaacgacctgccgaacggcaagatcctcgtcaagctgagcacgcggaagcagaacagcatgaaggtcatcctggaccggatcatcgactcgacctacgcgaagggcgcgtgcatgttgcacaagcacaagaagaagtggtacctcagcatcacctacaagagcaacatcaaggaggagttaaagttcgacaaggacctcatcatggggatcgacatgggcaagatcaacgtcctctacttcgccttcaacaagggcctcgtgcggggcgcgatctccggcgaggagatcgaggcgttccgcaagaagatcgagcaccgccggatctcgctgctgcgccagggcaagtactgctccgggaaccggatcggcaagggccgggagaagcgcatcaagcccatcgacgtcctgaacgacaaggtggccaagttccgcaacgcgaccaaccacaagtacgcgaactacatcgtccagcagtgcctcaagtacaactgcgggacgatccagctcgaagacctgaaggggatctcgaaggagcagacgttcctcaagaactggacctacttcgacctccaggagaagatcaagaaccaggccaaccagtacggcgtgaaggtggtgaagatcgacccctcctacacgagccagcggtgctccgagtgcgggtacatccacaagaacaaccgccaggaccagagcaccttcgagtgccagcagtgctcgttcaaggtgcacgccgactacaacgccgccaagaacatctccatgtacaacatcgagaaggtcatccagaagcaactggaattgcaggagaagctgaacctgacgaagtacaaggagcagtacctggagcagatggagaacatcaactga

SEQ ID NO: 2347 - DNA, 1332 bp, Unknown
  Bacillus sp. multi
atgaagtaccagatcgtctgccccgtgaacatcgagtggaaggcgttcgaaatctatctccggaccctgagctaccacttccgcaccatcggcaaccgcaccatccagaagctctgggagtacgacaaccagagcctcaagcacttcaaggacacgggccagtacccctcggcccagcagctctacgggtgcacgcagaagacgatcagcgggtacatctacgaccagctcaaggaggagtaccaggacatcaacaaggcgaacatgagcaccaccctccagaagaccatcaagacgtggaacagccgcaagaaggagatttggagcggcgagatgagcatcccgagcttccggaacaacctgcccatcgacatccacggcaacagcatccagatcatcaaggagaagtccggcgactacatcgcgtccgtgtccctcttcagcagcaagttcatcaaggagaacgacctgcccaacgggaagatcctggtcaagctgagcacccggaagcagaacagcatgaaggtcatcctggaccgcatcatcgactccacctacgcgaagggcgcgtgcatgctgcacaagcacaagaagaagtggtacctgtccatcacctacaagagcaacatcaaggaggagcttaagttcgacaaggacctcatcatggggatcgacatggggaagatcaacgtcctgtacttcgccttcaacaaggggctcgtgcgcggggcgatctccggcgaggagatcgaggcgttccgcaagaaaatcgagcaccggcggatctcgctcctgcgccagggcaaatactgctccggcaaccgcatcggcaagggccgcgagaagcgcatcaagcccatcgacgtgctcaacgacaaggtggccaagttccgcaacgcgacgaaccacaagtacgcgaactacatcgtccagcagtgcctcaagtacaactgcggcacgatccagctcgaagacctcaaggggatcagcaaggagcagacgttcctcaagaactggacgtacttcgacctccaggagaagatcaagaaccaggccaaccagtacggcgtcaaggtcgtcaagatcgaccccagctacacctcccagcggtgctcggagtgcggctacatccacaagaacaaccgccaggaccagtccaccttcgagtgccagcagtgctccttcaaggtccacgcggactacaacgccgccaagaacatctccatgtacaacatcgagaaggtgatccagaagcagctcgaactgcaggagaagctgaacctcaccaagtacaaggagcagtacctggagcagatggagaacatcaactag

SEQ ID NO: 2348 - DNA, 1332 bp, Unknown
  Bacillus sp. multi
atgaagtaccagatcgtgtgccccgtcaacatcgagtggaaggcgttcgaaatctacctgcggaccctctcctaccacttccgcaccatcggcaaccgcacgatccagaagctctgggagtacgacaaccagagcctcaagcacttcaaggacaccggccagtacccgtcggcgcagcagctctacggctgcacccagaaaacgatctccgggtacatctacgaccagctcaaggaggagtaccaggacatcaacaaggcgaacatgagcacgaccctccagaaaaccatcaagacgtggaacagccgcaagaaggagatctggagcggcgagatgagcatccccagcttccggaacaacctgcccatcgacatccacgggaacagcatccagatcatcaaggagaagtccggcgactacatcgcctcggtcagcctgttctcgtccaagttcatcaaggagaacgacctgcccaacgggaagatcctggtcaagctctccacgcgcaagcagaactcgatgaaggtcatcctggaccggatcatcgacagcacgtacgcgaagggcgcgtgcatgttgcacaagcacaagaagaagtggtacctcagcatcacctacaagagcaacatcaaggaggagctcaagttcgacaaagacctaatcatgggcatcgacatgggcaagatcaacgtgctctacttcgccttcaacaagggcctggtgcgcggggcgatcagcggggaggagatcgaggcgttccgcaagaagatcgagcaccggcgcatctccctgctccgccagggcaagtactgctcgggcaaccgcatcgggaaggggcgggagaagcggatcaagcccatcgacgtgctgaacgacaaggtggccaagttccgcaacgccaccaaccacaagtacgccaactacatcgtccagcagtgcctcaagtacaactgcggcaccatccagctcgaggacctcaaggggatctcgaaggagcagacgttcctcaagaactggacgtacttcgacctccaggagaaaatcaagaaccaggcgaaccagtacggcgtgaaggtcgtgaagatcgaccccagctacaccagccagcgctgctccgagtgcggctacatccacaagaacaaccgccaggaccagtccacgttcgagtgccagcagtgctcgttcaaggtccacgcggactacaacgcggccaagaacatcagcatgtacaacatcgagaaggtgatccagaagcagcttgagctgcaggagaagctgaacctgaccaagtacaaggagcagtacctggagcagatggagaacatcaactga

SEQ ID NO: 2349 - DNA, 1332 bp, Unknown
  Bacillus sp. multi
atgaagtaccagatcgtgtgcccggtcaacatcgagtggaaggcgttcgaaatctacctccggacgctctcctaccacttccgcaccatcggcaaccgcaccatccagaagctctgggagtacgacaaccagtccctcaagcacttcaaggacaccggccagtaccccagcgcccagcagctctacggctgcacccagaagacgatctcgggctacatctacgaccagctcaaggaggagtaccaggacatcaacaaggcgaacatgagcaccaccctccagaagacgatcaagacgtggaactcgcgcaagaaggaaatctggagcggcgagatgtccatcccgtccttccgcaacaacctccccatcgacatccacgggaactcgatccagatcatcaaggagaagtcgggcgactacatcgccagcgtctccctgttctcgtcgaagttcatcaaggagaacgacctcccgaacggcaagatcctcgtgaagctcagcacccggaagcagaacagcatgaaggtcatcctggaccggatcatcgactcgacctacgcgaagggcgcgtgcatgttgcacaagcacaagaagaagtggtacctgtccatcacctacaagagcaacatcaaggaggagttgaagttcgacaaagacctgatcatgggcatcgacatggggaagatcaacgtcctctacttcgccttcaacaaggggctcgtgcgcggggccatctccggcgaggagatcgaggcgttccgcaagaagatcgagcaccgccgcatctccctcctccgccaggggaagtactgctcggggaaccggatcgggaaggggcgcgagaagcgcatcaagcccatcgacgtcctcaacgacaaggtggccaagttccgcaacgcgaccaaccacaagtacgccaactacatcgtgcagcagtgcctcaagtacaactgcggcaccatccagcttgaggacctaaaggggatcagcaaggagcagaccttcctcaagaactggacgtacttcgacctccaggagaagatcaagaaccaggcgaaccagtacggcgtcaaggtcgtcaagatcgaccccagctacacgagccagcggtgctcggagtgcgggtacatccacaagaacaaccgccaggaccagtccaccttcgagtgccagcagtgctcgttcaaggtgcacgccgactacaacgcggccaagaacatctccatgtacaacatcgagaaggtgatccagaagcagctagagctccaggagaagctgaacctgacgaagtacaaggagcagtacctggagcagatggagaacatcaactga

SEQ ID NO: 2350 - DNA, 1353 bp, Unknown
  Bacillus sp. multi
ctgagcatcgcggtgaaggtgatgaagtaccagatcgtctgcccggtgaacatcgagtggaagacgttcgagatctacctccggaccctgagctaccacttccgcaccatcgggaaccgcacgatccagaagctctgggagtacgacaaccagtccctcaagcacttcaaggacacggggcagtaccccagcgcccagcagctctacggctgcacccagaaaaccatcagcggctacatctacgaccagctcaaggaggagtaccaggacatcaacaaggcgaacatgagcacgaccctccaaaagacgatccgcacgtggaactcccgcaagaaggagatctggagcggggagatgagcatcccgtccttccgcaacaacctccccatcgacatccacggcaactccatccagatcatcaaggagaagtccggcgactacatcgccagcgtgagcctgttctcgtccaagttcatcaaggagaacgacctccccaacgggaagatcctggtgaagctgtccacccgcaagcagaacagcatgaaggtgatcctggaccgcatcatcgactccacctacgcgaagggcgcgtgcatgttgcacaagcacaagaagaagtggtacctcagcatcacctacaagagcaacatcaaggaggaactcaagttcgacgaagaccttatcatgggcatcgacatgggcaagatcaacgtgctgtacttcgccttcaacaaggggctcgtgcggggcgcgatcagcggggaggagatcgaggcgttccgcaagaagattgagcaccggcggatctccctcctccgccaggggaagtactgctcggggaaccgcatcgggaaggggcgcgagaagcggatcaagcccatcgacgtgctcaacgacaaggtggcgaagttccgcaacgcgacgaaccacaagtacgccaactacatcgtgcagcagtgcctcaagtacaactgcggcacgatccagctagaggatctgaaggggatctcgaaggagcagacgttcctcaagaactggacgtacttcgacctccaggagaagatcaagaaccaggccaaccagtacggggtgaaggtcgtcaagatcgaccccagctacacctcccagcggtgctcggagtgcggctacatccacaagaacaaccgccaggaccagtccacgttcgagtgccagcagtgcagcttcaaggtgcacgccgactacaacgcggccaagaacatctcggtgtacaacatcgagaaggtcatccagaagcagttggagctgcaggagaagctgaaccagaccaagtacaaggagcagtacatcgagcagatgaagaacatcaactga

SEQ ID NO: 2351 - DNA, 1353 bp, Unknown
  Bacillus sp. multi
ctctccatcgcggtcaaggtgatgaagtaccagatcgtgtgccccgtcaacatcgagtggaagacgttcgagatctacctgcggaccctctcctaccacttccggaccatcgggaaccgcacgatccagaagctgtgggagtacgacaaccagagcctcaagcacttcaaggacaccgggcagtacccctcggcgcagcagctctacggctgcacccagaaaacgatctcggggtacatctacgaccagctcaaggaggagtaccaggacatcaacaaggccaacatgagcaccaccctccaaaagaccatccgcacctggaactcgcgcaagaaggaaatctggagcggggagatgagcatcccgtccttccgcaacaacctgcccatcgacatccacgggaactccatccagatcatcaaggagaagtccggcgactacatcgccagcgtcagcctgttctcctccaagttcatcaaggagaacgacctccccaacggcaagatcctggtgaagctcagcacccgcaagcagaacagcatgaaggtgatcctcgaccggatcatcgacagcacgtacgcgaagggcgcgtgcatgctccacaagcacaagaagaagtggtacctgagcatcacctacaagtcgaacatcaaggaggagctgaagttcgacgaggatctgattatgggcatcgacatgggcaagatcaacgtcctgtacttcgccttcaacaagggcctggtgcgcggggccatctccggggaggagatcgaggcgttccgcaagaaaatcgagcaccgccggatcagcctgctccgccaggggaagtactgctcgggcaaccgcatcggcaagggccgggagaagcggatcaagcccatcgacgtgctcaacgacaaggtggcgaagttccgcaacgccaccaaccacaagtacgccaactacatcgtccagcagtgcctcaagtacaactgcggcaccatccagcttgaagacctaaaggggatcagcaaggagcagacgttcctcaagaactggacgtacttcgacctccaggagaagatcaagaaccaggccaaccagtacggcgtcaaggtcgtcaagatcgaccccagctacaccagccagcggtgctcggagtgcgggtacatccacaagaacaaccgccaggaccagtccaccttcgagtgccagcagtgcagcttcaaggtccacgcggactacaacgcggccaagaacatctcggtgtacaacatcgagaaggtgatccagaagcagctggagctacaggagaagctgaaccagacgaagtacaaggagcagtacatcgagcagatgaagaacatcaactga

SEQ ID NO: 2352 - DNA, 1353 bp, Unknown
  Bacillus sp. multi
ctctccatcgcggtcaaggtgatgaagtaccagatcgtgtgcccggtgaacatcgagtggaagacgttcgagatctacctccggaccctgagctaccacttccgcaccatcggcaaccgcacgatccagaagctgtgggagtacgacaaccagagcctcaagcacttcaaggacacgggccagtacccctccgcgcagcagctctacggctgcacccaaaagaccatctccggctacatctacgaccagctcaaggaggagtaccaggacatcaacaaggccaacatgagcaccaccctccagaaaacaatccgcacctggaactcgcgcaagaaggagatctggagcggcgagatgagcatcccgagcttccggaacaacctccccatcgacatccacggcaacagcatccagatcatcaaggagaagtcgggcgactacatcgcctccgtcagcctgttctccagcaagttcatcaaggagaacgacctgccgaacgggaagatcctggtcaagctcagcacgcgcaagcagaacagcatgaaggtgatcctcgaccgcatcatcgactcgacctacgcgaagggcgcgtgcatgctgcacaagcacaagaagaagtggtatctctccatcacgtacaagtccaacatcaaggaggagttgaagttcgacgaggatctcatcatgggcatcgacatggggaagatcaacgtgctgtacttcgcgttcaacaagggcctggtgcgcggggcgatcagcggcgaggagatcgaggcgttccgcaagaagatagagcaccgccgcatctcgctgctgcgccaggggaagtattgctcgggcaaccggatcgggaaggggcgcgagaagcgcatcaagcccatcgacgtgctcaacgacaaggtggcgaagttccgcaacgccacgaaccacaagtacgccaactacatcgtccagcagtgcctcaagtacaactgcggcaccatccagctcgaggacctcaaggggatcagcaaggagcagacgttcctcaagaactggacctacttcgacctccaggagaagatcaagaaccaggccaaccagtacggcgtgaaggtggtcaagatcgacccctcctacaccagccagcggtgctcggagtgcgggtacatccacaagaacaaccgccaggaccagagcacgttcgagtgccagcagtgctcgttcaaggtccacgcggactacaacgcggccaagaacatctcggtgtacaacatcgagaaggtgatccagaagcagctggagctacaggagaagctgaaccagaccaagtacaaggagcagtacatcgagcagatgaagaatatcaactga

SEQ ID NO: 2353 - DNA, 1353 bp, Unknown
  Bacillus sp. multi
ctcagcatcgccgtcaaggtgatgaagtaccagatcgtgtgcccggtgaacatcgagtggaagaccttcgagatctacctccggaccctcagctaccacttccgcaccatcgggaaccgcaccatccagaagctgtgggagtacgacaaccagagcctcaagcacttcaaggacacgggccagtacccgagcgcccagcagctctacggctgcacgcagaaaaccatctcggggtacatctacgaccagctcaaggaggagtaccaggacatcaacaaggccaacatgagcacgaccctccagaagaccatccgcacctggaacagccgcaagaaggagatatggagcggcgagatgtccatcccctccttccgcaacaacctccccatcgacatccacgggaacagcatccagatcatcaaggagaagtcgggcgactacatcgcctccgtgtcgctgttcagctcgaagttcatcaaggagaacgacctccccaacggcaagatcctggtcaagctgtccacgcgcaagcagaactcgatgaaggtgatcctcgaccgcatcatcgacagcacctacgcgaagggcgcgtgcatgctgcacaagcacaagaagaagtggtatctctccatcacctacaagagcaacatcaaggaggagcttaagttcgacgaagacttgatcatggggatcgacatggggaagatcaacgtgctgtacttcgccttcaacaagggcctcgtgcgcggcgcgatctccggcgaggagatcgaggcgttccgcaagaagatcgagcaccgccgcatctcgctgctgcgccaggggaagtactgctccggcaaccggatcgggaaggggcgggagaagcgcatcaagcccatcgacgtgctgaacgacaaggtggccaagttccgcaacgcgacgaaccacaagtacgccaactacatcgtgcagcagtgcctcaagtacaactgcgggaccatccagctcgaggatctgaaggggatcagcaaggagcagaccttcctcaagaactggacctacttcgacctccaggagaaaatcaagaaccaggcgaaccagtacggcgtgaaggtggtcaagatcgacccctcctacaccagccagcgctgctccgagtgcggctacatccacaagaacaaccgccaggaccagtccaccttcgagtgccagcagtgcagcttcaaggtgcacgcggactacaacgcggccaagaacatcagcgtgtacaacatcgagaaggtgatccagaagcagctcgaactgcaggagaagctcaaccagacgaagtacaaggagcagtacatcgagcagatgaagaatatcaactga

SEQ ID NO: 2354 - DNA, 1353 bp, Unknown
  Bacillus sp. multi
ctgagcatcgcggtcaaggtcatgaagtaccagatcgtctgcccggtgaacatcgagtggaagacgttcgagatctacctgcggacgctgagctaccacttccgcaccatcggcaaccggacgatccagaagctctgggagtacgacaaccagtcgctcaagcacttcaaggacacggggcagtaccccagcgcgcagcagctctacggctgcacccagaagaccatcagcggctacatctacgaccagctcaaggaggagtaccaggacatcaacaaggccaacatgagcaccaccctccagaagacgatccgcacctggaactcccgcaagaaggagatctggagcggcgagatgtccatcccctccttccgcaacaacctccccatcgacatccacggcaactccatccagatcatcaaggagaagtccggcgactacatcgcgtccgtgagcctgttcagcagcaagttcatcaaggagaacgacctgcccaacgggaagatcctggtcaagctgtccacgcgcaagcagaacagcatgaaggtgatcctcgaccggatcatcgactcgacctacgcgaagggcgcgtgcatgctgcacaagcacaagaagaagtggtacttgagcatcacctacaagagcaacatcaaggaggagttgaagttcgacgaagacctcataatggggatcgacatgggcaagatcaacgtgctgtacttcgccttcaacaagggcctggtgcgcggggcgatctccggggaggagatcgaggcgttccgcaagaagattgagcaccggcggatctcgctgctgcgccaggggaaatactgctccggcaaccgcatcgggaagggccgcgagaagcggatcaagcccatcgacgtcctcaacgacaaggtggccaagttccgcaacgccacgaaccacaagtacgcgaactacatcgtgcagcagtgcctcaagtacaactgcggcaccatccaactcgaggacttgaaggggatcagcaaggagcagaccttcctcaagaactggacctacttcgacctccaggagaagatcaagaaccaggccaaccagtacggggtgaaggtcgtgaagatcgacccgtcctacaccagccagcgctgctcggagtgcggctacatccacaagaacaaccgccaggaccagagcaccttcgagtgccagcagtgcagcttcaaggtgcacgccgactacaacgcggccaagaacatctcggtgtacaacatcgagaaggtgatccagaagcagcttgaactgcaggagaagctgaaccagaccaagtacaaggagcagtacatcgagcagatgaagaacatcaactga

SEQ ID NO: 2355 - DNA, 1353 bp, Unknown
  Bacillus sp. multi
ctgagcatcgcggtcaaggtgatgaagtaccagatcgtctgccccgtcaacatcgagtggaagacgttcgagatctacctccggaccctgagctaccacttccgcaccatcgggaaccgcaccatccagaagctgtgggagtacgacaaccactcgctcaagcacttcaaggacaccgggcagtacccgtcggcgcagcagctctacgggtgcacgcagaagacaatcagcggctacatctacgaccagctcaaggaggagtaccaggacatcaacaaggcgaacatgagcaccaccctccagaaaacgatccggacgtggaactcgcgcaagaaggagatctggagcggcgagatgtccatcccgtccttccgcaacaacctccccatcgacatccacgggaactcgatccagatcatcaaggagaagtcgggcgactacatcgcgtcggtgagcctcttcagcagcaagttcatcaaggagaacgacctgcccaacgggaagatcctggtgaagctcagcacgcgcaagcagaactcgatgaaggtgatcctcgaccgcatcatcgacagcacgtacgcgaagggcgcgtgcatgctacacaagcacaagaagaagtggtacctgtcgatcacctacaagtccaacatcaaggaggagctgaagttcgacgaagatctcatcatgggcatcgacatggggaagatcaacgtcctctacttcgcgttcaacaaggggctggtgcgcggggccatcagcggcgaggagatcgaggcgttccgcaagaagatcgagcaccgccgcatcagcctcctccgccagggcaagtactgctccggcaaccgcatcggcaaggggcgcgagaagcgcatcaagcccatcgacgtcctgaacgacaaggtggccaagttccgcaacgcgacgaaccacaagtacgcgaactacatcgtccagcagtgcctcaagtacaactgcgggacgatacagcttgaggacttgaaggggatcagcaaggagcagaccttcctcaagaactggacgtacttcgacctccaggagaagatcaagaaccaggcgaaccagtacggggtgaaggtggtgaagatcgacccgtcctacacctcccagcggtgctccgagtgcggctacatccacaagaacaaccgccaggaccagagcacgttcgagtgccagcagtgcagcttcaaggtccacgccgactacaacgccgccaagaacatctccgtgtacaacatcgagaaggtgatccagaagcagctggaactccaggagaagctgaaccagaccaagtacaaggagaagtacatcgagcagatgaagaacatcaactag

SEQ ID NO: 2356 - DNA, 1353 bp, Unknown
  Bacillus sp. multi
ctctccatcgcggtgaaggtcatgaagtaccagatcgtgtgccccgtcaacatcgagtggaagaccttcgagatctacctccggaccctctcctaccacttccgcaccatcggcaaccgcaccatccagaagctctgggagtacgacaaccactcgctcaagcacttcaaggacacgggccagtacccgagcgcccagcagctctacggctgcacgcagaagaccatcagcggctacatctacgaccagctcaaggaggagtaccaggacatcaacaaggccaacatgagcaccaccctccagaagaccatccgcacctggaactcgcgcaagaaggagatctggagcggggagatgtccatcccgtcgttccgcaacaacctccccatcgacatccacggcaacagcatccagatcatcaaggagaagtcgggcgactacatcgcctccgtctccctgttctcgtccaagttcatcaaggagaacgacctgccgaacgggaagatcctggtgaagctctcgacgcggaagcagaacagcatgaaggtcatcctggaccggatcatcgacagcacctacgcgaagggcgcgtgcatgcttcacaagcacaagaagaagtggtacttgtccatcacctacaagtccaacatcaaggaggaactcaagttcgacgaggacttgatcatggggatcgacatgggcaagatcaacgtgctctacttcgccttcaacaagggcctggtgcgcggggccatctcgggcgaggagatcgaggcgttccgcaagaagatcgagcaccggcgcatctccctgctgcgccagggcaagtattgctcggggaaccgcatcggcaagggccgcgagaagcgcatcaagcccatcgacgtcctcaacgacaaggtggcgaagttccgcaacgccacgaaccacaagtacgccaactacatcgtccagcagtgcctcaagtacaactgcgggacgatccagttggaggacttgaaggggatctcgaaggagcagacgttcctcaagaactggacctacttcgacctccaggagaagattaagaaccaggccaaccagtacggcgtgaaggtggtgaagatcgaccccagctacacctcccagcgctgctcggagtgcggctacatccacaagaacaaccgccaggaccagagcacgttcgagtgccagcagtgctcgttcaaggtccacgccgactacaacgccgccaagaacatctcggtgtacaacatcgagaaggtgatccagaagcagctagagctccaggagaagctgaaccagaccaagtacaaggagaagtacatcgagcagatgaagaacatcaactga

SEQ ID NO: 2357 - DNA, 1353 bp, Unknown
  Bacillus sp. multi
ctcagcatcgcggtcaaggtgatgaagtaccagatcgtgtgccccgtgaacatcgagtggaagaccttcgagatctacctccggacgctcagctaccacttccgcaccatcggcaaccggaccatccagaagctctgggagtacgacaaccacagcctcaagcacttcaaggacacgggccagtacccctcggcgcagcagctctacggctgcacgcagaagactatctcgggctacatctacgaccagctcaaggaggagtaccaggacatcaacaaggccaacatgagcaccaccctccagaagaccatccgcacctggaactcccgcaagaaggagatctggagcggcgagatgagcatccccagcttccgcaacaacctgcccatcgacatccacggcaactcgatccagatcatcaaggagaagtcgggcgactacatcgcctccgtctccctgttctccagcaagttcatcaaggagaacgacctcccgaacgggaagatcctggtgaagctgagcacccgcaagcagaactccatgaaggtcatcctcgaccgcatcatcgactccacctacgcgaagggcgcgtgcatgctccacaagcacaagaagaagtggtacttatcgatcacgtacaagagcaacatcaaggaggagctcaagttcgacgaggatctgatcatgggcatcgacatggggaagatcaacgtgctgtacttcgcgttcaacaagggcctcgtgcgcggcgcgatcagcggggaggagatcgaggcgttccgcaagaaaatcgagcaccgccgcatctcgctcctccgccaggggaagtactgctccggcaaccgcatcgggaaggggcgggagaagcggatcaagcccatcgacgtgctgaacgacaaggtggccaagttccgcaacgccacgaaccacaagtacgcgaactacatcgtccagcagtgcctcaagtacaactgcgggaccatccagcttgaggatctcaaagggatctcgaaggagcagacgttcctcaagaactggacgtacttcgacctccaggagaagatcaagaaccaggccaaccagtacggcgtgaaggtcgtgaagatcgaccccagctacacgagccagcggtgcagcgagtgcgggtacatccacaagaacaaccgccaggaccagagcacgttcgagtgccagcagtgcagcttcaaggtgcacgccgactacaacgccgccaagaacatctcggtgtacaacatcgagaaggtcatccagaagcagcttgagctccaggagaagctgaaccagaccaagtacaaggagaagtacatcgagcagatgaagaacatcaactag

SEQ ID NO: 2358 - DNA, 1353 bp, Unknown
  Bacillus sp. multi
ctcagcatcgccgtgaaggtgatgaagtaccagatcgtgtgcccggtcaacatcgagtggaagacgttcgagatttacctccggaccctctcctaccacttccgcaccatcgggaaccgcacgatccagaagctgtgggagtacgacaaccactccctcaagcacttcaaggacaccggccagtacccgagcgcccagcagctctacggctgcacgcagaaaactatctcgggctacatctacgaccagctcaaggaggagtaccaggacatcaacaaggcgaacatgagcacgaccctccagaagaccatccggacgtggaactcgcgcaagaaggagatctggagcggcgagatgtccatccccagcttccgcaacaacctgcccatcgacatccacgggaactccatccagatcatcaaggagaagtccggcgactacatcgcctcggtgagcctgttcagctcgaagttcatcaaggagaacgacctcccgaacggcaagatcctggtcaagctcagcacgcggaagcagaacagcatgaaggtgatcctggaccgcatcatcgacagcacctacgcgaagggcgcgtgcatgctccacaagcacaagaagaagtggtacctttcgatcacctacaagagcaacatcaaggaggagctcaagttcgacgaggacctcatcatggggatcgacatggggaagatcaacgtgctgtacttcgccttcaacaagggcctcgtgcgcggggcgatcagcggggaggagatcgaggcgttccgcaagaagatcgagcaccggcggatctccctcctgcgccagggcaagtattgctccggcaaccgcatcggcaagggccgcgagaagcgcatcaagcccatcgacgtcctgaacgacaaggtggccaagttccgcaacgccacgaaccacaagtacgccaactacatcgtccagcagtgcctcaagtacaactgcgggaccatccagctcgaggacttaaaggggatcagcaaggagcagaccttcctcaagaactggacctacttcgacctccaggagaagatcaagaaccaggccaaccagtacggggtcaaggtcgtgaagatcgacccgagctacaccagccagcggtgcagcgagtgcggctacatccacaagaacaaccgccaggaccagagcacgttcgagtgccagcagtgctccttcaaggtgcacgccgactacaacgccgccaagaacatcagcgtgtacaacatcgagaaggtgatccagaagcaacttgagctccaggagaagctgaaccagacgaagtacaaggagaagtacatcgagcagatgaagaacatcaactga

SEQ ID NO: 2359 - DNA, 1353 bp, Unknown
  Bacillus sp. multi
ctgtccatcgccgtgaaggtgatgaagtaccagatcgtgtgcccggtcaacatcgagtggaagaccttcgagatctacctccggaccctgagctaccacttccgcaccatcgggaaccgcaccatccagaagctgtgggagtacgacaaccacagcctcaagcacttcaaggacacggggcagtacccgtcggcccagcagctctacggctgcacgcagaagaccatctcgggctacatctacgaccagctcaaggaggagtaccaggacatcaacaaggcgaacatgagcacgaccctccagaagacgatccgcacctggaacagccgcaagaaggagatctggagcggcgagatgagcatcccctcgttccgcaacaacctccccatcgacatccacgggaacagcatccagatcatcaaggagaagtccggcgactacatcgccagcgtctccctgttctcctccaagttcatcaaggagaacgacctcccgaacgggaagatcctggtcaagctctccacgcgcaagcagaacagcatgaaggtcatcctggaccggatcatcgactccacctacgcgaagggcgcgtgcatgctgcacaagcacaagaagaagtggtatctgagcatcacctacaagagcaacatcaaggaggagctcaagttcgacgaggacttaatcatggggatcgacatggggaagatcaacgtcctctacttcgccttcaacaaggggctcgtgcgcggcgcgatctcgggcgaggagatcgaggcgttccgcaagaagatcgagcaccgccgcatctccctcctgcgccagggcaagtactgctcgggcaaccgcatcggcaagggccgcgagaagcggatcaagcccatcgacgtgctcaacgacaaggtggccaagttccgcaacgccaccaaccacaagtacgcgaactacatcgtgcagcagtgcctcaagtacaactgcggcaccatccaacttgaggacttgaaggggatctcgaaggagcagaccttcctcaagaactggacctacttcgacctccaggagaagattaagaaccaggccaaccagtacggcgtgaaggtcgtcaagatcgacccgagctacacctcccagcggtgcagcgagtgcggctacatccacaagaacaaccgccaggaccagagcacgttcgagtgccagcagtgcagcttcaaggtgcacgccgactacaacgccgccaagaacatcagcgtgtacaacatcgagaaggtgatccagaagcagctcgagttacaggagaagctgaaccagacgaagtacaaggagaagtacatcgagcagatgaagaacatcaactga

SEQ ID NO: 2360 - DNA, 1332 bp, Unknown
  Bacillus sp. multi
atgaagtaccagatcgtgtgccccgtcaacatcgagtggaagaccttcgagatctacctgcggaccctcagctaccacttccgcaccatcggcaaccgcaccatccagaagctctgggagtacgacaaccagagcctcaagcacttcaaggacaccgggcagtacccctcggcccagcagctctacgggtgcacgcagaagaccatcagcgggtacatctacgaccagctcaaggaggagtaccaggacatcaacaaggccaacatgagcaccaccctccagaagacgatccgcacctggaactcccgcaagaaggagatatggagcggcgagatgagcatcccgtccttccggaacaacctgcccatcgacatccacgggaacagcatccagatcatcaaggagaagtccggggactacatcgcgtccgtctccctgttctccagcaagttcatcaaggagaacgacctcccgaacggcaagatcctggtcaagctgtccacgcggaagcagaacagcatgaaggtgatcctcgaccggatcatcgacagcacgtacgcgaagggcgcgtgcatgctccacaagcacaagaagaaatggtacttgagcatcacctacaagagcaacatcaaggaggagctaaagttcgacgaggacctcatcatggggatcgacatggggaagatcaacgtcctctacttcgccttcaacaagggcctggtgcggggcgcgatctccggcgaggagatcgaggcgttccgcaagaaaatcgagcaccgccggatcagcctgctgcgccagggcaagtactgttcgggcaaccgcatcgggaaggggcgggagaagcgcatcaagcccatcgacgtcctcaacgacaaggtggcgaagttccgcaacgccaccaaccacaagtacgcgaactacatcgtccagcagtgcctcaagtacaactgcggcacgatccagcttgaggacctgaaagggatctcgaaggagcagacgttcctcaagaactggacgtacttcgacctccaggagaagatcaagaaccaggcgaaccagtacggggtgaaggtcgtcaagatcgacccctcctacaccagccagcgctgctccgagtgcggctacatccacaagaacaaccgccaggaccagagcacgttcgagtgccagcagtgctcgttcaaggtgcacgcggactacaacgcggccaagaacatcagcgtgtacaacatcgagaaggtcatccagaagcagcttgagctccaggagaagctgaaccagaccaagtacaaggagcagtacatcgagcagatgaagaacatcaactga

SEQ ID NO: 2361 - DNA, 1332 bp, Unknown
  Bacillus sp. multi
atgaagtaccagatcgtgtgccccgtcaacatcgagtggaagaccttcgagatctacctgcggaccctctcctaccacttccggaccatcggcaaccgcaccatccagaagctgtgggagtacgacaaccagagcctcaagcacttcaaggacaccggccagtacccctccgcgcagcagctctacggctgcacccagaagactatcagcgggtacatctacgaccagctcaaggaggagtaccaggacatcaacaaggcgaacatgagcaccaccctccagaaaaccatccggacctggaactcccgcaagaaggagatctggagcggggagatgagcatcccgagcttccggaacaacctgcccatcgacatccacggcaactccatccagatcatcaaggagaagtccggcgactacatcgcgtccgtgagcctgttctccagcaagttcatcaaggagaacgacctccccaacggcaagatcctggtcaagctctccacccgcaagcagaactcgatgaaggtgatcctggaccggatcatcgactccacctacgcgaagggcgcgtgcatgctgcacaagcacaagaagaagtggtacttgtccatcacctacaagtcgaacatcaaggaggagttgaagttcgacgaagaccttatcatgggcatcgacatggggaagatcaacgtcctgtacttcgccttcaacaagggcctggtgcgcggggccatctccggggaggagatcgaggcgttccgcaagaagatcgagcaccgccggatcagcctgctccgccagggcaaatactgctccggcaaccgcatcgggaaggggcgcgagaagcggatcaagcccatcgacgtgctcaacgacaaggtggccaagttccgcaacgccacgaaccacaagtacgccaactacatcgtccagcagtgcctcaagtacaactgcggcaccatccagcttgaggacctaaaggggatctcgaaggagcagacgttcctcaagaactggacgtacttcgacctccaggagaagatcaagaaccaggccaaccagtacggggtgaaggtggtgaagatcgacccgtcctacaccagccagcgctgctccgagtgcggctacatccacaagaacaaccgccaggaccagtccaccttcgagtgccagcagtgcagcttcaaggtgcacgccgactacaacgccgccaagaacatctcggtgtacaacatcgagaaggtgatccagaagcagctggagctgcaggagaagctcaaccagaccaagtacaaggagcagtacatcgagcagatgaagaacatcaactag

SEQ ID NO: 2362 - DNA, 1332 bp, Unknown
  Bacillus sp. multi
atgaagtaccagatcgtgtgcccggtgaacatcgagtggaagacgttcgagatatacctgcggaccctctcgtaccacttccgcaccatcggcaaccgcaccatccagaagctctgggagtacgacaaccagtcgctcaagcacttcaaggacacggggcagtacccgtccgcccagcagctctacggctgcacccagaagacgatcagcgggtacatctacgaccagctcaaggaggagtaccaggacatcaacaaggcgaacatgagcaccaccctccagaaaaccatccgcacctggaactcccgcaagaaggaaatctggagcggcgagatgtccatcccctccttccggaacaacctccccatcgacatccacggcaactcgatccagatcatcaaggagaagtccggcgactacatcgcgtccgtcagcctgttctcgtccaagttcatcaaggagaacgacctgcccaacggcaagatcctggtcaagctcagcacgcgcaagcagaactcgatgaaggtgatcctggaccgcatcatcgactccacgtacgcgaagggcgcgtgcatgctgcacaagcacaagaagaagtggtacctcagcatcacctacaagagcaacatcaaggaggagctaaagttcgacgaggatctcatcatggggatcgacatgggcaagatcaacgtcctgtacttcgccttcaacaagggcctggtgcggggcgcgatctccggcgaggagatcgaggcgttccgcaagaagatagagcaccggcgcatctccctgctccgccaggggaagtactgctcgggcaaccggatcggcaagggccgggagaagcggatcaagcccatcgacgtgctgaacgacaaggtggcgaagttccgcaacgcgacgaaccacaagtacgccaactacatcgtccagcagtgcctcaagtacaactgcgggacgatccagctcgaggacttgaaggggatcagcaaggagcagaccttcctcaagaactggacgtacttcgacctccaggagaagatcaagaaccaggcgaaccagtacggcgtcaaggtcgtgaagatcgaccccagctacaccagccagcggtgcagcgagtgcggctacatccacaagaacaaccgccaggaccagtccaccttcgagtgccagcagtgcagcttcaaggtccacgccgactacaacgcggccaagaacatctccgtgtacaacatcgagaaggtcatccagaagcaacttgagctgcaggagaagctgaaccagacgaagtacaaggagcagtacatcgagcagatgaagaacatcaactga

SEQ ID NO: 2363 - DNA, 1332 bp, Unknown
  Bacillus sp. multi
atgaagtaccagatcgtgtgccccgtgaacatcgagtggaagacgttcgagatctacctccggaccctcagctaccacttccgcaccatcggcaaccggacgatccagaagctctgggagtacgacaaccagtcgctcaagcacttcaaggacacgggccagtacccctccgcgcagcagctctacggctgcacccagaagaccatctccggctacatctacgaccagctcaaggaggagtaccaggacatcaacaaggccaacatgagcaccaccctccagaaaaccatccgcacctggaactcccgcaagaaggagatctggagcggcgagatgtccatcccctcgttccgcaacaacctgcccatcgacatccacggcaactcgatccagatcatcaaggagaagtcgggcgactacatcgccagcgtcagcctgttctcctccaagttcatcaaggagaacgacctcccgaacgggaagatcctggtgaagctctccacgcgcaagcagaactccatgaaggtcatcctggaccggatcatcgactcgacctacgcgaagggcgcgtgcatgctccacaagcacaagaagaagtggtatctgtccatcacctacaagagcaacatcaaggaggagctaaagttcgacgaggatcttatcatgggcatcgacatgggcaagatcaacgtgctctacttcgccttcaacaagggcctcgtgcgcggggcgatctccggggaggagatcgaggcgttccgcaagaagatcgagcaccggcgcatctccctgctgcgccaggggaagtactgctcggggaaccggatcggcaaggggcgcgagaagcgcatcaagcccatcgacgtgctcaacgacaaggtggccaagttccgcaacgccaccaaccacaagtacgcgaactacatcgtgcagcagtgcctcaagtacaactgcggcacgatccagttagaggacctcaaggggatctcgaaggagcagacgttcctcaagaactggacgtacttcgacctccaggagaagatcaagaaccaggcgaaccagtacggcgtgaaggtggtgaagatcgacccgagctacacctcccagcggtgctccgagtgcggctacatccacaagaacaaccgccaggaccagagcacgttcgagtgccagcagtgcagcttcaaggtgcacgcggactacaacgccgccaagaacatcagcgtgtacaacatcgagaaggtgatccagaagcagcttgagctgcaggagaagctgaaccagaccaagtacaaggagcagtacatcgagcagatgaagaatatcaactga

SEQ ID NO: 2364 - DNA, 1332 bp, Unknown
  Bacillus sp. multi
atgaagtaccagatcgtgtgccccgtcaacatcgagtggaagaccttcgaaatctacctgcggaccctctcgtaccacttccgcaccatcggcaaccgcaccatccagaagctgtgggagtacgacaaccagagcctcaagcacttcaaggacacggggcagtaccccagcgcgcagcagctctacggctgcacccagaaaaccatcagcggctacatctacgaccagctcaaggaggagtaccaggacatcaacaaggccaacatgagcacgaccctccagaagacaatccgcacgtggaactcgcgcaagaaggagatctggagcggcgagatgagcatcccgagcttccgcaacaacctgcccatcgacatccacggcaacagcatccagatcatcaaggagaagtccggcgactacatcgcctcggtcagcctgttcagcagcaagttcatcaaggagaacgacctccccaacgggaagatcctggtcaagctctccacccgcaagcagaacagcatgaaggtgatcctcgaccgcatcatcgactcgacgtacgcgaagggcgcgtgcatgctgcacaagcacaagaagaagtggtacttgtccatcacctacaagagcaacatcaaggaggagctgaagttcgacgaagacctgatcatgggcatcgacatggggaagatcaacgtgctgtacttcgccttcaacaagggcctcgtgcggggcgcgatctcgggcgaggagatcgaggcgttccgcaagaagattgagcaccgccggatcagcctgctccgccaggggaagtactgttccggcaaccggatcggcaagggccgggagaagcgcatcaagcccatcgacgtgctcaacgacaaggtggccaagttccgcaacgcgacgaaccacaagtacgccaactacatcgtccagcagtgcctcaagtacaactgcggcaccatccagcttgaggacctcaaggggatcagcaaggagcagacgttcctcaagaactggacctacttcgacctccaggagaagatcaagaaccaggccaaccagtacggcgtcaaggtcgtgaagatcgacccctcctacacgagccagcggtgctcggagtgcggctacatccacaagaacaaccgccaggaccagagcacgttcgagtgccagcagtgctcgttcaaggtccacgccgactacaacgccgccaagaacatctccgtgtacaacatcgagaaggtgatccagaagcagctggaactccaggagaagctgaaccagaccaagtacaaggagcagtacatcgagcagatgaagaacatcaactag

SEQ ID NO: 2365 - DNA, 1353 bp, Unknown
  Bacillus sp. multi
ctctccctggcggtcaaggtcatgaagtaccagatcgtgtgccccgtgaacgtggagtggaaggtcttcgagacctacctccgcaccctgtcctaccagtcccgcaccatcggcaaccgcaccatccagaagatttgggagttcgacaacctctccctcaagcacttcaaggagacgggcgagtacccctcggcccagcagctctacggctgcacgcagaaaacaatcagcggctacatctacgaccagctcaaggaggagtacaaggacatcaacaaggccaacatgagcacgaccatccagaaaaccctcaagaactggaacagccgcaagaaggagatatggcgcggggagatgtccatcccgagcttccgcagcgacctccccatcgacatccacggcaactccatccagctcatcaaggagaagggcggcgactacatcgccagcgtgtcgctgttcagcagcaagttcatcaaggagaacgacctcccgaacgggaagatcctggtcaagctctcgacccgcaagcagaactccatgaaggtcatcctggaccggctcatcaactcgacgtacagcaagggcgcgtgcatgctgcacaagcacaagaagaagtggtacctgagcatcacctacaagagcaacatcaaggaggagctcaagttcgacgaggacctcattatggggatcgacatgggcaagatcaacgtgctgtacttcgcgttcaacaagagcctcgtgcggggcgcgatcagcggcgaggagatcgaggcgttccgcaagaagattgagcaccgccgcatctcgctcctccgccagggcaagtactgctcgggcaaccggatcggcaaggggcgcgagaagcgcatcaagcccatcgacgtcctcaacgacaaggtggcgaagttccgcaacgcgaccaaccacaagtacgcgaactacatcgtccagcagtgcctcaagtacaactgcgggaccatccagttggaagaccttaaggggatctcgaaggagcagacgttcctcaagaactggacctacttcgacctccaggagaagatcaagaaccaggcgaaccagtacggcgtgaaggtggtgaagatcgacccgagctacaccagccagcggtgcagcgagtgcggctacatccacaaggacaaccgccaggaccagtccaccttcgagtgcctccagtgcagcttcaaggtgcacgccgactacaacgccgccaagaacatctccgtgtacaacatcgagaaggtgatccagaaacagctcgaactgcaagagaagctgaacctcaccaagtacaaggagcactacatcgagcagatgaagaacatcaactga

SEQ ID NO: 2366 - DNA, 1353 bp, Unknown
  Bacillus sp. multi
ctgtccctggcggtcaaggtgatgaagtaccagatcgtgtgccccgtcaacgtcgagtggaaggtgttcgagacctacctccgcaccctctcgtaccagtcgcgcaccatcggcaaccgcacgatccagaaaatctgggagttcgacaacctcagcctcaagcacttcaaggagacgggcgagtacccctccgcccagcagctctacggctgcacgcagaaaaccatctccgggtacatctacgaccagctcaaggaggagtacaaggacatcaacaaggcgaacatgagcaccaccatccaaaagacgctcaagaactggaacagccgcaagaaggagatctggcgcggggagatgagcatccccagcttccggtcggacctccccatcgacatccacgggaactcgatccagctcatcaaggagaagggcggcgactacatcgccagcgtctcgctgttcagcagcaagttcatcaaggagaacgacctcccgaacgggaagatcctggtcaagctcagcacgcggaagcagaacagcatgaaggtcatcctcgaccgcctcatcaactcgacctacagcaagggcgcgtgcatgctccacaagcacaagaagaaatggtatctcagcatcacctacaagtcgaacatcaaggaggagctgaagttcgacgaagaccttatcatgggcatcgacatgggcaagatcaacgtgctctacttcgcgttcaacaagtcgctcgtccggggcgcgatctccggcgaggagatcgaggcgttccgcaagaagatcgagcaccgccgcatcagcctcctgcgccagggcaagtactgctccggcaaccggatcgggaagggccgcgagaagcggatcaagcccatcgacgtgctgaacgacaaggtggccaagttccgcaacgccacgaaccacaagtacgccaactacatcgtccagcagtgcctcaagtacaactgcggcaccatccagctagaggacctcaaggggatctcgaaggagcagacgttcctcaagaactggacctacttcgacctccaggagaagattaagaaccaggcgaaccagtacggcgtgaaggtcgtcaagatcgacccgtcctacacgagccagcggtgctcggagtgcgggtacatccacaaggacaaccgccaggaccagagcacgttcgagtgcctccagtgcagcttcaaggtgcacgccgactacaacgccgccaagaacatctccgtgtacaacatcgagaaggtgatccagaagcaactcgagctacaggaaaagctgaacctgaccaagtacaaggagcactacatcgagcagatgaagaatatcaactga

SEQ ID NO: 2367 - DNA, 1353 bp, Unknown
  Bacillus sp. multi
ctctccctggccgtgaaggtgatgaagtaccagatcgtgtgcccggtgaacgtcgagtggaaggtgttcgagacgtacctccgcaccctgtcctaccagtcgcgcaccatcggcaaccgcaccatccagaagatttgggagttcgacaacctctccctcaagcacttcaaggagaccggggagtacccgtcggcccagcagctctacggctgcacccagaaaacgatcagcggctacatctacgaccagctcaaggaggagtacaaggacatcaacaaggccaacatgagcaccaccatccagaagaccctcaagaactggaacagccgcaagaaggagatctggcggggcgagatgagcatcccgagcttccggtccgacctccccatcgacatccacgggaactccatccagctcatcaaggagaagggcggggactacatcgcctcggtcagcctgttctcctccaagttcatcaaggagaacgacctgcccaacgggaagatcctggtgaagctctccacccgcaagcagaactccatgaaggtcatcctcgaccggctcatcaactccacgtactcgaagggcgcgtgcatgctgcacaagcacaagaagaagtggtacttgtcgatcacctacaagagcaacatcaaggaggagttgaagttcgacgaggatctcattatggggatcgacatggggaagatcaacgtgctctacttcgccttcaacaagtcgctggtgcgcggggccatctccggggaggagatcgaggcgttccgcaagaagatcgagcaccggcgcatctccctcctgcgccagggcaagtactgctcggggaaccggatcggcaaggggcgcgagaagcggatcaagcccatcgacgtgctgaacgacaaggtggccaagttccgcaacgccaccaaccacaagtacgccaactacatcgtgcagcagtgcctcaagtacaactgcggcaccattcaactggaggatctaaaggggatcagcaaggagcagacgttcctcaagaactggacctacttcgacctccaggagaagatcaagaaccaggccaaccagtacggcgtgaaggtcgtcaagatcgacccgagctacaccagccagcgctgctccgagtgcgggtacatccacaaggacaaccgccaggaccagagcaccttcgagtgcctccagtgcagcttcaaggtgcacgcggactacaacgccgccaagaacatcagcgtgtacaacatcgagaaggtgatccagaagcagcttgagctccaggaaaagctgaacctgacgaagtacaaggagcactacatcgagcagatgaagaatatcaactga

SEQ ID NO: 2368 - DNA, 1353 bp, Unknown
  Bacillus sp. multi
ctgtcgctcgccgtgaaggtcatgaagtaccagatcgtgtgcccggtgaacgtcgagtggaaggtgttcgagacgtacctccgcacgctgagctaccagtcccggaccatcggcaaccgcaccatccagaaaatctgggagttcgacaacctctccctcaagcacttcaaggagaccggcgagtacccgtccgcgcagcagctctacggctgcacccagaaaacgatctcgggctacatctacgaccagctcaaggaggagtacaaggacatcaacaaggcgaacatgagcaccacgatccaaaagacactcaagaactggaactcccgcaagaaggaaatctggcgcggcgagatgtccatcccgagcttccgctcggacctccccatcgacatccacgggaactcgatccagctcatcaaggagaagggcggcgactacatcgcgtccgtgagcctgttctcctcgaagttcatcaaggagaacgacctccccaacgggaagatcctggtgaagctctccacccggaagcagaacagcatgaaggtcatcctcgaccgcctcatcaactcgacctacagcaagggcgcgtgcatgttgcacaagcacaagaagaagtggtacttgtcgatcacctacaagagcaacatcaaggaggagctgaagttcgacgaggatctcatcatggggatcgacatgggcaagatcaacgtgctgtacttcgcgttcaacaagtcgctggtgcgcggggccatctccggcgaggagatcgaggcgttccgcaagaagatcgagcaccggcgcatctccctgctccgccagggcaagtactgctccggcaaccggatcggcaaggggcgcgagaagcggatcaagcccatcgacgtgctgaacgacaaggtggccaagttccgcaacgcgaccaaccacaagtacgccaactacatcgtgcagcagtgcctcaagtacaactgcgggacgatccaactggaagacctcaaggggatcagcaaggagcagacgttcctcaagaactggacgtacttcgacctccaggagaagatcaagaaccaggcgaaccagtacggggtcaaggtcgtgaagatcgaccccagctacacctcccagcggtgcagcgagtgcgggtacatccacaaggacaaccgccaggaccagtccaccttcgagtgcctccagtgctcgttcaaggtgcacgccgactacaacgcggccaagaacatcagcgtgtacaacatcgagaaggtgatccagaaacagctggaactccaagagaagctgaacctcaccaagtacaaggagcactacatcgagcagatgaagaacatcaactga

SEQ ID NO: 2369 - DNA, 1353 bp, Unknown
  Bacillus sp. multi
ctcagcctggcggtgaaggtgatgaagtaccagatcgtgtgcccggtcaacgtggagtggaaggtcttcgagacctacctccgcacgctgtcctaccagtcccgcaccatcgggaaccgcaccatccagaaaatctgggagttcgacaacctcagcctcaagcacttcaaggagaccggggagtacccctcggcccagcagctctacggctgcacgcaaaagaccatctcggggtacatctacgaccagctcaaggaggagtacaaggacatcaacaaggccaacatgagcacgaccatccagaaaacgctcaagaactggaactcccgcaagaaggagatatggcggggcgagatgtccatcccgagcttccggtcggacctccccatcgacatccacggcaactcgatccagctcatcaaggagaagggcggcgactacatcgcctccgtgtccctgttcagcagcaagttcatcaaggagaacgacctccccaacggcaagatcctggtgaagctctcgacccggaagcagaacagcatgaaggtgatcctggaccggctcatcaactccacgtacagcaagggcgcgtgcatgttgcacaagcacaagaagaaatggtatctgagcatcacctacaagagcaacatcaaggaggagcttaagttcgacgaggacctgataatggggatcgacatggggaagatcaacgtgctctacttcgccttcaacaagtcgctggtgcgcggcgcgatcagcggggaggagatcgaggcgttccgcaagaaaatcgagcaccgccgcatctcgctgctccgccagggcaagtactgctccggcaaccggatcggcaagggccgggagaagcggatcaagcccatcgacgtgctgaacgacaaggtggccaagttccgcaacgcgaccaaccacaagtacgcgaactacatcgtccagcagtgcctcaagtacaactgcggcaccatccagttggaggacttgaaggggatctcgaaggagcagaccttcctcaagaactggacctacttcgacctccaggagaagatcaagaaccaggccaaccagtacggggtcaaggtggtcaagatcgacccgagctacacgagccagcggtgctcggagtgcggctacatccacaaggacaaccgccaggaccagtccaccttcgagtgcctccagtgcagcttcaaggtccacgccgactacaacgccgccaagaacatctcggtgtacaacatcgagaaggtgatccagaagcaactcgagctccaggagaagctgaacctgaccaagtacaaggagcactacatcgagcagatgaagaacatcaactga

SEQ ID NO: 2370 - DNA, 1353 bp, Unknown
  Bacillus sp. multi
ctgtccatcgcggtcaaggtgatgaagtaccagatcgtctgcccggtgaacatcgagtggaagacgttcgagatctacctccggacgctctcgtaccacttccgcaccatcggcaaccggaccatccagaagctgtgggagtacgacaaccagagcctcaagcacttcaaggacaccggccagtacccgtcggcgcagcagctctacgggtgcacgcagaaaacgatcagcgggtacatctacgaccagctcaaggaggagtaccaggacatcaacaaggccaacatgagcacgaccctccagaaaaccatcaagacctggaactcccgcaagaaggagatctggagcggcgagatgagcatccccagcttccggaacaacctgcccatcgacatccacgggaactccatccagatcatcaaggagaagtcgggcgactacatcgccagcgtgtcgctgttctccagcaagttcatcaaggagaacgacctccccaacggcaagatcctggtcaagctctccacccgcaagcagaacagcatgaaggtgatcctggaccggatcatcgactcgacctacgcgaagggcgcgtgcatgctgcacaagcacaagaagaagtggtacttgtcgatcacctacaagtccaacatcaaggaggagctcaagttcgacgaggacctgatcatgggcatcgacatggggaagatcaacgtcctctacttcgccttcaacaagggcctcgtgcgcggggcgatctccggggaggagatcgaggcgttccgcaagaagatcgagcaccggcgcatcagcctcctgcgccaggggaaatactgctcgggcaaccggatcgggaagggccgcaagaagcggatcaagcccatcgaggtgctgaacgacaagatcgccaagttccgcaacgcgaccaaccacaagtacgccaactacatcgtccagcagtgcctcaagtacaactgcgggacgatccagctagaggacctccaggggatcagcaaggagcagaccttcctcaagaactggacctacttcgacctccaggagaagatcaagaacctggccaaccagtacggcatcaaggtggtcaagatcgacccgtcctacacctcccagcggtgctcggagtgcgggtacatccacaagaacaaccggcagaaccagtccacgttcgagtgccagcagtgctcgttcaaggtgcacgcggactacaacgcggccaagaacatcagcgtgtacaacatcgagaaggtgatccagaagcagctcaagctccaggagaagctcaacctcacgaagtacaaggagcagtacatcgagcagatggagaacatcaactag

SEQ ID NO: 2371 - DNA, 1353 bp, Unknown
  Bacillus sp. multi
ctgtccatcgccgtgaaggtgatgaagtaccagatcgtgtgcccggtcaacatcgagtggaagaccttcgagatctacctccggaccctctcctaccacttccgcaccatcgggaaccgcacgatccagaagctctgggagtacgacaaccagtccctcaagcacttcaaggacaccggccagtaccccagcgcgcagcagctctacggctgcacgcagaaaaccatctccggctacatctacgaccagctcaaggaggagtaccaggacatcaacaaggccaacatgagcaccaccctccagaagaccatcaagacgtggaactcgcgcaagaaggagatctggagcggggagatgtccatcccgtccttccggaacaacctgcccatcgacatccacggcaactccatccagatcatcaaggagaagtccggggactacatcgcctccgtcagcctgttctcctccaagttcatcaaggagaacgacctgccgaacggcaagatcctggtgaagctgtccacgcggaagcagaactcgatgaaggtgatcctggaccggatcatcgacagcacctacgcgaagggcgcgtgcatgctgcacaagcacaagaagaagtggtacctgtccatcacctacaagtcgaacatcaaggaggagctgaagttcgacgaggacctcattatggggatcgacatgggcaagatcaacgtgctctacttcgcgttcaacaaggggctcgtccggggcgcgatcagcggggaggagatcgaggcgttccgcaagaagatcgagcaccgccggatctcgctgctgcgccaggggaagtactgttcgggcaaccggatcggcaagggccgcaagaagcgcatcaagcccatcgaggtgctgaacgacaagatcgccaagttccgcaacgcgaccaaccacaagtacgcgaactacatcgtccagcagtgcctcaagtacaactgcgggacgatacagctcgaagacctccagggcatcagcaaggagcagaccttcctcaagaactggacctacttcgacctccaggagaagatcaagaacctggccaaccagtacgggatcaaggtcgtgaagatcgacccctcctacacgagccagcggtgctcggagtgcggctacatccacaagaacaaccgccagaaccagtccacgttcgagtgccagcagtgctccttcaaggtccacgccgactacaacgcggccaagaacatctccgtgtacaacatcgagaaggtcatccagaagcagctcaagctccaggagaagctgaacctgaccaagtacaaggagcagtacatcgagcagatggagaacatcaactag

SEQ ID NO: 2372 - DNA, 1353 bp, Unknown
  Bacillus sp. multi
ctgtccatcgccgtgaaggtgatgaagtaccagatcgtgtgcccggtgaacatcgagtggaagacgttcgagatctacctgcggacgctctcgtaccacttccgcaccatcggcaaccggacgatccagaagctgtgggagtacgacaaccagtccctcaagcacttcaaggacaccggccagtacccctcggcccagcagctctacggctgcacgcagaaaacgatctccggctacatctacgaccagctcaaggaggagtaccaggacatcaacaaggccaacatgagcacgaccctccagaagaccatcaagacctggaacagccgcaagaaggagatctggagcggcgagatgtccatcccgtccttccggaacaacctccccatcgacatccacgggaactccatccagatcatcaaggagaagtccggggactacatcgcgtccgtctccctgttcagcagcaagttcatcaaggagaacgacctcccgaacggcaagatcctggtcaagctgagcacccgcaagcagaacagcatgaaggtgatcctggaccggatcatcgactccacgtacgcgaagggcgcgtgcatgctgcacaagcacaagaagaagtggtatctctccatcacgtacaagtccaacatcaaggaggagttgaagttcgacgaggatcttatcatggggatcgacatggggaagatcaacgtgctgtacttcgccttcaacaagggcctcgtgcgcggggcgatctcgggcgaggagatcgaggcgttccgcaagaagatcgagcaccggcggatctccctgctccgccagggcaagtactgctcgggcaaccgcatcgggaagggccgcaagaagcgcatcaagcccatcgaggtgctgaacgacaagatcgccaagttccgcaacgcgacgaaccacaagtacgcgaactacatcgtccagcagtgcctcaagtacaactgcggcacgatccagctcgaggacctccaggggatcagcaaggagcagacgttcctcaagaactggacctacttcgacctccaggagaagatcaagaacctggccaaccagtacgggatcaaggtcgtgaagatcgacccctcctacacctcccagcgctgctcggagtgcggctacatccacaagaacaaccggcagaaccagagcacgttcgagtgccagcagtgcagcttcaaggtccacgccgactacaacgccgccaagaacatctcggtgtacaacatcgagaaggtcatccagaagcagctcaagctccaggagaagctgaacctcacgaagtacaaggagcagtacatcgagcagatggagaacatcaactag

SEQ ID NO: 2373 - DNA, 1353 bp, Unknown
  Bacillus sp. multi
ctgtccatcgcggtcaaggtcatgaagtaccagatcgtgtgccccgtgaacatcgagtggaagaccttcgagatctacctgcggacgctcagctaccacttccgcaccatcggcaaccgcacgatccagaagctgtgggagtacgacaaccagagcctcaagcacttcaaggacaccggccagtacccctcggcccagcagctctacggctgcacgcagaagaccatcagcgggtacatctacgaccagctcaaggaggagtaccaggacatcaacaaggcgaacatgagcaccaccctccagaagacgatcaagacgtggaactcccgcaagaaggagatctggagcggcgagatgagcatcccgtccttccgcaacaacctccccatcgacatccacggcaactcgatccagatcatcaaggagaagtccggcgactacatcgcctcggtcagcctcttcagcagcaagttcatcaaggagaacgacctccccaacggcaagatcctggtgaagctcagcacccgcaagcagaactccatgaaggtgatcctggaccggatcatcgactccacctacgcgaagggcgcgtgcatgctgcacaagcacaagaagaagtggtacctctccatcacgtacaagagcaacatcaaggaggagctcaagttcgacgaagatctgatcatgggcatcgacatgggcaagatcaacgtgctgtacttcgccttcaacaaggggctcgtgcggggcgcgatctcgggcgaggagatcgaggcgttccgcaagaaaatcgagcaccgccggatctcgctgctccgccagggcaagtattgctcgggcaaccggatcgggaaggggcgcaagaagcggatcaagcccatcgaggtgctgaacgacaagatcgccaagttccgcaacgccacgaaccacaagtacgccaactacatcgtgcagcagtgcctcaagtacaactgcgggacgatccagctcgaagacctccagggcatcagcaaggagcagaccttcctcaagaactggacctacttcgacctccaggagaagatcaagaacctcgccaaccagtacgggatcaaggtcgtgaagatcgacccgtcctacacgagccagcggtgctccgagtgcggctacatccacaagaacaaccgccagaaccagagcacgttcgagtgccagcagtgctccttcaaggtgcacgcggactacaacgcggccaagaacatctcggtgtacaacatcgagaaggtcatccagaagcagctcaagctccaggagaagctcaacctgaccaagtacaaggagcagtacatcgagcagatggagaacatcaactga

SEQ ID NO: 2374 - DNA, 1353 bp, Unknown
  Bacillus sp. multi
ctctccatcgcggtcaaggtcatgaagtaccagatcgtgtgcccggtcaacatcgagtggaagaccttcgagatatacctccgcaccctgtcctaccacttccgcaccatcggcaaccgcacgatccagaagctgtgggagtacgacaaccagtccctcaagcacttcaaggacacgggccagtacccgagcgcccagcagctctacggctgcacgcagaaaaccatctccggctacatctacgaccagctcaaggaggagtaccaggacatcaacaaggccaacatgagcaccaccctccagaagaccatcaagacctggaactcccgcaagaaggagatctggagcggcgagatgtccatcccctccttccgcaacaacctccccatcgacatccacgggaactccatccagatcatcaaggagaagtcgggcgactacatcgccagcgtgtcgctgttctcgtccaagttcatcaaggagaacgacctcccgaacgggaagatcctggtcaagctgagcacccgcaagcagaactcgatgaaggtcatcctggaccgcatcatcgactccacgtacgcgaagggcgcgtgcatgctccacaagcacaagaagaagtggtacctcagcatcacgtacaagagcaacatcaaggaggagctgaagttcgacgaggatctcatcatggggatcgacatgggcaagatcaacgtgctgtacttcgccttcaacaaggggctcgtgcggggcgcgatctccggggaggagatcgaggcgttccgcaagaagatcgagcaccggcgcatctcgctgctccgccaggggaagtactgctccggcaaccgcatcggcaagggccgcaagaagcggatcaagcccatcgaggtgctgaacgacaagatcgccaagttccgcaacgccacgaaccacaagtacgccaactacatcgtgcagcagtgcctcaagtacaactgcgggacgatccagctcgaggatctacagggcatcagcaaggagcagaccttcctcaagaactggacgtacttcgacctccaggagaagatcaagaacctggcgaaccagtacgggatcaaggtcgtgaagatcgacccgagctacaccagccagcgctgctcggagtgcgggtacatccacaagaacaaccggcagaaccagagcacgttcgagtgccagcagtgctcgttcaaggtccacgccgactacaacgccgccaagaacatctccgtgtacaacatcgagaaggtcatccagaagcagctcaagctccaggagaagctcaacctcaccaagtacaaggagcagtacatcgagcagatggagaacatcaactga

SEQ ID NO: 2375 - DNA, 1353 bp, Bacillus thuringiensis
ctgtccatcgccgtcaaggtgatgaagtaccagatcgtgtgcccggtcaacatcgagtggaagaccttcgagatctacctccggacgctctcctaccacttccgcaccatcgggaaccggacgatccagaagctgtgggagtacgacaaccagtccctcaagcacttcaaggacaccggccagtaccccagcgcgcagcagctctacggctgcacgcagaaaaccatcagcggctacatctacgaccagctcaaggaggagtaccaggacatcaacaaggcgaacatgagcaccaccctccagaaaactatccggacctggaactcccgcaagaaggaaatctggagcggggagatgtccatccccagcttccgcaacaacctccccatcgacatccacggcaactccatccagatcatcaaggagaagtccggggactacatcgcgtcggtgtccctgttctccagcaagttcatcaaggagaacgacctcccgaacggcaagatcctggtgaagctctccacgcgcaagcagaactccatgaaggtgatcctcgaccgcatcatcgactccacctacgcgaagggcgcgtgcatgctccacaagcacaagaagaagtggtacctctccatcacgtacaagagcaacatcaaggaggagttgaagttcgacgaggacctgattatgggcatcgacatgggcaagatcaacgtcctctacttcgcgttcaacaagggcctggtgcgcggggcgatcagcggcgaggagatcgaggcgttccgcaagaagatcgagcaccggcgcatctccctcctgcgccaggggaagtattgctcgggcaaccggatcgggaagggccgcgagaagcgcatcaagcccatcgacgtcctcaacgacaaggtggccaagttccgcaacgccacgaaccacaagtacgccaactacatcgtccagcagtgcctcaagtacaactgcggcaccatccagctcgaggatctgaaggggatctcgaaggagcagaccttcctcaagaactggacctacttcgacctccaggagaagatcaagaaccaggccaaccagtacgggatgaaggtggtgaagatcgacccctcctacacctcccagcgctgctcggagtgcgggtacatccacaagaacaaccgccaggaccagagcacgttcgagtgccagcagtgcagcttcaaggtccacgcggactacaacgccgccaagaacatctcggtgtacaacatcgagaaggtcatccagaagcagctcgaactccaggagaagctgaaccagacgaagtacaaggagcagtacatcgagcagatgaagaacatcaactag

SEQ ID NO: 2376 - DNA, 1353 bp, Bacillus thuringiensis
ctctccatcgcggtgaaggtgatgaagtaccagatcgtgtgcccggtgaacatcgagtggaagaccttcgaaatctacctccggaccctctcgtaccacttccgcaccatcgggaaccgcaccatccagaagctgtgggagtacgacaaccagtccctcaagcacttcaaggacaccggccagtacccctccgcgcagcagctctacggctgcacccagaagaccatctcggggtacatctacgaccagctcaaggaggagtaccaggacatcaacaaggccaacatgagcaccaccctccagaaaacgatccggacctggaactcccgcaagaaggagatatggagcggcgagatgagcatcccctcgttccgcaacaacctccccatcgacatccacgggaacagcatccagatcatcaaggagaagtccggcgactacatcgccagcgtctccctgttcagcagcaagttcatcaaggagaacgacctccccaacgggaagatcctggtcaagctctccacccgcaagcagaacagcatgaaggtcatcctggaccggatcatcgacagcacctacgcgaagggcgcgtgcatgctacacaagcacaagaagaagtggtatctttccatcacctacaagtccaacatcaaggaggagctgaagttcgacgaggatctcatcatgggcatcgacatgggcaagatcaacgtgctgtacttcgccttcaacaagggcctcgtgcggggcgcgatctcgggcgaggagatcgaggcgttccgcaagaagatcgagcaccgccgcatcagcctcctccgccaggggaagtactgctccggcaaccgcatcggcaagggccgggagaagcggatcaagcccatcgacgtcctgaacgacaaggtggccaagttccgcaacgcgaccaaccacaagtacgccaactacatcgtccagcagtgcctcaagtacaactgcggcaccatccagctcgaagacctgaaggggatcagcaaggagcagaccttcctcaagaactggacctacttcgacctccaggagaagatcaagaaccaggccaaccagtacggcatgaaggtcgtgaagatcgacccctcctacacctcccagcggtgcagcgagtgcggctacatccacaagaacaaccgccaggaccagtccacgttcgagtgccagcagtgcagcttcaaggtccacgccgactacaacgccgccaagaacatcagcgtgtacaacatcgagaaggtgatccagaagcagttggagctgcaggagaagctgaaccagacgaagtacaaggagcagtacatcgagcagatgaagaacatcaactga

SEQ ID NO: 2377 - DNA, 1353 bp, Bacillus thuringiensis
ctctccatcgcggtgaaggtgatgaagtaccagatcgtgtgcccggtgaacatcgagtggaagaccttcgagatctacctccggaccctctcctaccacttccgcaccatcggcaaccgcacgatccagaagctctgggagtacgacaaccagtccctcaagcacttcaaggacacggggcagtacccgagcgcccagcagctctacggctgcacgcagaaaacgatcagcgggtacatctacgaccagctcaaggaggagtaccaggacatcaacaaggccaacatgagcaccaccctccagaaaacgatccgcacctggaactcgcgcaagaaggagatctggagcggcgagatgtccatccccagcttccggaacaacctgcccatcgacatccacgggaactccatccagatcatcaaggagaagtccggggactacatcgccagcgtgagcctgttctcctccaagttcatcaaggagaacgacctgccgaacggcaagatcctggtcaagctcagcacgcggaagcagaacagcatgaaggtcatcctcgaccgcatcatcgactccacgtacgcgaagggcgcgtgcatgctccacaagcacaagaagaagtggtacctcagcatcacctacaagtcgaacatcaaggaggagctcaagttcgacgaggacctcattatgggcatcgacatggggaagatcaacgtcctgtacttcgccttcaacaagggcctggtgcgcggggcgatcagcggcgaggagatcgaggcgttccgcaagaagatagagcaccgccggatcagcctgctccgccaggggaagtattgctcgggcaaccggatcggcaagggccgcgagaagcgcatcaagcccatcgacgtcctgaacgacaaggtggccaagttccgcaacgccaccaaccacaagtacgccaactacatcgtgcagcagtgcctcaagtacaactgcgggaccatccagttggaggaccttaaggggatcagcaaggagcagaccttcctcaagaactggacctacttcgacctccaggagaagatcaagaaccaggcgaaccagtacggcatgaaggtggtgaagatcgacccctcctacaccagccagcggtgcagcgagtgcggctacatccacaagaacaaccgccaggaccagagcacgttcgagtgccagcagtgcagcttcaaggtgcacgccgactacaacgcggccaagaacatctcggtgtacaacatcgagaaggtcatccagaagcagctcgaactgcaggagaagctgaaccagacgaagtacaaggagcagtacatcgagcagatgaagaatatcaactga

SEQ ID NO: 2378 - DNA, 1353 bp, Bacillus thuringiensis
ctcagcatcgcggtgaaggtcatgaagtaccagatcgtgtgccccgtgaacatcgagtggaagaccttcgagatatacctccggacgctctcctaccacttccgcaccatcggcaaccggaccatccagaagctctgggagtacgacaaccagagcctcaagcacttcaaggacaccgggcagtacccgtccgcgcagcagctctacgggtgcacgcagaagaccatctcgggctacatctacgaccagctcaaggaggagtaccaggacatcaacaaggccaacatgagcaccaccctccagaaaaccatccgcacgtggaactcccgcaagaaggagatttggagcggcgagatgagcatcccctcgttccgcaacaacctgcccatcgacatccacggcaactccatccagatcatcaaggagaagtccggcgactacatcgccagcgtcagcctgttctccagcaagttcatcaaggagaacgacctccccaacgggaagatcctggtgaagctcagcacgcgcaagcagaactccatgaaggtgatcctcgaccggatcatcgacagcacgtacgcgaagggcgcgtgcatgctgcacaagcacaagaagaagtggtacctcagcatcacctacaagtccaacatcaaggaggagttgaagttcgacgaggacttgatcatggggatcgacatggggaagatcaacgtgctctacttcgccttcaacaagggcctggtgcgcggcgcgatctccggggaggagatcgaggcgttccgcaagaaaatcgagcaccggcgcatctccctcctccgccaggggaagtattgctccggcaaccgcatcggcaagggccgcgagaagcggatcaagcccatcgacgtgctgaacgacaaggtggcgaagttccgcaacgcgacgaaccacaagtacgccaactacatcgtccagcagtgcctcaagtacaactgcggcaccatccagctcgaggacctcaaggggatctcgaaggagcagacgttcctcaagaactggacgtacttcgacctccaggagaagatcaagaaccaggccaaccagtacggcatgaaggtggtcaagatcgacccgagctacacctcccagcgctgctcggagtgcgggtacatccacaagaacaaccgccaggaccagagcacgttcgagtgccagcagtgcagcttcaaggtccacgccgactacaacgcggccaagaacatctcggtgtacaacatcgagaaggtgatccagaagcagctcgaactacaggagaagctgaaccagaccaagtacaaggagcagtacatcgagcagatgaagaacatcaactga

SEQ ID NO: 2379 - DNA, 1353 bp, Bacillus thuringiensis
ctgtccatcgcggtgaaggtcatgaagtaccagatcgtgtgcccggtcaacatcgagtggaagaccttcgagatctacctgcggaccctctcctaccacttccgcaccatcgggaaccggaccatccagaagctctgggagtacgacaaccagtcgctcaagcacttcaaggacaccggccagtacccgtcggcccagcagctctacggctgcacccagaagaccatcagcggctacatctacgaccagctcaaggaggagtaccaggacatcaacaaggcgaacatgagcaccaccctccagaaaaccatccgcacctggaacagccgcaagaaggagatatggagcggcgagatgagcatccccagcttccgcaacaacctgcccatcgacatccacggcaactccatccagatcatcaaggagaagtccggcgactacatcgcctccgtctcgctgttctcgtccaagttcatcaaggagaacgacctgcccaacggcaagatcctggtgaagctgagcacgcggaagcagaacagcatgaaggtgatcctggaccgcatcatcgacagcacctacgcgaagggcgcgtgcatgctgcacaagcacaagaagaagtggtacctgtcgatcacctacaagagcaacatcaaggaggagctgaagttcgacgaagacctaatcatgggcatcgacatgggcaagatcaacgtcctctacttcgccttcaacaagggcctcgtgcggggcgcgatcagcggcgaggagatcgaggcgttccgcaagaaaatagagcaccgccggatcagcctgctgcgccaggggaagtactgctccggcaaccgcatcggcaagggccgggagaagcggatcaagcccatcgacgtgctcaacgacaaggtggccaagttccgcaacgccaccaaccacaagtacgcgaactacatcgtccagcagtgcctcaagtacaactgcggcaccatccagttggaggatctgaaggggatcagcaaggagcagacgttcctcaagaactggacctacttcgacctccaggagaagatcaagaaccaggccaaccagtacgggatgaaggtggtgaagatcgacccgagctacaccagccagcggtgctcggagtgcggctacatccacaagaacaaccgccaggaccagagcacgttcgagtgccagcagtgctccttcaaggtgcacgcggactacaacgccgccaagaacatcagcgtgtacaacatcgagaaggtgatccagaagcagcttgagctccaggagaagctgaaccagaccaagtacaaggagcagtacatcgagcagatgaagaacatcaactga

SEQ ID NO: 2380 - DNA, 1353 bp, Unknown
  Bacillus sp. multi
ctctccatcgccgtgaaggtgatgaagtaccagatcgtgtgccccgtgaacatcgagtggaagaccttcgagatctatctccggacgctcagctaccacttccgcaccatcggcaaccgcaccatccagaagctctgggagtacgacaaccagtccctcaagcacttcaaggacacgggccagtaccccagcgcccagcagctctacggctgcacccagaagacgatcagcggctacatctacgaccagctcaaggaggagtaccaggacatcaacaaggccaacatgagcaccaccctccagaagaccatccggacgtggaactcgcgcaagaaggagatctggagcggcgagatgagcatcccgagcttccggaacaacctccccatcgacatccacgggaactccatccagatcatcaaggagaagtccggggactacatcgccagcgtctccctgttctcgtccaagttcatcaaggagaacgacctgccgaacgggaagatcctggtgaagctgtccacccggaagcagaactccatgaaggtgatcctggaccggatcatcgacagcacgtacgcgaagggcgcgtgcatgttgcacaagcacaagaagaagtggtacctctccatcacgtacaagtccaacatcaaggaggagcttaagttcgacgaggacctgataatgggcatcgacatgggcaagatcaacgtcctctacttcgcgttcaacaagggcctcgtgcgcggggccatctccggggaggagatcgaggcgttccgcaagaagatcgagcaccgccgcatctcgctcctgcgccagggcaaatactgctccggcaaccggatcgggaagggccgcgagaagcggatcaagcccatcgacgtcctgaacgacaaggtggccaagttccgcaacgccacgaaccacaagtacgcgaactacatcgtccagcagtgcctcaagtacaactgcgggacgatccaactcgaagacctcaaggggatctcgaaggagcagaccttcctcaagaactggacctacttcgacctccaggagaagatcaagaaccaggcgaaccagtacggggtgaaggtcgtgaagatcgacccctcctacaccagccagcgctgctccgagtgcggctacatccacaagaacaaccgccaggaccagagcacgttcgagtgccagcagtgcagcttcaaggtgcacgcggactacaacgcggccaagaacatcagcgtgtacaacatcgagaaggtgatccagaagcaactggagctacaggagaagctgaaccagaccaagtacaaggagaagtacatcgagcagatgaagaacatcaactga

SEQ ID NO: 2381 - DNA, 1353 bp, Unknown
  Bacillus sp. multi
ctgtccatcgccgtgaaggtcatgaagtaccagatcgtctgcccggtgaacatcgagtggaagaccttcgagatatacctgcggaccctctcgtaccacttccggaccatcggcaaccgcaccatccagaagctctgggagtacgacaaccagagcctcaagcacttcaaggacacgggccagtacccgtccgcgcagcagctctacgggtgcacgcagaagactatcagcggctacatctacgaccagctcaaggaggagtaccaggacatcaacaaggccaacatgagcacgaccctccagaagacaatccgcacgtggaactcgcgcaagaaggaaatctggagcggcgagatgagcatcccctccttccggaacaacctgcccatcgacatccacgggaacagcatccagatcatcaaggagaagtccggcgactacatcgcctccgtgtccctgttctccagcaagttcatcaaggagaacgacctcccgaacggcaagatcctggtgaagctcagcacccggaagcagaactccatgaaggtgatcctcgaccgcatcatcgacagcacctacgcgaagggcgcgtgcatgctgcacaagcacaagaagaaatggtacctgtccatcacctacaagagcaacatcaaggaggagctcaagttcgacgaggacctcatcatgggcatcgacatggggaagatcaacgtcctgtacttcgcgttcaacaaggggctcgtgcggggcgcgatcagcggcgaggagatcgaggcgttccgcaagaagatcgagcaccggcggatctccctgctccgccaggggaagtactgctccgggaaccgcatcggcaagggccgcgagaagcggatcaagcccatcgacgtgctgaacgacaaggtggcgaagttccgcaacgcgacgaaccacaagtacgccaactacatcgtgcagcagtgcctcaagtacaactgcgggaccatacagctcgaagacctcaaggggatcagcaaggagcagaccttcctcaagaactggacctacttcgacctccaggagaagatcaagaaccaggccaaccagtacggggtgaaggtcgtcaagatcgaccccagctacaccagccagcgctgctccgagtgcgggtacatccacaagaacaaccgccaggaccagtccacgttcgagtgccagcagtgcagcttcaaggtccacgccgactacaacgccgccaagaacatctcggtgtacaacatcgagaaggtcatccagaagcagcttgaactccaggagaagctcaaccagacgaagtacaaggagaagtacatcgagcagatgaagaacatcaactga

SEQ ID NO: 2382 - DNA, 1353 bp, Unknown
  Bacillus sp. multi
ctgtccatcgccgtgaaggtgatgaagtaccagatcgtctgcccggtcaacatcgagtggaagaccttcgagatctacctccggacgctgagctaccacttccgcaccatcgggaaccgcaccatccagaagctctgggagtacgacaaccagtccctcaagcacttcaaggacacgggccagtacccctccgcccagcagctctacggctgcacgcagaaaactatcagcggctacatctacgaccagctcaaggaggagtaccaggacatcaacaaggcgaacatgagcacgaccctccagaaaacgatccggacctggaactcgcgcaagaaggagatctggagcggcgagatgagcatccccagcttccggaacaacctgcccatcgacatccacgggaactcgatccagatcatcaaggagaagtcgggcgactacatcgccagcgtcagcctcttcagcagcaagttcatcaaggagaacgacctccccaacggcaagatcctggtcaagctgtccacccgcaagcagaacagcatgaaggtgatcctggaccgcatcatcgacagcacctacgcgaagggcgcgtgcatgctccacaagcacaagaagaagtggtacctctccatcacctacaagagcaacatcaaggaggagcttaagttcgacgaggacctaatcatggggatcgacatggggaagatcaacgtgctctacttcgccttcaacaaggggctggtgcgcggcgcgatcagcggggaggagatcgaggcgttccgcaagaaaatcgagcaccgccggatctccctgctgcgccagggcaagtactgctcgggcaaccggatcggcaagggccgggagaagcggatcaagcccatcgacgtgctcaacgacaaggtggccaagttccgcaacgcgaccaaccacaagtacgccaactacatcgtccagcagtgcctcaagtacaactgcggcacgatacagttggaggacctcaaggggatcagcaaggagcagaccttcctcaagaactggacctacttcgacctccaggagaagatcaagaaccaggccaaccagtacggcgtcaaggtggtcaagatcgacccgtcctacacgagccagcggtgctcggagtgcggctacatccacaagaacaaccgccaggaccagtccaccttcgagtgccagcagtgctccttcaaggtgcacgccgactacaacgcggccaagaacatctccgtgtacaacatcgagaaggtcatccagaagcagctggagttgcaggagaagctgaaccagaccaagtacaaggagaagtacatcgagcagatgaagaacatcaactga

SEQ ID NO: 2383 - DNA, 1353 bp, Unknown
  Bacillus sp. multi
ctgagcatcgccgtgaaggtgatgaagtaccagatcgtctgccccgtcaacatcgagtggaagaccttcgagatctacctccggacgctctcctaccacttccgcaccatcgggaaccgcaccatccagaagctctgggagtacgacaaccagtcgctcaagcacttcaaggacacgggccagtaccccagcgcgcagcagctctacggctgcacccagaaaaccatcagcggctacatctacgaccagctcaaggaggagtaccaggacatcaacaaggcgaacatgagcacgaccctccagaagacgatccgcacctggaacagccgcaagaaggagatctggagcggggagatgagcatcccctccttccggaacaacctccccatcgacatccacggcaacagcatccagatcatcaaggagaagtccggggactacatcgcgtccgtgagcctgttcagcagcaagttcatcaaggagaacgacctgcccaacgggaagatcctggtcaagctctccacgcggaagcagaacagcatgaaggtgatcctggaccgcatcatcgactcgacctacgcgaagggcgcgtgcatgcttcacaagcacaagaagaaatggtacctgtccatcacctacaagtccaacatcaaggaggagctcaagttcgacgaagaccttatcatgggcatcgacatgggcaagatcaacgtcctgtacttcgccttcaacaaggggctcgtgcgcggggccatcagcggggaggagatcgaggcgttccgcaagaagatcgagcaccgccgcatcagcctgctgcgccagggcaagtactgctcggggaaccgcatcggcaagggccgcgagaagcgcatcaagcccatcgacgtcctcaacgacaaggtggccaagttccgcaacgccacgaaccacaagtacgccaactacatcgtgcagcagtgcctcaagtacaactgcgggaccatccagttggaggatctcaaggggatcagcaaggagcagaccttcctcaagaactggacctacttcgacctccaggagaagatcaagaaccaggcgaaccagtacggggtcaaggtggtcaagatcgacccgagctacacctcgcagcggtgcagcgagtgcgggtacatccacaagaacaaccgccaggaccagagcaccttcgagtgccagcagtgctcgttcaaggtgcacgccgactacaacgccgccaagaacatctccgtgtacaacatcgagaaggtcatccagaagcaactagagctccaggagaagctgaaccagaccaagtacaaggagaagtacatcgagcagatgaagaacatcaactga

SEQ ID NO: 2384 - DNA, 1353 bp, Unknown
  Bacillus sp. multi
ctgtccatcgcggtcaaggtcatgaagtaccagatcgtgtgcccggtgaacatcgagtggaagacgttcgaaatctacctgcggaccctctcgtaccacttccgcaccatcggcaaccggaccatccagaagctgtgggagtacgacaaccagtccctcaagcacttcaaggacacggggcagtacccgtccgcgcagcagctctacgggtgcacgcagaagaccatctccggctacatctacgaccagctcaaggaggagtaccaggacatcaacaaggccaacatgagcaccaccctccagaagaccatccgcacctggaactcgcgcaagaaggaaatctggagcggcgagatgtccatcccctccttccggaacaacctccccatcgacatccacggcaactcgatccagatcatcaaggagaagtccggcgactacatcgcgtccgtgagcctgttcagcagcaagttcatcaaggagaacgacctccccaacggcaagatcctggtcaagctgtccacccggaagcagaactccatgaaggtgatcctggaccgcatcatcgacagcacgtacgcgaagggcgcgtgtatgctccacaagcacaagaagaagtggtacttgtcgatcacctacaagtccaacatcaaggaggagttgaagttcgacgaagacctcatcatgggcatcgacatgggcaagatcaacgtcctgtacttcgcgttcaacaagggcctcgtgcggggcgcgatcagcggcgaggagatcgaggcgttccgcaagaagatcgagcaccgccgcatcagcctcctgcgccagggcaagtactgctccgggaaccggatcggcaaggggcgcgagaagcggatcaagcccatcgacgtcctcaacgacaaggtggcgaagttccgcaacgccaccaaccacaagtacgcgaactacatcgtgcagcagtgcctcaagtacaactgcggcaccatccagttggaggatctcaaggggatcagcaaggagcagacgttcctcaagaactggacgtacttcgacctccaggagaagatcaagaaccaggccaaccagtacggggtcaaggtcgtcaagatcgacccgagctacaccagccagcggtgcagcgagtgcggctacatccacaagaacaaccgccaggaccagagcaccttcgagtgccagcagtgcagcttcaaggtccacgcggactacaacgccgccaagaacatcagcgtgtacaacatcgagaaggtgatccagaagcagctcgagttgcaggagaagctgaaccagaccaagtacaaggagaagtacatcgagcagatgaagaacatcaactga

SEQ ID NO: 2385 - DNA, 1353 bp, Unknown
  Bacillus sp. multi
ctctccatcgccgtgaaggtgatgaagtaccagatcgtgtgccccgtcaacatcgagtggaagaccttcgagatctacctgcggaccctgagctaccacttccgcaccatcggcaaccgcaccatccagaagctctgggagtacgacaaccagtcgctcaagcacttcaaggacaccggccagtacccgtccgcgcagcagctctacggctgcacgcagaagacgatcagcggctacatctacgaccagctcaaggaggagtaccaggacatcaacaaggccaacatgagcacgaccctccagaaaaccatccggacctggaactcccgcaagaaggagatatggagcggcgagatgtccatcccgagcttccgcaacaacctccccatcgacatccacggcaacagcatccagatcatcaaggagaagtcgggcgactacatcgccagcgtctcgctgttcagcagcaagttcatcaaggagaacgacctccccaacgggaagatcctggtcaagctgtccacccggaagcagaactccatgaaggtcatcctggaccgcatcatcgactccacgtacgcgaagggcgcgtgcatgctgcacaagcacaagaagaagtggtacctgagcatcacctacaagagcaacatcaaggaggagctaaagttcgacgaggacttaatcatggggatcgacatggggaagatcaacgtgctgtacttcgccttcaacaaggggctcgtgcgcggcgcgatcagcggcgaggagatcgaggcgttccgcaagaagatcgagcaccgccgcatctcgctcctccgccaggggaagtattgctcggggaaccggatcggcaagggccgcgagaagcgcatcaagcccatcgacgtcctgaacgacaaggtggccaagttccgcaacgccaccaaccacaagtacgcgaactacatcgtgcagcagtgcctcaagtacaactgcggcaccatccagctagaggatctcaaggggatcagcaaggagcagacgttcctcaagaactggacctacttcgacctccaggagaaaatcaagaaccaggcgaaccagtacggcgtcaaggtggtcaagatcgacccctcctacacgagccagcgctgctcggagtgcggctacatccacaagaacaaccgccaggaccagagcacgttcgagtgccagcagtgcagcttcaaggtgcacgccgactacaacgcggccaagaacatctcgctgtacaacatcgagaaggtcatccagaagcagctagagctgcaggagaagctgaaccagaccaagtacaaggagcagtacatcgagcagatgaagaacatcaactag

SEQ ID NO: 2386 - DNA, 1353 bp, Unknown
  Bacillus sp. multi
ctctccatcgccgtcaaggtgatgaagtaccagatcgtgtgccccgtcaacatcgagtggaagaccttcgagatctacctgcggacgctctcctaccacttccggaccatcggcaaccggaccatccagaagctgtgggagtacgacaaccagagcctcaagcacttcaaggacaccgggcagtacccctcggcccagcagctctacgggtgcacgcagaaaaccatcagcggctacatctacgaccagctcaaggaggagtaccaggacatcaacaaggccaacatgagcaccaccctccagaaaacgatccgcacctggaactcccgcaagaaggagatttggagcggcgagatgagcatcccgagcttccgcaacaacctccccatcgacatccacgggaactcgatccagatcatcaaggagaagtccggcgactacatcgcctccgtcagcctgttctccagcaagttcatcaaggagaacgacctccccaacggcaagatcctggtcaagctctccacccgcaagcagaacagcatgaaggtcatcctggaccggatcatcgactccacctacgcgaagggcgcgtgcatgctccacaagcacaagaagaaatggtacctatccatcacctacaagagcaacatcaaggaggagctgaagttcgacgaggacttgatcatgggcatcgacatggggaagatcaacgtcctctacttcgccttcaacaagggcctggtccggggcgcgatctcgggcgaggagatcgaggcgttccgcaagaagatcgagcaccggcgcatcagcctgctgcgccagggcaagtattgctcggggaaccgcatcgggaaggggcgcgagaagcggatcaagcccatcgacgtgctcaacgacaaggtggcgaagttccgcaacgccacgaaccacaagtacgccaactacatcgtgcagcagtgcctcaagtacaactgcgggaccatccagctagaggatcttaaggggatctcgaaggagcagacgttcctcaagaactggacctacttcgacctccaggagaagatcaagaaccaggccaaccagtacggggtcaaggtggtcaagatcgacccctcctacacctcccagcggtgctcggagtgcgggtacatccacaagaacaaccgccaggaccagagcacgttcgagtgccagcagtgcagcttcaaggtccacgcggactacaacgcggccaagaacatcagcctgtacaacatcgagaaggtgatccagaagcagctggagctgcaggagaagctgaaccagaccaagtacaaggagcagtacatcgagcagatgaagaacatcaactga

SEQ ID NO: 2387 - DNA, 1353 bp, Unknown
  Bacillus sp. multi
ctctccatcgccgtgaaggtgatgaagtaccagatcgtgtgcccggtgaacatcgagtggaagacgttcgaaatctacctccggaccctctcctaccacttccgcaccatcggcaaccgcacgatccagaagctgtgggagtacgacaaccagagcctcaagcacttcaaggacacgggccagtacccctccgcgcagcagctctacgggtgcacgcagaaaacgatcagcgggtacatctacgaccagctcaaggaggagtaccaggacatcaacaaggcgaacatgagcaccaccctccagaagacgatccggacctggaactcccgcaagaaggaaatctggagcggcgagatgtccatcccgtccttccgcaacaacctccccatcgacatccacggcaacagcatccagatcatcaaggagaagtccggcgactacatcgcctccgtctcgctgttctcctccaagttcatcaaggagaacgacctgccgaacggcaagatcctggtgaagctgagcacgcgcaagcagaactccatgaaggtcatcctggaccgcatcatcgactccacgtacgcgaagggcgcgtgcatgctccacaagcacaagaagaagtggtatctcagcatcacctacaagagcaacatcaaggaggagttgaagttcgacgaggacctcatcatgggcatcgacatgggcaagatcaacgtcctgtacttcgccttcaacaagggcctcgtgcgcggcgcgatcagcggggaggagatcgaggcgttccgcaagaagatcgagcaccgccggatcagcctgctgcgccaggggaagtactgctcgggcaaccggatcgggaaggggcgggagaagcgcatcaagcccatcgacgtgctcaacgacaaggtggccaagttccgcaacgccacgaaccacaagtacgcgaactacatcgtgcagcagtgcctcaagtacaactgcggcaccatacagctcgaggacttgaaggggatctcgaaggagcagacgttcctcaagaactggacctacttcgacctccaggagaagatcaagaaccaggcgaaccagtacggcgtgaaggtcgtcaagatcgaccccagctacacctcccagcgctgctcggagtgcggctacatccacaagaacaaccgccaggaccagtccaccttcgagtgccagcagtgcagcttcaaggtgcacgcggactacaacgccgccaagaacatcagcctctacaacatcgagaaggtgatccagaagcaactggagctacaggagaaactgaaccagacgaagtacaaggagcagtacatcgagcagatgaagaacatcaactga

SEQ ID NO: 2388 - DNA, 1353 bp, Unknown
  Bacillus sp. multi
ctgagcatcgcggtgaaggtcatgaagtaccagatcgtgtgccccgtgaacatcgagtggaagacgttcgagatctacctccggaccctcagctaccacttccgcaccatcggcaaccgcacgatccagaagctctgggagtacgacaaccagtccctcaagcacttcaaggacaccgggcagtaccccagcgcgcagcagctctacgggtgcacgcagaagacgatcagcggctacatctacgaccagctcaaggaggagtaccaggacatcaacaaggcgaacatgagcacgaccctccagaaaacgatccggacctggaactcccgcaagaaggaaatctggagcggggagatgtccatccccagcttccgcaacaacctgcccatcgacatccacggcaactcgatccagatcatcaaggagaagtcgggcgactacatcgcctccgtgagcctgttctcctccaagttcatcaaggagaacgacctgccgaacgggaagatcctggtcaagctctccacccggaagcagaactccatgaaggtgatcctggaccgcatcatcgactcgacctacgcgaagggcgcgtgcatgctgcacaagcacaagaagaagtggtacctgtccatcacctacaagagcaacatcaaggaggagctcaagttcgacgaggatcttatcatgggcatcgacatgggcaagatcaacgtcctctacttcgccttcaacaagggcctcgtgcgcggcgcgatctccggcgaggagatcgaggcgttccgcaagaagatcgagcaccgccgcatctccctcctccgccagggcaagtactgctccggcaaccgcatcgggaaggggcgcgagaagcgcatcaagcccatcgacgtgctcaacgacaaggtggccaagttccgcaacgccacgaaccacaagtacgcgaactacatcgtgcagcagtgcctcaagtacaactgcggcaccatacagctcgaagacctcaaggggatcagcaaggagcagaccttcctcaagaactggacctacttcgacctccaggagaagatcaagaaccaggcgaaccagtacggggtcaaggtcgtcaagatcgacccgtcctacaccagccagcggtgctccgagtgcggctacatccacaagaacaaccgccaggaccagagcaccttcgagtgccagcagtgctccttcaaggtccacgcggactacaacgcggccaagaacatctccctgtacaacatcgagaaggtcatccagaagcagttggagttacaggagaagctcaaccagaccaagtacaaggagcagtacatcgagcagatgaagaatatcaactga

SEQ ID NO: 2389 - DNA, 1353 bp, Unknown
  Bacillus sp. multi
ctgagcatcgccgtcaaggtcatgaagtaccagatcgtgtgcccggtgaacatcgagtggaagacgttcgagatatacctccggaccctctcgtaccacttccgcaccatcggcaaccgcacgatccagaagctctgggagtacgacaaccagtcgctcaagcacttcaaggacacgggccagtacccctccgcgcagcagctctacggctgcacccagaagacgatcagcggctacatctacgaccagctcaaggaggagtaccaggacatcaacaaggccaacatgagcaccaccctccagaaaacaatccgcacgtggaactcccgcaagaaggagatctggagcggcgagatgtccatcccgagcttccgcaacaacctccccatcgacatccacggcaactcgatccagatcatcaaggagaagtccggcgactacatcgcctcggtgtcgctgttctccagcaagttcatcaaggagaacgacctgcccaacgggaagatcctggtgaagctctccacccggaagcagaactccatgaaggtcatcctcgaccgcatcatcgactcgacctacgcgaagggcgcgtgcatgctgcacaagcacaagaagaagtggtacctctccatcacctacaagagcaacatcaaggaggagctgaagttcgacgaggacctcatcatgggcatcgacatgggcaagatcaacgtgctctacttcgcgttcaacaaggggctcgtgcggggcgcgatcagcggggaggagatcgaggcgttccgcaagaagattgagcaccggcgcatctcgctgctgcgccagggcaagtactgctcgggcaaccgcatcgggaagggccgcgagaagcggatcaagcccatcgacgtgctcaacgacaaggtggccaagttccgcaacgccaccaaccacaagtacgcgaactacatcgtgcagcagtgcctcaagtacaactgcggcacgatccagttggaagaccttaaggggatcagcaaggagcagacgttcctcaagaactggacgtacttcgacctccaggagaagattaagaaccaggccaaccagtacggcgtcaaggtggtcaagatcgacccgagctacacgagccagcggtgctccgagtgcggctacatccacaagaacaaccgccaggaccagtccacgttcgagtgccagcagtgcagcttcaaggtgcacgccgactacaacgccgccaagaacatctcgctgtacaacatcgagaaggtcatccagaagcagctagagctacaggagaagctgaaccagaccaagtacaaggagcagtacatcgagcagatgaagaacatcaactga

SEQ ID NO: 2390 - DNA, 1197 bp, Unknown
  Bacillus sp. multi
ctcaaggacttcaaggacaccgggcagtacccctccgcccagcagctctacggctgcacccagaagacgatctccgggtacatctacgaccagctcaaggaggagtaccaggacatcaacaaggcgaacatgagcaccaccctccagaagaccatcaagacctggaactcccgcaagaaggagatctggagcggggagatgtccatcccgagcttccgcaacaacctgcccatcgacatccacgggaactccatccagatcatcaaggagaagtccggcgactacatcgcctccgtgagcctgttctcctcgaagttcatcaaggagaacgacctgccgaacgggaagatcctggtgaagctgtccacgcggaagcagaactccatgaaggtgatcctggaccggatcatcgacaacacctacgcgaagggcgcgtgcatgctccacaagcacaagaagaagtggtacctctccatcacctacaagtccaacatcaaggaggagctaaagttcgacgaggacctcatcatgggcatcgacatgggcaagatcaacgtcctgtacttcgccttcaacaaggggctggtgcgcggcgggatctccggcgaggagatcgaggcgttccgcaagaagatcgagcaccgccgcatctccctcctccgccagggcaaatactgctccggcaaccgcatcgggaaggggcgcaagaagcggatcaagcccatcgaggtgctgaacgacaagatcgccaagttccgcaacgccaccaaccacaagtacgcgaactacatcgtccagcagtgcctcaagtacaactgcgggaccatccagctcgaggatctccagggcatctcgaaggagcagaccttcctcaagaactggacctacttcgacctccaggagaagatcaagaaccaggcgaaccagtacggcatcaaggtcgtgaagatcgaccccagctacaccagccagcggtgcagcgagtgcggctacatccacaagaacaaccggcagaaccagtccacgttcgagtgccagcagtgcagcttcaaggtgcacgccgactacaacgccgccaagaacatcagcgtgtacaacatcgagaaggtcatccagaagcagctcaagctccaggagaagctcaacctcaccaagtacaaggagcagtacatcgagcagatggagaacatcaactga

SEQ ID NO: 2391 - DNA, 1197 bp, Unknown
  Bacillus sp. multi
ctcaaggacttcaaggacaccggccagtacccgtcggcccagcagctctacggctgcacgcagaagaccatctcgggctacatctacgaccagctcaaggaggagtaccaggacatcaacaaggcgaacatgagcaccaccctccagaagacgatcaagacgtggaacagccgcaagaaggaaatctggagcggcgagatgagcatcccctcgttccgcaacaacctgcccatcgacatccacggcaactccatccagatcatcaaggagaagtcgggcgactacatcgcgtccgtgtccctgttctcctccaagttcatcaaggagaacgacctgcccaacggcaagatcctggtgaagctctccacgcggaagcagaacagcatgaaggtgatcctcgaccgcatcatcgacaacacctacgcgaagggcgcgtgcatgctccacaagcacaagaagaagtggtacctgtccatcacctacaagagcaacatcaaggaggagctgaagttcgacgaggacctcatcatgggcatcgacatgggcaagatcaacgtcctgtacttcgcgttcaacaagggcctcgtgcgcggcgggatctccggcgaggagatcgaggcgttccgcaagaagatcgagcaccggcgcatctccctcctccgccagggcaaatactgctccgggaaccggatcgggaagggccgcaagaagcgcatcaagcccatcgaggtgctgaacgacaagatcgccaagttccgcaacgcgaccaaccacaagtacgcgaactacatcgtccagcagtgcctcaagtacaactgcgggaccatccagctcgaagacctccaggggatcagcaaggagcagacgttcctcaagaactggacctacttcgacctccaggagaagatcaagaaccaggcgaaccagtacggcatcaaggtggtcaagatcgacccgtcctacaccagccagcgctgctccgagtgcgggtacatccacaagaacaaccgccagaaccagagcaccttcgagtgccagcagtgcagcttcaaggtgcacgccgactacaacgccgccaagaacatctcggtgtacaacatcgagaaggtgatccagaagcagctcaagctccaggagaagctcaacctgaccaagtacaaggagcagtacatcgagcagatggagaacatcaactag

SEQ ID NO: 2392 - DNA, 1197 bp, Unknown
  Bacillus sp. multi
ctcaaggacttcaaggacaccggccagtacccgtccgcgcagcagctctacggctgcacccagaaaaccatctcggggtacatctacgaccagctcaaggaggagtaccaggacatcaacaaggccaacatgagcacgaccctccagaagacgatcaagacctggaactcccgcaagaaggagatatggagcggcgagatgagcatcccctccttccgcaacaacctgcccatcgacatccacggcaactccatccagatcatcaaggagaagtcgggcgactacatcgccagcgtcagcctgttcagctcgaagttcatcaaggagaacgacctccccaacgggaagatcctggtgaagctgagcacccgcaagcagaacagcatgaaggtgatcctcgaccgcatcatcgacaacacctacgcgaagggcgcgtgcatgctgcacaagcacaagaagaagtggtacctgtccatcacctacaagtccaacatcaaggaggagctcaagttcgacgaggacctgatcatggggatcgacatgggcaagatcaacgtcctctacttcgcgttcaacaaggggctcgtgcgcggcgggatcagcggcgaggagatcgaggcgttccgcaagaagatcgagcaccgccgcatcagcctcctccgccagggcaagtactgctccggcaaccggatcggcaagggccgcaagaagcgcatcaagcccatcgaggtgctgaacgacaagatcgccaagttccgcaacgccaccaaccacaagtacgcgaactacatcgtccagcagtgcctcaagtacaactgcggcacgatccagctcgaagacctccagggcatcagcaaggagcagacgttcctcaagaactggacgtacttcgacctccaggagaagatcaagaaccaggcgaaccagtacggcatcaaggtcgtcaagatcgacccgagctacaccagccagcgctgctccgagtgcggctacatccacaagaacaaccggcagaaccagtccacgttcgagtgccagcagtgcagcttcaaggtgcacgcggactacaacgccgccaagaacatcagcgtgtacaacatcgagaaggtcatccagaagcagctcaagctccaggagaagctgaacctcaccaagtacaaggagcagtacatcgagcagatggagaacatcaactga

SEQ ID NO: 2393 - DNA, 1197 bp, Unknown
  Bacillus sp. multi
ctcaaggacttcaaggacacggggcagtacccgtccgcgcagcagctctacgggtgcacgcagaagacgatcagcgggtacatctacgaccagctcaaggaggagtaccaggacatcaacaaggccaacatgagcaccaccctccagaagaccatcaagacctggaactcccgcaagaaggagatctggagcggcgagatgtccatcccgtccttccggaacaacctgcccatcgacatccacgggaactccatccagatcatcaaggagaagtcgggcgactacatcgcctccgtgagcctgttcagcagcaagttcatcaaggagaacgacctgccgaacgggaagatcctggtcaagctcagcacccgcaagcagaactccatgaaggtcatcctcgaccgcatcatcgacaacacctacgcgaagggcgcgtgcatgctccacaagcacaagaagaagtggtacctgtccatcacgtacaagtcgaacatcaaggaggagctgaagttcgacgaggacctaatcatgggcatcgacatgggcaagatcaacgtgctctacttcgcgttcaacaaggggctggtgcgcggcggcatctccggcgaggagatcgaggcgttccgcaagaagatcgagcaccgccggatcagcctcctgcgccaggggaaatactgctccgggaaccggatcggcaagggccgcaagaagcgcatcaagcccatcgaggtgctgaacgacaagatcgccaagttccgcaacgcgaccaaccacaagtacgcgaactacatcgtccagcagtgcctcaagtacaactgcggcaccatccagctcgaagacctccagggcatcagcaaggagcagacgttcctcaagaactggacgtacttcgacctccaggagaagatcaagaaccaggcgaaccagtacgggatcaaggtggtgaagatcgacccgagctacaccagccagcgctgctcggagtgcggctacatccacaagaacaaccgccagaaccagagcacgttcgagtgccagcagtgcagcttcaaggtgcacgcggactacaacgccgccaagaacatcagcgtgtacaacatcgagaaggtgatccagaagcagctcaagctccaggagaagctgaacctcacgaagtacaaggagcagtacatcgagcagatggagaacatcaactag

SEQ ID NO: 2394 - DNA, 1197 bp, Unknown
  Bacillus sp. multi
ctcaaggacttcaaggacacgggccagtaccccagcgcccagcagctctacggctgcacccagaagacgatctccggctacatctacgaccagctcaaggaggagtaccaggacatcaacaaggccaacatgagcacgaccctccagaaaacgatcaagacgtggaactcccgcaagaaggagatctggagcggcgagatgtccatcccctccttccgcaacaacctgcccatcgacatccacggcaacagcatccagatcatcaaggagaagtccggggactacatcgcgtcggtgtccctgttctcgtccaagttcatcaaggagaacgacctccccaacggcaagatcctggtcaagctcagcacccgcaagcagaactccatgaaggtgatcctcgaccgcatcatcgacaacacctacgcgaagggcgcgtgcatgctgcacaagcacaagaagaagtggtatctgtccatcacctacaagtccaacatcaaggaggagctcaagttcgacgaggacctcatcatgggcatcgacatggggaagatcaacgtcctgtacttcgcgttcaacaagggcctcgtccggggcggcatctccggcgaggagatcgaggcgttccgcaagaagatcgagcaccgccggatctcgctgctccgccagggcaaatactgctccggcaaccgcatcggcaaggggcgcaagaagcgcatcaagcccatcgaggtgctgaacgacaagatcgccaagttccgcaacgccacgaaccacaagtacgcgaactacatcgtccagcagtgcctcaagtacaactgcggcacgatccagctcgaggacctccagggcatcagcaaggagcagacgttcctcaagaactggacctacttcgacctccaggagaagatcaagaaccaggccaaccagtacggcatcaaggtggtgaagatcgaccccagctacacctcccagcgctgctccgagtgcgggtacatccacaagaacaaccggcagaaccagtccaccttcgagtgccagcagtgcagcttcaaggtccacgccgactacaacgcggccaagaacatctccgtgtacaacatcgagaaggtgatccagaagcagctcaagctccaggagaagctcaacctcacgaagtacaaggagcagtacatcgagcagatggagaacatcaactga

SEQ ID NO: 2395 - DNA, 1353 bp, Unknown
  Bacillus sp. multi
ctctccatcgcggtgaaggtcatgaagtaccagatcgtgtgcccggtcaacatcgagtggaagaccttcgaaatctacctgcggaccctcagctaccacttccggaccatcgggaaccggacgatccagaagctgtgggagtacgacaaccagagcctcaagcacttcaaggacacgggccagtacccgtcggcgcagcagctctacggctgcacccagaagaccatcagcgggtacatctacgaccagctcaaggaggagtaccaggacatcaacaaggccaacatgagcaccaccctccagaagacgatccgcacctggaacagccgcaagaaggaaatctggagcggcgagatgtccatcccctccttccgcaacaacctccccatcgacatccacggcaactccatccagatcatcaaggagaagtcgggcgactacatcgcctccgtgtccctgttcagcagcaagttcatcaaggagaacgacctcccgaacgggaagatcctggtcaagctgtccacgcgcaagcagaactccatgaaggtcatcctggaccggatcatcgactcgacctacgcgaagggcgcgtgcatgctccacaagcacaagaagaagtggtacctgtccatcacctacaagagcaacatcaaggaggagctgaaattcgacgaggatctgatcatgggcatcgacatggggaagatcaacgtcctctacttcgccttcaacaaggggctggtgcgcggcgcgatcagcggcgaggagatcgaggcgttccgcaagaagatcgagcaccgccgcatctcgctcctgcgccagggcaagtactgctccggcaaccgcatcggcaaggggcgcgagaagcgcatcaagcccatcgacgtgctcaacgacaaggtggccaagttccgcaacgcgaccaaccacaagtacgccaactacatcgtgcagcagtgcctcaagtacaactgcggcaccatccagctcgaggacttgaaggggatcagcaaggagcagacgttcctcaagaactggacgtacttcgacctccaggagaagatcaagaaccaggccaacctctacggggtcaaggtcatgaagatcgacccgagctacacctcgcagcggtgctccgagtgcgggtacatccacaagaacaaccgccagaaccagagcacgttcgagtgccagcagtgctcgttcaaggtccacgccgactacaacgcggccaagaacatcagcctctacaacatcgagaaggtgatccagaagcaattggagctgcaggagaagctgaacctcaccaagtacaaggagcagtacatggagcagatgaagaatatcaactag

SEQ ID NO: 2396 - DNA, 1353 bp, Unknown
  Bacillus sp. multi
ctgagcatcgcggtgaaggtcatgaagtaccagatcgtgtgccccgtgaacatcgagtggaagacgttcgagatctacctgcggacgctctcgtaccacttccgcaccatcggcaaccgcaccatccagaagctgtgggagtacgacaaccagagcctcaagcacttcaaggacaccgggcagtacccctcggcgcagcagctctacggctgcacgcagaagactatcagcgggtacatctacgaccagctcaaggaggagtaccaggacatcaacaaggcgaacatgagcacgaccctccagaagacgatccgcacgtggaactcccgcaagaaggagatctggagcggcgagatgagcatcccgagcttccgcaacaacctccccatcgacatccacggcaacagcatccagatcatcaaggagaagtccggggactacatcgcctccgtgagcctgttctccagcaagttcatcaaggagaacgacctccccaacggcaagatcctggtcaagctgtccacccggaagcagaactccatgaaggtgatcctcgaccggatcatcgacagcacctacgcgaagggcgcgtgcatgctccacaagcacaagaagaagtggtacttgtccatcacctacaagtcgaacatcaaggaggagctgaagttcgacgaagacctgatcatggggatcgacatgggcaagatcaacgtcctctacttcgccttcaacaaggggctcgtgcgcggggccatctccggcgaggagatcgaggcgttccgcaagaagatcgagcaccgccggatcagcctgctccgccagggcaaatactgctccggcaaccggatcgggaaggggcgcgagaagcggatcaagcccatcgacgtgctgaacgacaaggtggcgaagttccgcaacgcgaccaaccacaagtacgcgaactacatcgtgcagcagtgcctcaagtacaactgcggcaccatccagctcgaggacttgaaggggatcagcaaggagcagaccttcctcaagaactggacctacttcgacctccaggagaagattaagaaccaggccaacctgtacggcgtgaaggtgatgaagatcgacccgagctacaccagccagcggtgcagcgagtgcggctacatccacaagaacaaccggcagaaccagagcacgttcgagtgccagcagtgcagcttcaaggtgcacgcggactacaacgcggccaagaacatctcgctgtacaacatcgagaaggtgatccagaagcagctcgaactccaggagaaactgaacctcaccaagtacaaggagcagtacatggagcagatgaagaacatcaactag

SEQ ID NO: 2397 - DNA, 1353 bp, Unknown
  Bacillus sp. multi
ctgtccatcgcggtcaaggtgatgaagtaccagatcgtgtgccccgtgaacatcgagtggaagacgttcgagatatacctgcggaccctcagctaccacttccgcaccatcggcaaccgcaccatccagaagctctgggagtacgacaaccagagcctcaagcacttcaaggacaccggccagtacccctccgcccagcagctctacggctgcacccagaaaacgatctcgggctacatctacgaccagctcaaggaggagtaccaggacatcaacaaggcgaacatgagcaccaccctccagaaaacgatccgcacgtggaactcccgcaagaaggaaatctggagcggcgagatgagcatccccagcttccggaacaacctccccatcgacatccacggcaactccatccagatcatcaaggagaagtcgggcgactacatcgcgtcggtgtccctgttctcctcgaagttcatcaaggagaacgacctgccgaacgggaagatcctggtgaagctctcgacccgcaagcagaacagcatgaaggtgatcctggaccggatcatcgacagcacctacgcgaagggcgcgtgcatgctccacaagcacaagaagaagtggtatctctccatcacctacaagagcaacatcaaggaggagcttaagttcgacgaggacctgatcatgggcatcgacatgggcaagatcaacgtgctgtacttcgcgttcaacaagggcctcgtgcgcggcgcgatctccggggaggagatcgaggcgttccgcaagaagatcgagcaccgccgcatcagcctgctccgccagggcaagtactgctccggcaaccggatcggcaagggccgcgagaagcgcatcaagcccatcgacgtcctcaacgacaaggtggccaagttccgcaacgcgacgaaccacaagtacgccaactacatcgtccagcagtgcctcaagtacaactgcgggaccatccagctcgaagacctcaaggggatcagcaaggagcagacgttcctcaagaactggacgtacttcgacctccaggagaagatcaagaaccaggccaacctctacggcgtgaaggtcatgaagatcgaccccagctacacgagccagcgctgctcggagtgcggctacatccacaagaacaaccgccagaaccagagcaccttcgagtgccagcagtgcagcttcaaggtccacgcggactacaacgccgccaagaacatctccctctacaacatcgagaaggtgatccagaagcagctggagctgcaagagaagctgaacctgacgaagtacaaggagcagtacatggagcagatgaagaacatcaactga

SEQ ID NO: 2398 - DNA, 1353 bp, Unknown
  Bacillus sp. multi
ctgagcatcgccgtcaaggtcatgaagtaccagatcgtgtgcccggtcaacatcgagtggaagaccttcgagatctacctccggaccctctcgtaccacttccgcaccatcggcaaccggaccatccagaagctgtgggagtacgacaaccagtcgctcaagcacttcaaggacaccggccagtaccccagcgcccagcagctctacgggtgcacgcagaagaccatctccgggtacatctacgaccagctcaaggaggagtaccaggacatcaacaaggcgaacatgagcaccaccctccagaagaccatccggacctggaacagccgcaagaaggagatatggagcggcgagatgagcatcccgtcgttccgcaacaacctccccatcgacatccacggcaactccatccagatcatcaaggagaagtccggcgactacatcgcctccgtgagcctgttctcctccaagttcatcaaggagaacgacctccccaacgggaagatcctggtcaagctctcgacgcgcaagcagaactcgatgaaggtcatcctggaccggatcatcgactcgacgtacgcgaagggcgcgtgcatgctccacaagcacaagaagaagtggtacttgtccatcacctacaagagcaacatcaaggaggagcttaagttcgacgaggacttaatcatggggatcgacatggggaagatcaacgtcctctacttcgccttcaacaagggcctcgtgcgcggggccatcagcggcgaggagatcgaggcgttccgcaagaagatcgagcaccgccgcatctcgctcctccgccagggcaagtactgctcgggcaaccgcatcggcaagggccgcgagaagcggatcaagcccatcgacgtcctcaacgacaaggtggccaagttccgcaacgccacgaaccacaagtacgcgaactacatcgtgcagcagtgcctcaagtacaactgcggcaccatccagttggaggaccttaaggggatcagcaaggagcagaccttcctcaagaactggacctacttcgacctccaggagaagatcaagaaccaggcgaacctctacggcgtgaaggtgatgaagatcgaccccagctacaccagccagcgctgctcggagtgcggctacatccacaagaacaaccgccagaaccagtccaccttcgagtgccagcagtgctccttcaaggtgcacgcggactacaacgccgccaagaacatcagcctgtacaacatcgagaaggtgatccagaagcagttggagctgcaggagaagctgaacctcaccaagtacaaggagcagtacatggagcagatgaagaacatcaactga

SEQ ID NO: 2399 - DNA, 1353 bp, Unknown
  Bacillus sp. multi
ctgagcatcgccgtcaaggtcatgaagtaccagatcgtgtgccccgtcaacatcgagtggaagacgttcgaaatctacctccggacgctgagctaccacttccggaccatcggcaaccggaccatccagaagctctgggagtacgacaaccagtcgctcaagcacttcaaggacacggggcagtacccctccgcccagcagctctacgggtgcacgcagaagaccatctcgggctacatctacgaccagctcaaggaggagtaccaggacatcaacaaggccaacatgagcaccaccctccagaagaccatccggacctggaacagccgcaagaaggagatctggagcggcgagatgtccatccccagcttccggaacaacctccccatcgacatccacgggaacagcatccagatcatcaaggagaagtccggcgactacatcgcctccgtctcgctgttctccagcaagttcatcaaggagaacgacctcccgaacggcaagatcctggtgaagctgagcacgcgcaagcagaacagcatgaaggtgatcctggaccgcatcatcgactccacgtacgcgaagggcgcgtgcatgctccacaagcacaagaagaagtggtacttgtccatcacctacaagtccaacatcaaggaggagcttaagttcgacgaggaccttatcatgggcatcgacatgggcaagatcaacgtgctctacttcgccttcaacaagggcctggtgcgcggcgcgatcagcggcgaggagatcgaggcgttccgcaagaagatcgagcaccgccggatctcgctgctccgccagggcaagtactgctcggggaaccgcatcgggaagggccgcgagaagcggatcaagcccatcgacgtgctgaacgacaaggtggcgaagttccgcaacgcgacgaaccacaagtacgccaactacatcgtccagcagtgcctcaagtacaactgcgggacgatacagctcgaagacctcaaggggatcagcaaggagcagaccttcctcaagaactggacgtacttcgacctccaggagaagatcaagaaccaggcgaacctgtacggggtcaaggtcatgaagatcgacccgagctacacgagccagcgctgctccgagtgcgggtacatccacaagaacaaccggcagaaccagtccacgttcgagtgccagcagtgctccttcaaggtccacgccgactacaacgccgccaagaacatctccctctacaacatcgagaaggtgatccagaagcaactggaactccaggagaagctgaacctgaccaagtacaaggagcagtacatggagcagatgaagaacatcaactga

SEQ ID NO: 2400 - DNA, 1353 bp, Unknown
  Bacillus sp. multi
ctctccatcgcggtgaaggtgatgaagtaccagatcgtgtgcccggtgaacatcgagtggaagaccttcgagatctatctccggacgctcagctaccacttccggaccatcgggaaccgcacgatccagaagctgtgggagtacgacaaccagtccctcaagcacttcaaggacacgggccagtaccccagcgcccagcagctctacggctgcacgcagaaaacgatctcgggctacatctacgaccagctcaaggaggagtaccaggacatcaacaaggccaacatgagcacgaccctccagaagacaatccgcacgtggaactcccgcaagaaggagatctggagcggggagatgagcatccccagcttccggaacaacctgcccatcgacatccacggcaacagcatccagatcatcaaggagaagtccggcgactacatcgcctcggtcagcctgttctcctccaagttcatcaaggagaacgacctgccgaacggcaagatcctggtgaagctctccacgcggaagcagaacagcatgaaggtgatcctggaccgcatcatcgactccacctacgcgaagggcgcgtgcatgctccacaagcacaagaagaagtggtatctatccatcacctacaagtccaacatcaaggaggagcttaagttcgacgaggacctcatcatgggcatcgacatgggcaagatcaacgtgctgtacttcgccttcaacaaggggctcgtgcggggcgcgatcagcggcgaggagatcgaggcgttccgcaagaagatcgagcaccggagcatctcgctcctgcgccagggcaagtactgctcgggcaaccgcatcgggaagggccgcgagaagcggatcaagcccatcgacgtcctcaacgacaaggtggcgaagttccgcaacgcgaccaaccacaagtacgcgaactacatcgtccagcagtgcctcaagtacaactgcggcacgatccagctcgaagacctcaaggggatctcgaaggagcagaccttcctcaagaactggacctacttcgacctccaggagaagattaagaaccaggcgaaccagtacggcgtcaaggtcgtcaagatcgacccgtcctacacctcgcagcggtgcagcgagtgcgggtacatccacaagaacaaccgccaggaccagagcaccttcgagtgccagcagtgcagcttcaaggtccacgcggactacaacgcggccaagaacatctccctgtacaacatcgagaaggtgatccagaagcagctagagctccaggagaagctgaaccagaccaagtacaaggagcagtacatcgagcagatgaagaacatcaactag

SEQ ID NO: 2401 - DNA, 1353 bp, Unknown
  Bacillus sp. multi
ctgtccatcgccgtcaaggtgatgaagtaccagatcgtgtgcccggtcaacatcgagtggaagacgttcgagatctacctgcggacgctctcgtaccacttccggaccatcgggaaccggaccatccagaagctctgggagtacgacaaccagtccctcaagcacttcaaggacacgggccagtacccgtcggcgcagcagctctacggctgcacccagaagaccatcagcgggtacatctacgaccagctcaaggaggagtaccaggacatcaacaaggccaacatgagcacgaccctccagaaaacgatccgcacgtggaacagccgcaagaaggagatctggagcggcgagatgtccatcccctcgttccgcaacaacctgcccatcgacatccacggcaactccatccagatcatcaaggagaagtcgggcgactacatcgcgtcggtgagcctgttcagcagcaagttcatcaaggagaacgacctgccgaacggcaagatcctggtcaagctcagcacccgcaagcagaacagcatgaaggtcatcctggaccggatcatcgactccacgtacgcgaagggcgcgtgcatgctgcacaagcacaagaagaagtggtacctgtccatcacgtacaagtccaacatcaaggaggaactgaagttcgacgaagacttgattatggggatcgacatggggaagatcaacgtgctgtacttcgcgttcaacaagggcctcgtgcggggcgcgatcagcggcgaggagatcgaggcgttccgcaagaagatcgagcaccggagcatctccctgctgcgccagggcaagtattgctcgggcaaccgcatcggcaaggggcgcgagaagcgcatcaagcccatcgacgtgctcaacgacaaggtggccaagttccgcaacgcgacgaaccacaagtacgccaactacatcgtgcagcagtgcctcaagtacaactgcggcaccatccaactggaggacttgaaggggatcagcaaggagcagaccttcctcaagaactggacgtacttcgacctccaggagaagatcaagaaccaggcgaaccagtacggggtgaaggtggtgaagatcgaccccagctacaccagccagcggtgctcggagtgcggctacatccacaagaacaaccgccaggaccagagcaccttcgagtgccagcagtgctcgttcaaggtgcacgcggactacaacgcggccaagaacatcagcctgtacaacatcgagaaggtgatccagaagcagcttgagctccaggagaagctgaaccagacgaagtacaaggagcagtacatcgagcagatgaagaacatcaactga

SEQ ID NO: 2402 - DNA, 1353 bp, Unknown
  Bacillus sp. multi
ctcagcatcgccgtgaaggtcatgaagtaccagatcgtgtgcccggtgaacatcgagtggaagacgttcgagatctacctgcggaccctctcctaccacttccgcaccatcgggaaccgcaccatccagaagctgtgggagtacgacaaccagtccctcaagcacttcaaggacaccggccagtacccgagcgcgcagcagctctacggctgcacgcagaaaaccatcagcggctacatctacgaccagctcaaggaggagtaccaggacatcaacaaggccaacatgagcaccaccctccagaaaacgatccggacgtggaactcgcgcaagaaggagatttggagcggggagatgtccatcccgtccttccgcaacaacctccccatcgacatccacggcaactccatccagatcatcaaggagaagtcgggcgactacatcgccagcgtgagcctgttctccagcaagttcatcaaggagaacgacctccccaacgggaagatcctggtgaagctgagcacgcggaagcagaacagcatgaaggtcatcctggaccgcatcatcgactccacctacgcgaagggcgcgtgcatgctccacaagcacaagaagaagtggtacttgagcatcacctacaagagcaacatcaaggaggagctcaagttcgacgaggacctcattatgggcatcgacatgggcaagatcaacgtgctctacttcgccttcaacaaggggctggtgcgcggggcgatctcgggcgaggagatcgaggcgttccgcaagaaaatcgagcaccgcagcatcagcctgctccgccagggcaagtattgctccgggaaccgcatcgggaagggccgcgagaagcggatcaagcccatcgacgtgctcaacgacaaggtggccaagttccgcaacgcgaccaaccacaagtacgccaactacatcgtgcagcagtgcctcaagtacaactgcggcacgatccagctcgaggacctcaaggggatcagcaaggagcagaccttcctcaagaactggacgtacttcgacctccaggagaagattaagaaccaggccaaccagtacggcgtcaaggtggtcaagatcgaccccagctacaccagccagcggtgcagcgagtgcgggtacatccacaagaacaaccgccaggaccagtccaccttcgagtgccagcagtgcagcttcaaggtgcacgcggactacaacgccgccaagaacatcagcctgtacaacatcgagaaggtgatccagaagcagctggagttgcaggagaagctgaaccagaccaagtacaaggagcagtacatcgagcagatgaagaacatcaactga

SEQ ID NO: 2403 - DNA, 1353 bp, Unknown
  Bacillus sp. multi
ctcagcatcgcggtgaaggtgatgaagtaccagatcgtgtgccccgtgaacatcgagtggaagacgttcgaaatctacctgcggacgctgagctaccacttccgcaccatcggcaaccgcaccatccagaagctctgggagtacgacaaccagagcctcaagcacttcaaggacacgggccagtacccctccgcccagcagctctacggctgcacgcagaaaaccatctccggctacatctacgaccagctcaaggaggagtaccaggacatcaacaaggccaacatgagcacgaccctccagaagacgatccgcacctggaactcccgcaagaaggagatctggagcggggagatgagcatccccagcttccgcaacaacctgcccatcgacatccacggcaactccatccagatcatcaaggagaagtccggcgactacatcgccagcgtgtccctgttctcctcgaagttcatcaaggagaacgacctcccgaacggcaagatcctggtcaagctcagcacgcggaagcagaacagcatgaaggtgatcctggaccgcatcatcgactcgacgtacgcgaagggcgcgtgcatgctgcacaagcacaagaagaagtggtacttaagcatcacctacaagagcaacatcaaggaggagctgaagttcgacgaggacctcatcatgggcatcgacatgggcaagatcaacgtgctgtacttcgcgttcaacaaggggctcgtgcgcggcgcgatcagcggcgaggagatcgaggcgttccgcaagaagattgagcaccgcagcatctcgctcctccgccagggcaagtactgctccggcaaccggatcggcaagggccgggagaagcgcatcaagcccatcgacgtcctcaacgacaaggtggcgaagttccgcaacgcgaccaaccacaagtacgcgaactacatcgtgcagcagtgcctcaagtacaactgcgggaccatccagcttgaagacctgaaagggatcagcaaggagcagaccttcctcaagaactggacctacttcgacctccaggagaagatcaagaaccaggccaaccagtacggcgtgaaggtcgtcaagatcgaccccagctacacgagccagcgctgctccgagtgcggctacatccacaagaacaaccgccaggaccagtccaccttcgagtgccagcagtgctccttcaaggtccacgccgactacaacgcggccaagaacatctccctgtacaacatcgagaaggtgatccagaagcagcttgagctccaggagaagctgaaccagaccaagtacaaggagcagtacatcgagcagatgaagaacatcaactag

SEQ ID NO: 2404 - DNA, 1353 bp, Unknown
  Bacillus sp. multi
ctctccatcgcggtgaaggtcatgaagtaccagatcgtgtgcccggtcaacatcgagtggaagacgttcgagatctacctccggacgctcagctaccacttccgcaccatcggcaaccgcaccatccagaagctctgggagtacgacaaccagtccctcaagcacttcaaggacacgggccagtaccccagcgcccagcagctctacgggtgcacgcagaagaccatctcgggctacatctacgaccagctcaaggaggagtaccaggacatcaacaaggccaacatgagcaccaccctccagaagacgatccgcacgtggaactcccgcaagaaggaaatctggagcggcgagatgagcatcccgagcttccgcaacaacctccccatcgacatccacgggaactcgatccagatcatcaaggagaagtccggggactacatcgcgtccgtcagcctgttctcctcgaagttcatcaaggagaacgacctcccgaacgggaagatcctggtcaagctgtccacgcgcaagcagaacagcatgaaggtcatcctggaccgcatcatcgactcgacctacgcgaagggcgcgtgcatgctgcacaagcacaagaagaaatggtatctctccatcacctacaagagcaacatcaaggaggagctgaagttcgacgaggatctcatcatgggcatcgacatgggcaagatcaacgtcctgtacttcgccttcaacaagggcctggtgcggggcgcgatctccggcgaggagatcgaggcgttccgcaagaagatagagcaccggagcatctcgctgctgcgccagggcaagtactgctccggcaaccggatcggcaagggccgggagaagcgcatcaagcccatcgacgtgctcaacgacaaggtggcgaagttccgcaacgccaccaaccacaagtacgccaactacatcgtccagcagtgcctcaagtacaactgcggcaccatccagctcgaagacctgaaggggatcagcaaggagcagaccttcctcaagaactggacctacttcgacctccaggagaagatcaagaaccaggccaaccagtacggggtgaaggtggtcaagatcgaccccagctacacctcccagcgctgctccgagtgcggctacatccacaagaacaaccgccaggaccagagcacgttcgagtgccagcagtgctcgttcaaggtgcacgcggactacaacgcggccaagaacatctccctctacaacatcgagaaggtgatccagaaacaacttgagctccaggagaagctgaaccagaccaagtacaaggagcagtacatcgagcagatgaagaacatcaactga

SEQ ID NO: 2405 - DNA, 1353 bp, Unknown
  Bacillus sp. multi
ctgtccacggtggtgaaggtgatgaagtaccagatcgtgtgcccggtgaacatcgagtggaaggcgttcgagacctacctccgcaccctctcgtaccaagtgcggaccattggcaaccgcaccatccagaagctgtgggacttcgacaaccagtccctgaaccacttccgggagaacggcgtgtacccgtccgcccagcagctctacggctgcacgcagaaaacgatctccggctacatctacgaccagctcaaggaggagtaccaggacatcaacaaggcgaacatgagcacgaccctccagaagactatcaagacgtggaactcgcgcaagaaggaaatccgcagcggcgagatgagcatcccctccttccgcaacaacctccccatcgacatccacggcaactccatccagatcacgaaggagaagtcgggcgactacatcgccagcctgtccctcttcagctccaacttcatcaaggagaacaacctcccgaacggcaagatccaagtgaagctgtccacgcgcaagcagaacagcatgaaggtcatcctcgaccggatcatcgagaacacctacgcgaagggcgcgtgcatgttgcacaagcacaagaacaagtggtacctgtccatcatctacaagcccacggtcaaggaggagcacaacttcgaggaggatctcgtgatggggatcgacatgggcaagatcaacgtgctgtacttcagcttcaacaagggctggattcgtggcgcgatcagcggcgaggagatcgaggcgttccgcaagaagatagagcaccgccgcatctccctcctgcgccaggggaagtattgctcgggcaaccgcgtgggcaaggggcgggagaagcggatcaagcccatcgacgtgctcaacaacaaggtcgccaagttccgcaacgcgaccaaccacaagtacgccaactacatcgtccagcagtgcctcaagtacaactgcgggaccatccagctcgaaaacctccagggcatcagcaaggagcagaccttcctcaagaactggacctacttcgacctccaggagaagatcaagcagcaggctcaccagtacggcatcaaggtggtcaccatcgaccccagctacaccagccagcggtgcagcgagtgcgggtacatccacaagaacaaccggcagtcgcagtccaccttcgagtgccagcagtgcaacctcaaggtgcacgccgactacaacgccgccaagaacatctccatctacaacatcgagaaggtgatccagaagcagctcaagctccaggagaagctgaactccaagaagttcaccgagcagtacatcgagcagatcgagaacatcaactag

SEQ ID NO: 2406 - DNA, 1353 bp, Unknown
  Bacillus sp. multi
ctctcgaccgtggtgaaggtgatgaagtaccagatcgtgtgcccggtgaacatcgagtggaaggcgttcgagacctacctccgcacgctgagctaccaagtccgcactatcggcaaccgcacgatccagaagctgtgggacttcgacaaccagtccctgaaccacttccgcgagaacggcgtgtacccgtccgcccagcagctctacggctgcacccagaaaacgatctccggctacatctacgaccagctcaaggaggagtaccaggacatcaacaaggccaacatgagcaccaccctccagaagaccatcaagacctggaactcccgcaagaaggagattcgctcgggcgagatgtccatcccctccttccgcaacaacctccccatcgacatccacggcaacagcatccagatcacgaaggagaagtcgggcgactacatcgcctccctgagcctgttcagctccaacttcatcaaggagaacaacctccccaacgggaagatccaggtcaagctctcgacgcgcaagcagaactcgatgaaggtgatcctggaccgcatcatcgagaacacctacgcgaagggcgcgtgcatgctccacaagcacaagaacaagtggtatcttagcatcatctacaagccgaccgtgaaggaggagcacaacttcgaggaagacctcgtgatgggcatcgacatggggaagatcaacgtgctgtacttctcgttcaacaaggggtggattcgaggggcgatcagcggggaggagatcgaggcgttccgcaagaaaatcgagcaccgccgcatcagcctgctccgccagggcaagtactgctccggcaaccgcgtgggcaagggccgggagaagcgcatcaagcccatcgacgtgctgaacaacaaggtcgccaagttccgcaacgcgacgaaccacaagtacgcgaactacatcgtgcagcagtgcctcaagtacaactgcggcaccatacaacttgagaacctccagggcatctcgaaggagcagaccttcctcaagaactggacgtacttcgacctccaggagaagatcaagcagcaggctcaccagtacggcatcaaggtggtgaccatcgaccccagctacaccagccagcgctgctcggagtgcggctacatccacaagaacaaccggcagagccagagcaccttcgagtgccagcagtgcaacctcaaggtgcacgccgactacaacgccgccaagaacatctccatctacaacatcgagaaggtgatccagaagcagctcaagctccaggagaagctgaactccaagaagttcaccgagcagtacatcgagcagatcgagaacatcaactga

SEQ ID NO: 2407 - DNA, 1353 bp, Unknown
  Bacillus sp. multi
ctcagcaccgtcgtgaaggtcatgaagtaccagatcgtgtgcccggtcaacatcgagtggaaggcgttcgagacgtacctccggaccctctcgtaccaggtgcgtaccatcggcaaccgcaccatccagaagctctgggacttcgacaaccagtccctgaaccacttccgcgagaacggcgtgtacccgtccgcccagcagctctacggctgcacccagaaaaccatcagcggctacatctacgaccagctcaaggaggagtaccaggacatcaacaaggccaacatgagcaccacgctccagaaaaccatcaagacgtggaacagccgcaagaaggagatacgctccggcgagatgagcatcccgtccttccgcaacaacctccccatcgacatccacggcaactccatccagatcacgaaggagaagtccggcgactacatcgcctccctcagcctcttcagctcgaacttcatcaaggagaacaacctgccgaacgggaagatccaggtgaagctgagcacgcgcaagcagaactccatgaaggtgatcctggaccgcatcatcgagaacacctacgcgaagggcgcgtgcatgcttcacaagcacaagaacaagtggtacttgagcatcatctacaagcccaccgtgaaggaggagcacaacttcgaggaagacctcgtgatgggcatcgacatgggcaagatcaacgtgctgtacttctcgttcaacaagggctggatccggggcgcgatctcgggcgaggagatcgaggcgttccgcaagaagatagagcaccgccgcatcagcctcctgcgccaggggaagtactgttcggggaaccgcgtgggcaagggccgggagaagcgcatcaagcccatcgacgtgctgaacaacaaggtggccaagttccgcaacgcgaccaaccacaagtacgccaactacatcgtgcagcagtgcctcaagtacaactgcggcaccattcaacttgagaacctccagggcatctcgaaggagcagaccttcctcaagaactggacctacttcgacctccaggagaaaatcaagcagcaagcgcaccagtacggcatcaaggtggtgaccatcgaccccagctacacgagccagcgctgctccgagtgcggctacatccacaagaacaaccggcagtcccagagcaccttcgagtgccagcagtgcaacctcaaggtgcacgcggactacaacgcggccaagaacatcagcatctacaacatcgagaaggtgatccagaagcagctcaagctccaggagaagctcaacagcaagaagttcaccgagcagtacatcgagcagatcgagaacatcaactga

SEQ ID NO: 2408 - DNA, 1353 bp, Unknown
  Bacillus sp. multi
ctgtccaccgtcgtgaaggtcatgaagtaccagatcgtgtgccccgtcaacatcgagtggaaggcgttcgagacgtacctccggacgctctcgtaccaggtgcgtaccatcgggaaccgcacgatccagaagctctgggacttcgacaaccagtcgctgaaccacttccgggagaacggggtgtacccgtcggcgcagcagctctacggctgcacgcagaaaactatctccggctacatctacgaccagctcaaggaggagtaccaggacatcaacaaggcgaacatgagcacgacgctccagaaaaccatcaagacgtggaacagccgcaagaaggagatccggagcggcgagatgtccatcccctcgttccgcaacaacctgcccatcgacatccacggcaacagcatccagatcacgaaggagaagtccggggactacatcgcctcgctctccctcttcagctccaacttcatcaaggagaacaacctccccaacggcaagatccaggtgaagctctccacccgcaagcagaacagcatgaaggtgatcctcgaccgcatcatcgagaacacctacgcgaagggcgcgtgcatgttgcacaagcacaagaacaagtggtacttgagcatcatctacaagccgaccgtcaaggaggagcacaacttcgaggaggacttggtgatgggcatcgacatggggaagatcaacgtcctgtacttcagcttcaacaagggctggatacggggagcgatcagcggcgaggagatcgaggcgttccgcaagaagattgagcaccgccggatctccctcctccgccaggggaaatactgctcgggcaaccgcgtcgggaagggccgggagaagcggatcaagcccatcgacgtcctcaacaacaaggtggccaagttccgcaacgcgaccaaccacaagtacgccaactacatcgtgcagcagtgcctcaagtacaactgcggcaccatccaactcgagaacctccaggggatctcgaaggagcagaccttcctcaagaactggacgtacttcgacctccaggagaagatcaagcagcaagcccaccagtacggcatcaaggtcgtgaccatcgacccgtcctacaccagccagcgctgctcggagtgcggctacatccacaagaacaaccggcagtcccagtccaccttcgagtgccagcagtgcaacctcaaggtgcacgcggactacaacgccgccaagaacatcagcatctacaacatcgagaaggtcatccagaagcagctcaagctccaggagaagctgaactccaagaaattcacggagcagtacatcgagcagatcgagaacatcaactag

SEQ ID NO: 2409 - DNA, 1353 bp, Unknown
  Bacillus sp. multi
ctgtccaccgtggtgaaggtgatgaagtaccagatcgtgtgccccgtgaacatcgagtggaaggcgttcgagacctacctccgcacgctcagctaccaagtccgcacgatcggcaaccgcaccatccagaagctgtgggacttcgacaaccagtccctcaaccacttccgggagaacggcgtgtacccgtccgcccagcagctctacggctgcacccagaaaaccatcagcggctacatctacgaccagctcaaggaggagtaccaggacatcaacaaggccaacatgagcaccacgctccagaagaccatcaagacctggaactcgcgcaagaaggaaatccgcagcggcgagatgtccatcccgtccttccgcaacaacctccccatcgacatccacggcaactcgatccagatcacgaaggagaagtcgggcgactacatcgccagcctctcgctcttcagctcgaacttcatcaaggagaacaacctcccgaacggcaagatccaagtaaagctctccacgcggaagcagaactccatgaaggtcatcctcgaccggatcatcgagaacacctacgcgaagggcgcgtgcatgttgcacaagcacaagaacaagtggtaccttagcatcatctacaagccgacggtgaaggaggagcacaacttcgaggaggacctcgtgatgggcatcgacatgggcaagatcaacgtgctgtacttcagcttcaacaaggggtggattcgcggcgcgatctccggcgaggagatcgaggcgttccgcaagaaaatcgagcaccggcggatctccctcctccgccaggggaagtactgctccggcaaccgcgtcggcaagggccgggagaagcgcatcaagcccatcgacgtgctgaacaacaaggtggcgaagttccgcaacgccaccaaccacaagtacgccaactacatcgtccagcagtgcctcaagtacaactgcgggaccatccagcttgagaacctccagggcatctcgaaggagcagaccttcctcaagaactggacgtacttcgacctccaggaaaagattaagcaacaagcgcaccagtacgggatcaaggtggtgaccatcgacccgtcctacacctcccagcggtgctccgagtgcgggtacatccacaagaacaaccggcagtcccagtccacgttcgagtgccagcagtgcaacctcaaggtccacgcggactacaacgccgccaagaacatcagcatctacaacatcgagaaggtcatccagaagcagctcaagctccaggagaagctgaacagcaagaagttcacggagcagtacatcgagcagatcgagaacatcaactga

SEQ ID NO: 2410 - DNA, 1353 bp, Unknown
  Bacillus sp. multi
ctcagcatcgccgtcaaggtcatgaagtaccagatcgtgtgccccgtgaacatcgagtggaagaccttcgagatctacctgcggacgctctcgtaccacttccgcaccatcgggaaccggaccatccagaagctctgggagtacgacaaccagagcctcaagcacttcaaggacaccgggcagtacccctcggcgcagcagctctacggctgcacccagaagactatctcgggctacatctacgaccagctcaaggaggagtaccaggacatcaacaaggcgaacatgagcaccaccctccagaaaacgatccggacgtggaactcccgcaagaaggagatctggagcggcgagatgagcatcccctccttccggaacaacctccccatcgacatccacggcaacagcatccagatcatcaaggagaagtccggggactacatcgccagcgtctccctgttctcgtccaagttcatcaaggagaacgacctcccgaacggcaagatcctggtgaagctgtccacgcgcaagcagaactccatgaaggtgatcctggaccggatcatcgacagcacctacgcgaagggcgcgtgtatgctccacaagcacaagaagaagtggtacctgagcatcacctacaagagcaacatcaaggaggagctgaagttcgacgaagacctcatcatgggcatcgacatgggcaagatcaacgtgctgtacttcgcgttcaacaaggggctcgtccggggcaccatctccggcgaggagatcgaggcgttccgcaagaagatcgagcaccgccgcatctccctgctgcgccaggggaagtattgctccggcaaccgcatcgggaaggggcgcgagaagcggatcaagcccatcgacgtgctgaacgacaaggtggcgaagttccgcaacgcgaccaaccacaagtacgccaactacatcgtccagcagtgcctcaagtacaactgcgggacgatccagctcgaagacctcaaggggatcagcaaggagcagaccttcctcaagaactggacctacttcgacctccaggagaagattaagaaccaggcgaaccagtacggggtcaaggtcgtgaagatcgacccgagctacacgagccagcggtgctcggagtgcgagtacatccacaagaacaaccgccaggaccagtccacgttcgagtgccagcagtgcagcttcaaggtgcacgccgactacaacgcggccaagaacatcagcgtgtacaacatcgagaaggtcatccagaagcaactcgagctccaggagaagctgaaccagacgaagtacaaggagcagtacatcgagcagatgaagaacatcaactag

SEQ ID NO: 2411 - DNA, 1353 bp, Unknown
  Bacillus sp. multi
ctgagcatcgcggtgaaggtgatgaagtaccagatcgtgtgcccggtgaacatcgagtggaagacgttcgaaatctacctccggaccctcagctaccacttccgcaccatcggcaaccgcacgatccagaagctctgggagtacgacaaccagtccctcaagcacttcaaggacacgggccagtacccgtccgcccagcagctctacggctgcacgcagaagacgatctcggggtacatctacgaccagctcaaggaggagtaccaggacatcaacaaggccaacatgagcaccaccctccagaaaaccatccggacgtggaacagccgcaagaaggagatttggagcggggagatgtccatcccgtcgttccgcaacaacctccccatcgacatccacggcaacagcatccagatcatcaaggagaagtccggcgactacatcgcctccgtcagcctgttctccagcaagttcatcaaggagaacgacctcccgaacgggaagatcctggtcaagctcagcacgcggaagcagaactccatgaaggtgatcctcgaccggatcatcgactccacgtacgcgaagggcgcgtgcatgctgcacaagcacaagaagaagtggtacctctccatcacctacaagtccaacatcaaggaggagttgaagttcgacgaggacctgatcatggggatcgacatggggaagatcaacgtgctctacttcgccttcaacaagggcctcgtgcgcggcaccatcagcggcgaggagatcgaggcgttccgcaagaagatcgagcaccggcggatctccctcctgcgccaggggaaatactgctcgggcaaccggatcggcaagggccgcgagaagcggatcaagcccatcgacgtgctcaacgacaaggtggccaagttccgcaacgccacgaaccacaagtacgcgaactacatcgtccagcagtgcctcaagtacaactgcgggacgatccagcttgaggatctcaaggggatcagcaaggagcagacgttcctcaagaactggacgtacttcgacctccaggagaagatcaagaaccaggccaaccagtacggggtgaaggtggtcaagatcgacccgtcctacacgagccagcggtgctccgagtgcgagtacatccacaagaacaaccgccaggaccagagcaccttcgagtgccagcagtgcagcttcaaggtccacgccgactacaacgcggccaagaacatctccgtgtacaacatcgagaaggtgatccagaagcagcttgagctgcaggagaagctgaaccagacgaagtacaaggagcagtacatcgagcagatgaagaacatcaactag

SEQ ID NO: 2412 - DNA, 1353 bp, Unknown
  Bacillus sp. multi
ctctccatcgcggtcaaggtgatgaagtaccagatcgtgtgccccgtcaacatcgagtggaagaccttcgagatctacctccgcaccctgtcctaccacttccgcaccatcggcaaccggaccatccagaagctctgggagtacgacaaccagagcctcaagcacttcaaggacaccggccagtacccgtcggcccagcagctctacgggtgcacgcagaagaccatctcgggctacatctacgaccagctcaaggaggagtaccaggacatcaacaaggccaacatgagcacgaccctccagaaaaccatccggacctggaacagccgcaagaaggagatttggagcggcgagatgtccatccccagcttccggaacaacctccccatcgacatccacggcaacagcatccagatcatcaaggagaagtcgggcgactacatcgcctccgtctccctgttcagctcgaagttcatcaaggagaacgacctcccgaacggcaagatcctggtgaagctgagcacgcggaagcagaacagcatgaaggtgatcctcgaccgcatcatcgactcgacgtacgcgaagggcgcgtgcatgctgcacaagcacaagaagaagtggtacttgtccatcacctacaagtcgaacatcaaggaggagttgaagttcgacgaagacctcatcatgggcatcgacatggggaagatcaacgtgctgtacttcgccttcaacaaggggctcgtgcgcggcacgatctccggggaggagatcgaggcgttccgcaagaagatcgagcaccggcggatcagcctgctccgccagggcaagtactgctccggcaaccgcatcgggaagggccgggagaagcggatcaagcccatcgacgtcctgaacgacaaggtggcgaagttccgcaacgcgaccaaccacaagtacgcgaactacatcgtgcagcagtgcctcaagtacaactgcgggacgatccagttggaggacctgaaggggatcagcaaggagcagacgttcctcaagaactggacctacttcgacctccaggagaagatcaagaaccaggccaaccagtacggcgtgaaggtggtgaagatcgacccgagctacaccagccagcggtgcagcgagtgcgagtacatccacaagaacaaccgccaggaccagagcaccttcgagtgccagcagtgctccttcaaggtgcacgccgactacaacgccgccaagaacatcagcgtgtacaacatcgagaaggtgatccagaagcaactggagttgcaggagaagctgaaccagacgaagtacaaggagcagtacatcgagcagatgaagaacatcaactag

SEQ ID NO: 2413 - DNA, 1353 bp, Unknown
  Bacillus sp. multi
ctgtccatcgccgtgaaggtgatgaagtaccagatcgtgtgcccggtcaacatcgagtggaagaccttcgagatctacctccggacgctctcgtaccacttccggaccatcggcaaccgcaccatccagaagctctgggagtacgacaaccagtccctcaagcacttcaaggacaccgggcagtaccccagcgcccagcagctctacggctgcacgcagaaaacgatcagcgggtacatctacgaccagctcaaggaggagtaccaggacatcaacaaggcgaacatgagcaccaccctccagaagaccatccggacctggaacagccgcaagaaggagatctggagcggcgagatgagcatcccctccttccgcaacaacctgcccatcgacatccacgggaactccatccagatcatcaaggagaagtcgggcgactacatcgcctcggtgtccctgttctcctccaagttcatcaaggagaacgacctgccgaacggcaagatcctggtgaagctgtccacgcgcaagcagaacagcatgaaggtcatcctggaccggatcatcgacagcacgtacgcgaagggcgcgtgcatgctgcacaagcacaagaagaagtggtatctctccatcacctacaagagcaacatcaaggaggagctaaagttcgacgaggacctcatcatggggatcgacatgggcaagatcaacgtcctgtacttcgccttcaacaaggggctggtgcggggcaccatctcgggcgaggagatcgaggcgttccgcaagaagatcgagcaccgccggatctccctgctgcgccagggcaagtattgctccgggaaccgcatcggcaaggggcgggagaagcggatcaagcccatcgacgtgctcaacgacaaggtggcgaagttccgcaacgccaccaaccacaagtacgcgaactacatcgtccagcagtgcctcaagtacaactgcgggaccatccagctcgaagacctcaaggggatcagcaaggagcagaccttcctcaagaactggacgtacttcgacctccaggagaagattaagaaccaggcgaaccagtacggcgtcaaggtggtcaagatcgaccccagctacacgagccagcgctgctcggagtgcgagtacatccacaagaacaaccgccaggaccagagcaccttcgagtgccagcagtgctcgttcaaggtccacgccgactacaacgcggccaagaacatctccgtgtacaacatcgagaaggtcatccagaagcaactggaactgcaggagaagctgaaccagaccaagtacaaggagcagtacatcgagcagatgaagaacatcaactga

SEQ ID NO: 2414 - DNA, 1353 bp, Unknown
  Bacillus sp. multi
ctctccatcgccgtgaaggtgatgaagtaccagatcgtgtgccccgtcaacatcgagtggaagacgttcgagatctacctccggaccctctcctaccacttccgcaccatcggcaaccgcacgatccagaagctctgggagtacgacaaccagtcgctcaagcacttcaaggacacgggccagtacccgtcggcccagcagctctacggctgcacccagaagacgatcagcggctacatctacgaccagctcaaggaggagtaccaggacatcaacaaggcgaacatgagcacgaccctccagaaaacgatccgcacctggaactcccgcaagaaggagatatggagcggcgagatgagcatcccgagcttccggaacaacctccccatcgacatccacggcaactcgatccagatcatcaaggagaagtcgggcgactacatcgccagcgtcagcctcttcagcagcaagttcatcaaggagaacgacctgccgaacggcaagatcctggtcaagctcagcacccggaagcagaacagcatgaaggtgatcctggaccggatcatcgactccacgtacgcgaagggcgcgtgcatgctccacaagcacaagaagaagtggtacctttccatcacgtacaagtccaacatcaaggaggagctcaagttcgacgaggacttaatcatgggcatcgacatggggaagatcaacgtgctctacttcgcgttcaacaagggcctcgtgcgcgggacgatctcgggcgaggagatcgaggcgttccgcaagaaaatcgagcaccgccgcatcagcctgctgcgccagggcaagtactgctcgggcaaccgcatcggcaagggccgcgagaagcgcatcaagcccatcgacgtcctcaacgacaaggtggccaagttccgcaacgcgacgaaccacaagtacgcgaactacatcgtccagcagtgcctcaagtacaactgcggcacgatccaactcgaggacctcaaggggatcagcaaggagcagacgttcctcaagaactggacctacttcgacctccaggagaagatcaagaaccaggcgaaccagtacggcgtgaaggtcgtgaagatcgaccccagctacacctcccagcggtgcagcgagtgcgagtacatccacaagaacaaccgccaggaccagtccacgttcgagtgccagcagtgcagcttcaaggtccacgcggactacaacgccgccaagaacatctccgtgtacaacatcgagaaggtcatccagaagcaactcgagctccaggagaagctgaaccagaccaagtacaaggagcagtacatcgagcagatgaagaacatcaactag

SEQ ID NO: 2415 - DNA, 1353 bp, Unknown
  Bacillus sp. multi
ctctccctggcggtgaaggtcatgaagtaccagatcgtctgcccggtgaacgtcgagtggaaggtcttcgagacctacctccggaccctctcgtaccagtcgcggaccatcggcaaccgcaccatccagaagatttgggagttcgacaacctctcgctcaagcacttcaaggagaccggcgagtacagctccgcgcagcagctctacggctgcacgcagaaaacgatcagcgggtacatctacgaccagctcaaggaggagtacaaggacatcaacaaggccaacatgagcacgacgatccagaagaccctcaagaactggaactcgcgcaagaaggagatctggagcggcgagatgtccatccccagcttccggaacaacctccccatcgacatccacggcaactccatccagatcatcaaggagaagtccggcgactacatcgcctccgtgagcctgttcagcagcaagttcatcaaggagaacgacctgcccaacgggaagatcctggtcaagctgagcacgcgcaagcagaactcgatgaaggtgatcctggaccgcatcatcgactccacctacgcgaagggcgcgtgcatgctgcacaagcacaagaagaagtggtacctgagcatcacctacaagtccaacatcaaggaggagttgaagttcgacgaagacctcatcatgggcatcgacatggggaagatcaacgtgctgtacttcgccttcaacaagggcctggtgcgcggggccatctccggcgaggagatcgaggcgttccgcaagaaaatcgagcaccgccgcatcagcctgctgcgccaggggaagtactgctccggcaaccgcatcggcaaggggcgcgagaagcgcatcaagcccatcgacgtcctcaacgacaaggtggcgaagttccgcaacgcgacgaaccacaagtacgccaactacatcgtccagcagtgcctcaagtacaactgcgggaccatccagttggaagacctgaaggggatcagcaaggagcagaccttcctcaagaactggacgtacttcgacctccaggagaagattaagaaccaggccaaccagtacggcgtcaaggtcgtcaagatcgacccgtcctacacctcccagcggtgctccgagtgcgggtacatccacaagaacaaccgccaggaccagagcaccttcgagtgccagcagtgctccttcaaggtgcacgcggactacaacgcggccaagaacatctcggtgtacaacatcgagaaggtgatccagaagcagctggagctgcaggagaagctgaaccagaccaagtacaaggagcagtacatcgagcagatgaagaacatcaactga

SEQ ID NO: 2416 - DNA, 1353 bp, Unknown
  Bacillus sp. multi
ctctcgctggccgtgaaggtcatgaagtaccagatcgtgtgcccggtgaacgtcgagtggaaggtgttcgagacctacctgcggaccctgagctaccagtcccgcaccatcggcaaccgcaccatccagaagatctgggagttcgacaacctctccctcaagcacttcaaggagaccggggagtacagctcggcgcagcagctctacgggtgcacgcagaagaccatcagcgggtacatctacgaccagctcaaggaggagtacaaggacatcaacaaggcgaacatgagcacgaccatccagaagaccctcaagaactggaactcccgcaagaaggaaatctggagcggcgagatgtccatcccctccttccggaacaacctgcccatcgacatccacggcaactcgatccagatcatcaaggagaagtccggcgactacatcgcctcggtcagcctcttcagcagcaagttcatcaaggagaacgacctcccgaacggcaagatcctggtcaagctctcgacgcgcaagcagaactccatgaaggtgatcctggaccggatcatcgactcgacctacgcgaagggcgcgtgcatgctccacaagcacaagaagaagtggtacttgtccatcacctacaagtcgaacatcaaggaggagcttaagttcgacgaggatctcatcatggggatcgacatgggcaagatcaacgtcctgtacttcgcgttcaacaagggcctggtgcgcggcgcgatctccggggaggagatcgaggcgttccgcaagaagatcgagcaccgccgcatctcgctcctgcgccaggggaagtattgctcggggaaccgcatcggcaaggggcgcgagaagcgcatcaagcccatcgacgtcctgaacgacaaggtggcgaagttccgcaacgcgaccaaccacaagtacgcgaactacatcgtgcagcagtgcctcaagtacaactgcgggaccatccagctcgaagacctcaaggggatctcgaaggagcagacgttcctcaagaactggacctacttcgacctccaggagaagatcaagaaccaggccaaccagtacggggtgaaggtcgtgaagatcgacccgagctacaccagccagcggtgcagcgagtgcggctacatccacaagaacaaccgccaggaccagtccacgttcgagtgccagcagtgcagcttcaaggtgcacgcggactacaacgcggccaagaacatcagcgtgtacaacatcgagaaggtgatccagaaacagctggagctgcaggagaagctcaaccagaccaagtacaaggagcagtacatcgagcagatgaagaatatcaactag

SEQ ID NO: 2417 - DNA, 1353 bp, Unknown
  Bacillus sp. multi
ctgtcgctggccgtgaaggtcatgaagtaccagatcgtctgcccggtgaacgtggagtggaaggtgttcgagacgtacctccgcaccctgtcgtaccagagccgcaccatcggcaaccgcaccatccagaaaatctgggagttcgacaacctgtcgctcaagcacttcaaggagaccggcgagtacagctccgcgcagcagctctacggctgcacccagaagacgatcagcggctacatctacgaccagctcaaggaggagtacaaggacatcaacaaggcgaacatgagcaccaccatccagaaaaccctcaagaactggaacagccgcaagaaggagatctggagcggcgagatgtccatcccgtcgttccgcaacaacctccccatcgacatccacggcaacagcatccagatcatcaaggagaagtccggcgactacatcgcctccgtgtcgctgttctccagcaagttcatcaaggagaacgacctgccgaacggcaagatcctggtgaagctctccacgcgcaagcagaacagcatgaaggtgatcctggaccggatcatcgacagcacctacgcgaagggcgcgtgcatgctccacaagcacaagaagaagtggtacctgagcatcacctacaagagcaacatcaaggaggagctgaagttcgacgaggacttgatcatgggcatcgacatgggcaagatcaacgtcctctacttcgcgttcaacaagggcctcgtgcggggcgcgatctccggggaggagatcgaggcgttccgcaagaagatcgagcaccggcggatctccctgctgcgccaggggaaatactgctcgggcaaccgcatcggcaaggggcgcgagaagcggatcaagcccatcgacgtcctgaacgacaaggtggcgaagttccgcaacgcgaccaaccacaagtacgccaactacatcgtgcagcagtgcctcaagtacaactgcgggaccatccagctcgaggacttgaaggggatcagcaaggagcagacgttcctcaagaactggacctacttcgacctccaggagaagattaagaaccaggcgaaccagtacggcgtcaaggtggtgaagatcgacccctcctacaccagccagcggtgctccgagtgcgggtacatccacaagaacaaccgccaggaccagagcacgttcgagtgccagcagtgctccttcaaggtccacgccgactacaacgcggccaagaacatctccgtgtacaacatcgagaaggtgatccagaagcagctggaactacaggagaagctgaaccagacgaagtacaaggagcagtacatcgagcagatgaagaacatcaactag

SEQ ID NO: 2418 - DNA, 1353 bp, Unknown
  Bacillus sp. multi
ctctccctggccgtcaaggtgatgaagtaccagatcgtgtgcccggtcaacgtggagtggaaggtcttcgagacctacctccgcacgctgtcctaccagtcgcggaccatcgggaaccgcacgatccagaagatttgggagttcgacaacctctccctcaagcacttcaaggagaccggggagtacagctccgcgcagcagctctacggctgcacgcagaagaccatcagcggctacatctacgaccagctcaaggaggagtacaaggacatcaacaaggccaacatgagcacgaccatccagaagacactcaagaactggaactcccgcaagaaggagatctggagcggcgagatgagcatcccgtcgttccgcaacaacctgcccatcgacatccacggcaactccatccagatcatcaaggagaagtccggggactacatcgcgtcggtgtccctgttcagctcgaagttcatcaaggagaacgacctccccaacggcaagatcctggtcaagctctccacccgcaagcagaacagcatgaaggtgatcctggaccggatcatcgactcgacctacgcgaagggcgcgtgcatgctgcacaagcacaagaagaagtggtacttgtcgatcacctacaagtccaacatcaaggaggagctgaagttcgacgaggatctcataatgggcatcgacatggggaagatcaacgtgctctacttcgccttcaacaaggggctcgtgcgcggcgcgatctccggggaggagatcgaggcgttccgcaagaaaatcgagcaccgccgcatcagcctgctccgccagggcaagtactgctccggcaaccgcatcgggaagggccgcgagaagcggatcaagcccatcgacgtgctcaacgacaaggtggccaagttccgcaacgcgacgaaccacaagtacgccaactacatcgtgcagcagtgcctcaagtacaactgcgggaccatccagctcgaggacttgaaggggatctcgaaggagcagaccttcctcaagaactggacctacttcgacctccaggagaagatcaagaaccaggccaaccagtacggcgtgaaggtcgtgaagatcgaccccagctacaccagccagcggtgctccgagtgcggctacatccacaagaacaaccgccaggaccagtccacgttcgagtgccagcagtgcagcttcaaggtccacgcggactacaacgccgccaagaacatctcggtgtacaacatcgagaaggtgatccagaagcagctcgaactgcaggagaagctgaaccagaccaagtacaaggagcagtacatcgagcagatgaagaacatcaactga

SEQ ID NO: 2419 - DNA, 1353 bp, Unknown
  Bacillus sp. multi
ctgtcgctcgccgtgaaggtgatgaagtaccagatcgtgtgcccggtgaacgtcgagtggaaggtgttcgagacctacctgcggacgctctcctaccagagccgcaccatcggcaaccgcacgatccagaaaatctgggagttcgacaacctcagcctcaagcacttcaaggagaccggggagtacagctcggcccagcagctctacggctgcacgcagaagaccatcagcggctacatctacgaccagctcaaggaggagtacaaggacatcaacaaggccaacatgagcacgaccatccagaagaccctcaagaactggaacagccgcaagaaggagatatggagcggggagatgtccatccccagcttccgcaacaacctccccatcgacatccacggcaactccatccagatcatcaaggagaagtcgggcgactacatcgccagcgtcagcctcttcagcagcaagttcatcaaggagaacgacctccccaacggcaagatcctggtgaagctctccacgcgcaagcagaacagcatgaaggtcatcctggaccggatcatcgacagcacctacgcgaagggcgcgtgcatgctgcacaagcacaagaagaagtggtacctgagcatcacctacaagtcgaacatcaaggaggagcttaagttcgacgaggacctaatcatgggcatcgacatgggcaagatcaacgtcctctacttcgcgttcaacaaggggctcgtgcggggcgcgatctccggggaggagatcgaggcgttccgcaagaagatcgagcaccgccgcatctcgctcctccgccaggggaagtactgttcgggcaaccggatcggcaagggccgcgagaagcgcatcaagcccatcgacgtcctgaacgacaaggtggcgaagttccgcaacgcgaccaaccacaagtacgccaactacatcgtgcagcagtgcctcaagtacaactgcgggaccatccagcttgaggacttgaaggggatcagcaaggagcagacgttcctcaagaactggacgtacttcgacctccaggagaagatcaagaaccaggccaaccagtacggcgtgaaggtggtgaagatcgaccccagctacaccagccagcgctgctcggagtgcgggtacatccacaagaacaaccgccaggaccagtccaccttcgagtgccagcagtgctccttcaaggtccacgcggactacaacgccgccaagaacatctccgtgtacaacatcgagaaggtcatccagaagcagctggagctacaggagaagctgaaccagaccaagtacaaggagcagtacatcgagcagatgaagaacatcaactga

SEQ ID NO: 2420 - DNA, 1353 bp, Unknown
  Bacillus sp. multi
ctgtccatcgcggtgaaggtgatgaagtaccagatcgtgtgccccgtcaacatcgagtggaagacgttcgaaatctacctccggaccctcagctaccacttccggaccatcgggaaccgcaccatccagaagctctgggagtacgacaaccagtcgctcaagcacttcaaggacaccggccagtaccccagcgcgcagcagctctacggctgcacccagaaaaccatctcgggctacatctacgaccagctcaaggaggagtaccaggacatcaacaaggccaacatgagcacgaccctccagaagacgatccgcacctggaactcgcgcaagaaggagatatggagcggcgagatgagcatcccgagcttccgcaacaacctccccatcgacatccacgggaactccatccagatcatcaaggagaagtccggcgactacatcgcgtccgtctccctcttcagcagcaagttcatcaaggagaacgacctgccggacggcaagatcctggtgaagctgagcacccggaagcagaacagcatgaaggtcatcctcgaccgcatcatcgactcgacctacgcgaagggcgcgtgcatgctccacaagcacaagaagaagtggtacctctccatcacgtacaagagcaacatcaaggaggagcttaagttcgacgaggacctgatcatgggcatcgacatggggaagatcaacgtgctgtacttcgcgttcaacaaggggctcgtccggggcgcgatctccggggaggagatcgaggcgttccgcaagaagatcgagcaccgccgcatctccctgctgcgccagggcaaatactgctccggcaaccgcatcggcaaggggcgggagaagcggatcaagcccatcgacgtgctcaacgacaaggtggccaagttccgcaacgccaccaaccacaagtacgccaactacatcgtgcagcagtgcctcaagtacaactgcggcacgatccagttggaggacttgaaagggatctcgaaggagcagaccttcctcaagaactggacgtacttcgacctccaggagaagatcaagaaccaggccaaccagtacggggtcaaggtcgtgaagatcgacccctcctacacgagccagcggtgctccgagtgcgagtacatccacaagaacaaccgccaggaccagtccaccttcgagtgccagcagtgcagcttcaaggtgcacgcggactacaacgccgccaagaacatctccgtgtacaacatcgagaaggtcatccagaagcaactggagctacaggagaagctgaaccagaccaagtacaaggagcagtacatcgagcagatgaagaacatcaactag

SEQ ID NO: 2421 - DNA, 1353 bp, Unknown
  Bacillus sp. multi
ctcagcatcgccgtgaaggtgatgaagtaccagatcgtctgcccggtgaacatcgagtggaagacgttcgagatctacctccggaccctctcctaccacttccgcaccatcgggaaccgcacgatccagaagctgtgggagtacgacaaccagtccctcaagcacttcaaggacacgggccagtacccctccgcccagcagctctacggctgcacgcagaaaacgatcagcgggtacatctacgaccagctcaaggaggagtaccaggacatcaacaaggcgaacatgagcaccaccctccagaagaccatccgcacctggaacagccgcaagaaggaaatctggagcggcgagatgtccatccccagcttccgcaacaacctgcccatcgacatccacggcaactccatccagatcatcaaggagaagtccggcgactacatcgcctcggtgtcgctgttctccagcaagttcatcaaggagaacgacctcccggacggcaagatcctggtcaagctctccacgcgcaagcagaacagcatgaaggtcatcctcgaccgcatcatcgacagcacgtacgcgaagggcgcgtgcatgctgcacaagcacaagaagaagtggtacttgagcatcacctacaagtccaacatcaaggaggaattgaagttcgacgaggacctgatcatgggcatcgacatggggaagatcaacgtcctgtacttcgccttcaacaagggcctcgtgcgcggggcgatctccggggaggagatcgaggcgttccgcaagaagatcgagcaccgccgcatctccctgctccgccaggggaagtattgctcggggaaccggatcgggaaggggcgcgagaagcgcatcaagcccatcgacgtcctgaacgacaaggtggccaagttccgcaacgcgacgaaccacaagtacgccaactacatcgtgcagcagtgcctcaagtacaactgcggcacgatccagctagaggatctgaaggggatctcgaaggagcagacgttcctcaagaactggacctacttcgacctccaggagaagatcaagaaccaggccaaccagtacggcgtgaaggtcgtgaagatcgacccctcctacaccagccagcgctgctcggagtgcgagtacatccacaagaacaaccgccaggaccagtccaccttcgagtgccagcagtgctcgttcaaggtgcacgccgactacaacgccgccaagaacatctcggtgtacaacatcgagaaggtcatccagaagcagttggaactgcaggagaagctgaaccagaccaagtacaaggagcagtacatcgagcagatgaagaacatcaactag

SEQ ID NO: 2422 - DNA, 1353 bp, Unknown
  Bacillus sp. multi
ctctccatcgccgtcaaggtcatgaagtaccagatcgtgtgcccggtgaacatcgagtggaagaccttcgagatctacctccggacgctctcctaccacttccgcaccatcggcaaccgcacgatccagaagctgtgggagtacgacaaccagtccctcaagcacttcaaggacacgggccagtacccgtccgcgcagcagctctacggctgcacccagaagacgatcagcggctacatctacgaccagctcaaggaggagtaccaggacatcaacaaggccaacatgagcacgaccctccagaagaccatccgcacctggaactcgcgcaagaaggagatttggagcggggagatgtccatcccgtccttccgcaacaacctccccatcgacatccacgggaactccatccagatcatcaaggagaagtccggggactacatcgcctccgtgtcgctgttctcctcgaagttcatcaaggagaacgacctcccggacgggaagatcctggtcaagctctccacccggaagcagaacagcatgaaggtcatcctggaccgcatcatcgacagcacctacgcgaagggcgcgtgcatgctgcacaagcacaagaagaagtggtacctctcgatcacctacaagagcaacatcaaggaggagcttaagttcgacgaggacttgatcatggggatcgacatgggcaagatcaacgtgctctacttcgccttcaacaaggggctcgtgcgcggcgcgatctccggcgaggagatcgaggcgttccgcaagaagatagagcaccgccggatctcgctgctgcgccagggcaaatactgctcgggcaaccgcatcggcaaggggcgcgagaagcgcatcaagcccatcgacgtgctcaacgacaaggtggccaagttccgcaacgcgaccaaccacaagtacgcgaactacatcgtgcagcagtgcctcaagtacaactgcggcacgatccagttggaagacctgaaggggatcagcaaggagcagaccttcctcaagaactggacctacttcgacctccaggagaagatcaagaaccaggccaaccagtacggcgtcaaggtggtcaagatcgaccccagctacacctcgcagcggtgctcggagtgcgagtacatccacaagaacaaccgccaggaccagagcacgttcgagtgccagcagtgctccttcaaggtgcacgcggactacaacgcggccaagaacatcagcgtgtacaacatcgagaaggtgatccagaagcaactagagttgcaggagaagctgaaccagaccaagtacaaggagcagtacatcgagcagatgaagaacatcaactag

SEQ ID NO: 2423 - DNA, 1353 bp, Unknown
  Bacillus sp. multi
ctcagcatcgccgtcaaggtcatgaagtaccagatcgtgtgcccggtcaacatcgagtggaagaccttcgaaatctacctgcggaccctctcctaccacttccgcaccatcgggaaccgcacgatccagaagctctgggagtacgacaaccagtccctcaagcacttcaaggacaccggccagtacccgtcggcccagcagctctacggctgcacccagaagacgatcagcggctacatctacgaccagctcaaggaggagtaccaggacatcaacaaggccaacatgagcaccaccctccagaagacgatccggacctggaacagccgcaagaaggagatctggagcggcgagatgagcatcccgagcttccgcaacaacctccccatcgacatccacggcaacagcatccagatcatcaaggagaagtccggcgactacatcgcgtccgtgagcctgttctcctccaagttcatcaaggagaacgacctgccggacggcaagatcctggtcaagctctccacgcgcaagcagaacagcatgaaggtcatcctcgaccgcatcatcgactccacgtacgcgaagggcgcgtgcatgctgcacaagcacaagaagaagtggtatctgtccatcacctacaagagcaacatcaaggaggagctaaagttcgacgaggacttaatcatggggatcgacatggggaagatcaacgtgctctacttcgccttcaacaaggggctggtgcgcggggccatctccggggaggagatcgaggcgttccgcaagaagattgagcaccgccggatcagcctgctccgccaggggaagtattgctcgggcaaccggatcgggaagggccgggagaagcgcatcaagcccatcgacgtcctcaacgacaaggtggccaagttccgcaacgcgaccaaccacaagtacgccaactacatcgtccagcagtgcctcaagtacaactgcgggacgatacagctcgaggatctgaaggggatctcgaaggagcagacgttcctcaagaactggacgtacttcgacctccaggagaagatcaagaaccaggcgaaccagtacggcgtgaaggtggtcaagatcgacccctcctacacgagccagcgctgctccgagtgcgagtacatccacaagaacaaccgccaggaccagtccaccttcgagtgccagcagtgcagcttcaaggtgcacgcggactacaacgcggccaagaacatcagcgtgtacaacatcgagaaggtgatccagaagcagctcgaactgcaggagaagctgaaccagaccaagtacaaggagcagtacatcgagcagatgaagaacatcaactga

SEQ ID NO: 2424 - DNA, 1353 bp, Unknown
  Bacillus sp. multi
ctgagcatcgcggtcaaggtgatgaagtaccagatcgtctgcccggtcaacatcgagtggaagaccttcgagatctacctgcggacgctcagctaccacttccgcaccatcgggaaccgcacgatccagaagctctgggagtacgacaaccagtcgctcaagcacttcaaggacaccggccagtacccctccgcccagcagctctacggctgcacccagaaaacgatcagcggctacatctacgaccagctcaaggaggagtaccaggacatcaacaaggcgaacatgagcacgaccctccagaagacgatccggacgtggaactcccgcaagaaggagatctggagcggcgagatgagcatcccgtcgttccgcaacaacctgcccatcgacatccacgggaacagcatccagatcatcaaggagaagtcgggcgactacatcgcctccgtcagcctgttctccagcaagttcatcaaggagaacgacctgccggacgggaagatcctggtcaagctgagcacgcggaagcagaactccatgaaggtgatcctcgaccggatcatcgactccacgtacgcgaagggcgcgtgcatgcttcacaagcacaagaagaagtggtacctgtccatcacctacaagagcaacatcaaggaggagctaaagttcgacgaggatctgatcatggggatcgacatggggaagatcaacgtgctctacttcgccttcaacaaggggctggtgcgcggcgcgatcagcggcgaggagatcgaggcgttccgcaagaagatcgagcaccggcgcatctccctgctccgccaggggaagtattgttccggcaaccggatcggcaagggccgggagaagcgcatcaagcccatcgacgtcctgaacgacaaggtggcgaagttccgcaacgcgacgaaccacaagtacgcgaactacatcgtccagcagtgcctcaagtacaactgcggcacgatccagctagaggacttgaaggggatcagcaaggagcagacgttcctcaagaactggacctacttcgacctccaggagaagatcaagaaccaggccaaccagtacggggtcaaggtcgtgaagatcgacccgagctacacctcccagcggtgctccgagtgcgagtacatccacaagaacaaccgccaggaccagtccacgttcgagtgccagcagtgcagcttcaaggtccacgccgactacaacgcggccaagaacatcagcgtgtacaacatcgagaaggtcatccagaagcagctggaactacaggagaagctgaaccagacgaagtacaaggagcagtacatcgagcagatgaagaacatcaactga

SEQ ID NO: 2425 - DNA, 1332 bp, Unknown
  Bacillus sp. multi
atgaagtaccagatcgtctgccccgtgaacgtcgagtggaaggtgttcgagacctacctccgcaccctgtcctaccagtcccggaccatcggcaaccgcaccatccagaaaatctgggagttcgacaacctgagcctcaagcacttcaaggagaccggggagtacccgtcggcccagcagctctacggctgcacccagaaaaccatcagcgggtacatctacgaccagctcaaggaggagtacaaggacatcaacaaggcgaacatgagcacgaccatccagaaaacgctcaagaactggaacagccgcaagaaggagatttggcgcggcgagatgagcatcccctccttccgctcggacctccccatcgacatccacggcaactcgatccagctcatcaaggagaagggcggggactacatcgcctcggtgagcctgttctcctccaagttcatcaaggagaacgacctcccgaacggcaagatcctggtcaagctctcgacgcgcaagcagaacagcatgaaggtcatcctcgaccgcctcatcaactcgacctacagcaagggcgcgtgcatgttccacaagcacaagaagaagtggtatctgtccatcacctacaagtccaacatcaaggaggagcttaagttcgacgaggatctgatcatggggatcgacatggggaagatcaacgtcctctacttcaccttcaacaaggggctcgtccggggcacgatctccggcgaggagatcgaggcgttccgcaagaagatcgagcaccgccggatctccctgctgcgccagggcaagtactgctccgggaaccgcatcgggaagggccgggagaagcgcatcaagcccatcgacgtgctcaacgacaaggtggccaagttccgcaacgccaccaaccacaagtacgccaactacatcgtgcagcagtgcctcaagtacaactgcgggaccatccagttggaggacctgaaggggatctcgaaggagcagaccttcctcaagaactggacctacttcgacctccaggagaagatcaagaaccaggcgaaccagtacggcgtcaaggtcgtgaagatcgacccgtcctacacgagccagcgctgctccgagtgcgggtacatccacaaggacaaccgccaggaccagagcacgttcgagtgcctccagtgcagcttcaaggtccacgccgactacaacgccgccaagaacatctcggtgcacaacatcgagaaggtcatccagaagcagctggagcttcaagagaagctgaacctcaccaagtacaaggagcactacatcgagcagatgaagaacatcaactga

SEQ ID NO: 2426 - DNA, 1332 bp, Unknown
  Bacillus sp. multi
atgaagtaccagatcgtgtgccccgtcaacgtggagtggaaggtgttcgagacctacctccggacgctctcgtaccagagccgcaccatcggcaaccgcacgatccagaaaatctgggagttcgacaacctctccctcaagcacttcaaggagacgggcgagtacccgtccgcccagcagctctacggctgcacccagaaaacgatcagcggctacatctacgaccagctcaaggaggagtacaaggacatcaacaaggcgaacatgagcacgaccatccagaagaccctcaagaactggaactcccgcaagaaggagatctggcgcggggagatgagcatcccgtcgttccggagcgacctgcccatcgacatccacgggaactcgatccagctcatcaaggagaagggcggcgactacatcgcctccgtcagcctgttctcctccaagttcatcaaggagaacgacctgccgaacggcaagatcctggtcaagctcagcacgcggaagcagaactcgatgaaggtgatcctggaccgcctcatcaacagcacctacagcaagggcgcgtgcatgttccacaagcacaagaagaagtggtacctgtccatcacctacaagagcaacatcaaggaggagttgaagttcgacgaggatctgatcatgggcatcgacatgggcaagatcaacgtgctctacttcacgttcaacaagggcctggtgcgcggcacgatctccggggaggagatcgaggcgttccgcaagaagatcgagcaccggcggatctccctcctccgccagggcaagtattgctccggcaaccggatcggcaaggggcgggagaagcgcatcaagcccatcgacgtgctgaacgacaaggtggcgaagttccgcaacgccaccaaccacaagtacgcgaactacatcgtccagcagtgcctcaagtacaactgcggcaccatccagttggaggatctcaaggggatcagcaaggagcagaccttcctcaagaactggacgtacttcgacctccaggagaagattaagaaccaggcgaaccagtacggggtgaaggtggtcaagatcgaccccagctacacgagccagcggtgctccgagtgcggctacatccacaaggacaaccgccaggaccagtccacgttcgagtgcctccagtgcagcttcaaggtgcacgcggactacaacgcggccaagaacatcagcgtccacaacatcgagaaggtcatccagaagcagctcgaactccaggaaaagctgaacctgacgaagtacaaggagcactacatcgagcagatgaagaacatcaactga

SEQ ID NO: 2427 - DNA, 1332 bp, Unknown
  Bacillus sp. multi
atgaagtaccagatcgtgtgcccggtgaacgtcgagtggaaggtcttcgagacgtacctgcggaccctgagctaccagtcccgcaccatcggcaaccgcaccatccagaaaatctgggagttcgacaacctgtccctcaagcacttcaaggagaccggcgagtacccctccgcccagcagctctacggctgcacgcagaaaaccatctcgggctacatctacgaccagctcaaggaggagtacaaggacatcaacaaggccaacatgagcaccaccatccagaagaccctcaagaactggaactcccgcaagaaggaaatctggcgcggggagatgagcatcccgtcgttccggagcgacctgcccatcgacatccacggcaacagcatccagctcatcaaggagaagggcggcgactacatcgcctccgtgtccctcttcagcagcaagttcatcaaggagaacgacctgccgaacgggaagatcctggtcaagctgagcacgcgcaagcagaactccatgaaggtgatcctcgaccgcctcatcaactcgacctactcgaagggcgcgtgcatgttccacaagcacaagaagaagtggtacctgtccatcacctacaagagcaacatcaaggaggagcttaagttcgacgaggacctcataatggggatcgacatggggaagatcaacgtgctctacttcacgttcaacaagggcctggtgcggggcacgatctcgggcgaggagatcgaggcgttccgcaagaagatcgagcaccgccggatctcgctcctccgccagggcaagtactgctcgggcaaccggatcggcaaggggcgggagaagcgcatcaagcccatcgacgtcctcaacgacaaggtggccaagttccgcaacgccacgaaccacaagtacgccaactacatcgtgcagcagtgcctcaagtacaactgcgggacgatccagttggaggacttgaaggggatcagcaaggagcagaccttcctcaagaactggacctacttcgacctccaggagaagatcaagaaccaggccaaccagtacggcgtcaaggtcgtgaagatcgacccgagctacaccagccagcggtgcagcgagtgcggctacatccacaaggacaaccgccaggaccagagcaccttcgagtgcctccagtgcagcttcaaggtgcacgccgactacaacgcggccaagaacatctcggtgcacaacatcgagaaggtgatccagaagcagcttgaactgcaggagaagctgaacctcaccaagtacaaggagcactacatcgagcagatgaagaatatcaactga

SEQ ID NO: 2428 - DNA, 1332 bp, Unknown
  Bacillus sp. multi
atgaagtaccagatcgtgtgcccggtgaacgtggagtggaaggtcttcgagacctacctgcggaccctcagctaccagtcgcggaccatcggcaaccggaccatccagaagatctgggagttcgacaacctgtcgctcaagcacttcaaggagaccggcgagtacccgtcggcccagcagctctacggctgcacccagaaaaccatcagcggctacatctacgaccagctcaaggaggagtacaaggacatcaacaaggcgaacatgagcacgacgatccagaagactctcaagaactggaacagccgcaagaaggagatctggcgcggggagatgagcatccccagcttccgctcggacctccccatcgacatccacggcaacagcatccagctcatcaaggagaagggcggggactacatcgcctccgtgtccctgttcagcagcaagttcatcaaggagaacgacctccccaacggcaagatcctggtcaagctgtccacgcgcaagcagaactccatgaaggtcatcctggaccggctcatcaactccacctacagcaagggcgcgtgcatgttccacaagcacaagaagaagtggtatctgtccatcacctacaagagcaacatcaaggaggagttgaagttcgacgaggacttaatcatgggcatcgacatgggcaagatcaacgtgctctacttcacgttcaacaaggggctggtgcgcggcacgatctcgggcgaggagatcgaggcgttccgcaagaagatagagcaccgccgcatctccctcctgcgccagggcaagtactgctcgggcaaccgcatcgggaaggggcgggagaagcggatcaagcccatcgacgtcctcaacgacaaggtggccaagttccgcaacgcgaccaaccacaagtacgccaactacatcgtgcagcagtgcctcaagtacaactgcggcacgatccagttggaagacctcaaggggatcagcaaggagcagacgttcctcaagaactggacgtacttcgacctccaggagaagatcaagaaccaggcgaaccagtacggcgtcaaggtggtgaagatcgacccgagctacacctcccagcggtgctccgagtgcgggtacatccacaaggacaaccgccaggaccagtccaccttcgagtgcctccagtgctcgttcaaggtgcacgccgactacaacgccgccaagaacatctcggtgcacaacatcgagaaggtgatccagaagcagcttgagctccaggagaagctgaacctgaccaagtacaaggagcactacatcgagcagatgaagaacatcaactga

SEQ ID NO: 2429 - DNA, 1332 bp, Unknown
  Bacillus sp. multi
atgaagtaccagatcgtgtgccccgtcaacgtcgagtggaaggtgttcgagacgtacctgcggaccctctcgtaccagtcccgcaccatcggcaaccgcaccatccagaagatctgggagttcgacaacctgtcgctcaagcacttcaaggagacgggcgagtacccgagcgcgcagcagctctacggctgcacgcagaagaccatctccggctacatctacgaccagctcaaggaggagtacaaggacatcaacaaggccaacatgagcaccaccatccagaaaaccctcaagaactggaactcgcgcaagaaggagatctggcgcggcgagatgtccatcccgagcttccggtcggacctgcccatcgacatccacggcaactccatccagctcatcaaggagaagggcggcgactacatcgcgtcggtgtccctgttcagctcgaagttcatcaaggagaacgacctcccgaacgggaagatcctggtgaagctcagcacgcggaagcagaactccatgaaggtcatcctcgaccgcctcatcaactcgacctacagcaagggcgcgtgcatgttccacaagcacaagaagaagtggtacctatccatcacgtacaagagcaacatcaaggaggagctgaagttcgacgaggatctgatcatggggatcgacatgggcaagatcaacgtgctctacttcacgttcaacaagggcctggtccggggcacgatctccggggaggagatcgaggcgttccgcaagaagatcgagcaccgccggatctccctcctgcgccaggggaaatactgctcgggcaaccggatcggcaagggccgggagaagcggatcaagcccatcgacgtgctcaacgacaaggtggcgaagttccgcaacgccaccaaccacaagtacgcgaactacatcgtgcagcagtgcctcaagtacaactgcggcacgatccagttggaggacttgaaggggatctcgaaggagcagaccttcctcaagaactggacctacttcgacctccaggagaagatcaagaaccaggccaaccagtacggcgtcaaggtggtgaagatcgacccgagctacacctcgcagcggtgcagcgagtgcggctacatccacaaggacaaccgccaggaccagagcacgttcgagtgcctccagtgcagcttcaaggtgcacgccgactacaacgccgccaagaacatctccgtgcacaacatcgagaaggtgatccagaagcagctcgaattacaggaaaagctgaacctgaccaagtacaaggagcactacatcgagcagatgaagaacatcaactag

SEQ ID NO: 2430 - DNA, 1353 bp, Unknown
  Bacillus sp. multi
ctcagcatcgccgtgaaggtgatgaagtaccagatcgtgtgccccgtgaacatcgagtggaagacgttcgagatctacctccgcaccctgtcgtaccacttccgcaccatcgggaaccgcaccatccagaagctgtgggagtacgacaaccagtcgctcaagcacttcaaggacacgggccagtacccctcggcgcagcagctctacggctgcacccagaaaaccatctccgggtacatctacgaccagctcaaggaggagtaccaggacatcaacaaggcgaacatgagcaccaccctccagaagactatccgcacgtggaactcgcgcaagaaggagatctggagcggcgagatgtccatccccagcttccggaacaacctgcccatcgacatccacggcaactcgatccagatcatcaaggagaagtcgggcgactacatcgcgtcggtgtccctgttcagcagcaagttcatcaaggagaacgacctcccgaacgggaagatcctggtgaagctctccacccgcaagcagaactccatgaaggtgatcctcgaccgcatcatcgactcgacctacgcgaagggcgcgtgcatgttgcacaagcacaagaagaagtggtatcttagcatcacctacaagagcaacatcaaggaggagcttaagttcgacgaggacctgattatggggatcgacatggggaagatcaacgtgctctacttcgcgttcaacaagggcctggtgcggggcgcgatcagcggcgaggagatcgaggcgttccgcaagaagatcgagcaccggcgcatctccctcctccgccaggggaagtactgctccggcaaccgcatcggcaagggccgcgagaagcggatcaagcccatcgacgtcctcaacgacaaggtggccaagttccgcaacgccacgaaccacaagtacgccaactacatcgtgcagcagtgcctcaagtacaactgcgggaccatccacctggaagacctcaaggggatcagcaaggagcagaccttcctcaagaactggacctacttcgacctccaggagaagatcaagaaccaggccaaccagtacggcgtgaaggtcgtgaagatcgacccctcctacacctcccagcgctgctccgagtgcggctacatccacaagaacaaccgccaggaccagtccaccttcgagtgccagcagtgctccttcaaggtccacgcggactacaacgcggccaagaacatctccgtgtacaacatcgagaaggtcatccagaagcagctcgaactgcaggaaaagctgaaccagacgaagtacaaggagcagtacatcgagcagatgaagaacatcaactga

SEQ ID NO: 2431 - DNA, 1353 bp, Unknown
  Bacillus sp. multi
ctgagcatcgcggtgaaggtgatgaagtaccagatcgtctgcccggtcaacatcgagtggaagacgttcgagatatacctccggaccctctcctaccacttccggaccatcggcaaccggaccatccagaagctctgggagtacgacaaccagagcctcaagcacttcaaggacacgggccagtacccgtccgcccagcagctctacgggtgcacgcagaaaaccatcagcggctacatctacgaccagctcaaggaggagtaccaggacatcaacaaggccaacatgagcaccaccctccagaaaacaatccgcacctggaactcccgcaagaaggagatttggagcggcgagatgtccatccccagcttccgcaacaacctgcccatcgacatccacggcaactccatccagatcatcaaggagaagtccggggactacatcgcctcggtcagcctgttcagcagcaagttcatcaaggagaacgacctgcccaacgggaagatcctggtgaagctcagcacccggaagcagaactccatgaaggtcatcctggaccggatcatcgactcgacctacgcgaagggcgcgtgcatgctgcacaagcacaagaagaagtggtatctttccatcacctacaagtccaacatcaaggaggagctgaagttcgacgaggacctcatcatgggcatcgacatggggaagatcaacgtgctgtacttcgcgttcaacaaggggctggtgcgcggggcgatctccggcgaggagatcgaggcgttccgcaagaagatcgagcaccggcgcatctcgctcctccgccagggcaagtactgctcggggaaccggatcggcaagggccgggagaagcgcatcaagcccatcgacgtgctgaacgacaaggtggccaagttccgcaacgcgaccaaccacaagtacgcgaactacatcgtccagcagtgcctcaagtacaactgcgggacgatccacctggaagacctcaaggggatcagcaaggagcagaccttcctcaagaactggacgtacttcgacctccaggagaagatcaagaaccaggccaaccagtacggcgtgaaggtggtgaagatcgaccccagctacacctcccagcggtgctcggagtgcggctacatccacaagaacaaccgccaggaccagtccaccttcgagtgccagcagtgctccttcaaggtgcacgccgactacaacgccgccaagaacatctccgtgtacaacatcgagaaggtgatccagaagcagctcgaactccaggaaaagctgaaccagaccaagtacaaggagcagtacatcgagcagatgaagaacatcaactga

SEQ ID NO: 2432 - DNA, 1353 bp, Unknown
  Bacillus sp. multi
ctgtccatcgccgtgaaggtgatgaagtaccagatcgtgtgccccgtcaacatcgagtggaagaccttcgagatctatctgcggacgctctcgtaccacttccgcaccatcggcaaccgcaccatccagaagctgtgggagtacgacaaccagtcgctcaagcacttcaaggacaccgggcagtacccgagcgcccagcagctctacggctgcacgcagaagacgatcagcggctacatctacgaccagctcaaggaggagtaccaggacatcaacaaggcgaacatgagcaccaccctccagaaaactatccgcacgtggaactcccgcaagaaggagatctggagcggggagatgagcatcccgtccttccggaacaacctccccatcgacatccacgggaactccatccagatcatcaaggagaagtccggcgactacatcgcgtccgtgagcctcttcagcagcaagttcatcaaggagaacgacctgcccaacggcaagatcctggtgaagctctcgacccggaagcagaactcgatgaaggtcatcctcgaccggatcatcgactccacctacgcgaagggcgcgtgcatgctccacaagcacaagaagaagtggtacttgagcatcacgtacaagagcaacatcaaggaggagttgaagttcgacgaagatctcatcatgggcatcgacatgggcaagatcaacgtcctctacttcgccttcaacaagggcctcgtgcgcggggcgatctccggcgaggagatcgaggcgttccgcaagaagatcgagcaccgccggatcagcctgctgcgccaggggaagtattgctcggggaaccgcatcgggaaggggcgggagaagcgcatcaagcccatcgacgtcctgaacgacaaggtggccaagttccgcaacgccacgaaccacaagtacgcgaactacatcgtgcagcagtgcctcaagtacaactgcgggacgatccacctggaggacctcaaggggatctcgaaggagcagaccttcctcaagaactggacgtacttcgacctccaggagaagatcaagaaccaggcgaaccagtacggcgtgaaggtggtgaagatcgacccgtcctacaccagccagcggtgctccgagtgcggctacatccacaagaacaaccgccaggaccagagcaccttcgagtgccagcagtgcagcttcaaggtccacgccgactacaacgcggccaagaacatcagcgtgtacaacatcgagaaggtgatccagaagcagctggagctacaggagaaactgaaccagaccaagtacaaggagcagtacatcgagcagatgaagaacatcaactga

SEQ ID NO: 2433 - DNA, 1353 bp, Unknown
  Bacillus sp. multi
ctgagcatcgccgtcaaggtgatgaagtaccagatcgtgtgccccgtcaacatcgagtggaagaccttcgagatctacctccggacgctgagctaccacttccgcaccatcgggaaccgcacgatccagaagctgtgggagtacgacaaccagagcctcaagcacttcaaggacacgggccagtacccctcggcccagcagctctacggctgcacgcagaagaccatctcgggctacatctacgaccagctcaaggaggagtaccaggacatcaacaaggccaacatgagcaccaccctccagaagaccatccggacctggaacagccgcaagaaggagatatggagcggcgagatgagcatcccgtccttccgcaacaacctccccatcgacatccacggcaacagcatccagatcatcaaggagaagtccggcgactacatcgcgtcggtgtccctgttcagcagcaagttcatcaaggagaacgacctcccgaacgggaagatcctggtgaagctctccacccgcaagcagaactccatgaaggtcatcctggaccggatcatcgacagcacgtacgcgaagggcgcgtgcatgctgcacaagcacaagaagaagtggtacctctccatcacctacaagtcgaacatcaaggaggagttgaagttcgacgaggatctgataatggggatcgacatgggcaagatcaacgtcctgtacttcgccttcaacaaggggctggtgcgcggggccatcagcggcgaggagatcgaggcgttccgcaagaagatcgagcaccgccgcatctccctgctgcgccagggcaaatactgctcggggaaccgcatcgggaaggggcgcgagaagcggatcaagcccatcgacgtcctcaacgacaaggtggccaagttccgcaacgcgaccaaccacaagtacgccaactacatcgtgcagcagtgcctcaagtacaactgcggcacgatccacctggaggacttgaaggggatctcgaaggagcagaccttcctcaagaactggacgtacttcgacctccaggagaaaatcaagaaccaggccaaccagtacggggtcaaggtggtgaagatcgacccgtcctacacgagccagcggtgctcggagtgcggctacatccacaagaacaaccgccaggaccagagcaccttcgagtgccagcagtgctcgttcaaggtgcacgcggactacaacgcggccaagaacatctccgtgtacaacatcgagaaggtcatccagaaacagcttgagcttcaggagaagctgaaccagaccaagtacaaggagcagtacatcgagcagatgaagaacatcaactga

SEQ ID NO: 2434 - DNA, 1353 bp, Unknown
  Bacillus sp. multi
ctgtccatcgccgtcaaggtcatgaagtaccagatcgtgtgcccggtcaacatcgagtggaagacgttcgagatctacctgcggacgctctcgtaccacttccgcaccatcgggaaccggacgatccagaagctgtgggagtacgacaaccagtcgctcaagcacttcaaggacaccgggcagtacccctcggcgcagcagctctacgggtgcacgcagaagaccatctccggctacatctacgaccagctcaaggaggagtaccaggacatcaacaaggccaacatgagcaccaccctccagaaaacgatccgcacctggaacagccgcaagaaggagatatggagcggggagatgtccatcccgagcttccgcaacaacctccccatcgacatccacggcaacagcatccagatcatcaaggagaagtccggcgactacatcgcgtccgtctccctgttctcctccaagttcatcaaggagaacgacctccccaacgggaagatcctggtcaagctctccacccgcaagcagaacagcatgaaggtgatcctcgaccggatcatcgactccacgtacgcgaagggcgcgtgcatgttacacaagcacaagaagaagtggtatctttcgatcacctacaagagcaacatcaaggaggagctcaagttcgacgaggaccttatcatggggatcgacatggggaagatcaacgtgctgtacttcgcgttcaacaagggcctcgtccggggcgcgatctccggcgaggagatcgaggcgttccgcaagaagatcgagcaccgccggatctccctgctgcgccagggcaaatactgctcggggaaccgcatcggcaaggggcgggagaagcggatcaagcccatcgacgtgctcaacgacaaggtggccaagttccgcaacgcgacgaaccacaagtacgccaactacatcgtccagcagtgcctcaagtacaactgcggcaccatccacctggaggatctcaaggggatcagcaaggagcagacgttcctcaagaactggacgtacttcgacctccaggagaagatcaagaaccaggcgaaccagtacggggtgaaggtcgtgaagatcgacccgagctacacctcccagcggtgcagcgagtgcggctacatccacaagaacaaccgccaggaccagagcacgttcgagtgccagcagtgctcgttcaaggtccacgcggactacaacgcggccaagaacatcagcgtgtacaacatcgagaaggtcatccagaagcagctcgaactccaggagaagctgaaccagaccaagtacaaggagcagtacatcgagcagatgaagaacatcaactga

SEQ ID NO: 2435 - DNA, 1332 bp, Unknown
  Bacillus sp. multi
atgaagtaccagatcgtgtgccccgtcaacatcgagtggaagaccttcgaaatctacctccgcaccctgagctaccacttccgcaccatcggcaaccgcaccatccagaagctgtgggagtacgacaaccagtcgctcaagcacttcaaggacaccggccagtacccctccgcccagcagctctacggctgcacccagaagacgatctccggctacatctacgaccagctcaaggaggagtaccaggacatcaacaaggccaacatgagcacgaccctccagaagaccatcaagacgtggaacagccgcaagaaggagatctggagcggcgagatgagcatccccagcttccggaacaacctgcccatcgacatccacggcaactcgatccagatcatcaaggagaagtcgggcgactacatcgccagcgtcagcctgttctccagcaagttcatcaaggagaacgacctcccgaacgggaagatcctggtcaagctctcgacccgcaagcagaactccatgaaggtcatcctcgaccgcatcatcgactccacgtacgcgaagggcgcgtgcatgctccacaagcacaagaagaaatggtacctgtccatcacctacaagtcgaacatcaaggaggagctcaagttcgacgaggacttaatcatgggcatcgacatgggcaagatcaacgtgctgtacttcgccttcaacaagggcctggtccggggcgcgatctcgggcgaggagatcgaggcgttccgcaagaaaatcgagcaccggcgcatcagcctgctgcgccagggcaagtactgctccggcaaccgcatcgggaaggggcgcaagaagcgcatcaagcccatcgaggtgctgaacgacaagatcgccaagttccgcacggcgaccaaccacaagtacgccaactacatcgtgcagcagtgcctcaagtacaactgcggcaccatacagctcgaagacctccaggggatcagcaaggagcagacgttcctcaagaactggacgtacttcgacctccaggagaagatcaagaaccaggcgaaccagtacgggatcaaggtcgtgaagatcgacccctcctacaccagccagcggtgcagcgagtgcggctacatccacaagaacaaccgccagaaccagagcaccttcgagtgccagcagtgctcgttcaaggtccacgccgactacaacgccgccaagaacatcagcgtgtacaacatcgagaaggtcatccagcggcagctcaagctccaggagaagctcaacctgaccaagtacaaggagcagtacatcgagcagatggagaacatcaactga

SEQ ID NO: 2436 - DNA, 1332 bp, Unknown
  Bacillus sp. multi
atgaagtaccagatcgtgtgcccggtgaacatcgagtggaagaccttcgagatctatctgcggaccctcagctaccacttccggaccatcggcaaccggaccatccagaagctctgggagtacgacaaccagagcctcaagcacttcaaggacacgggccagtacccgagcgcccagcagctctacgggtgcacgcagaaaacgatctccggctacatctacgaccagctcaaggaggagtaccaggacatcaacaaggcgaacatgagcacgaccctccagaagacgatcaagacgtggaactcccgcaagaaggagatttggagcggcgagatgagcatccccagcttccgcaacaacctgcccatcgacatccacggcaacagcatccagatcatcaaggagaagtccggcgactacatcgcctccgtctcgctgttcagctcgaagttcatcaaggagaacgacctgccgaacggcaagatcctggtgaagctgtccacccgcaagcagaacagcatgaaggtgatcctcgaccggatcatcgacagcacgtacgcgaagggcgcgtgcatgctgcacaagcacaagaagaagtggtacctgagcatcacctacaagtccaacatcaaggaggagctgaagttcgacgaggacctcattatggggatcgacatgggcaagatcaacgtgctctacttcgccttcaacaaggggctggtgcggggcgcgatctcgggcgaggagatcgaggcgttccgcaagaagatcgagcaccgccgcatcagcctcctgcgccaggggaagtactgctcggggaaccgcatcggcaaggggcgcaagaagcggatcaagcccatcgaggtgctgaacgacaagatcgccaagttccgcaccgcgacgaaccacaagtacgcgaactacatcgtccagcagtgcctcaagtacaactgcgggaccatccagcttgaggatctccagggtatcagcaaggagcagacgttcctcaagaactggacctacttcgacctccaggagaagatcaagaaccaggcgaaccagtacgggatcaaggtggtgaagatcgacccgagctacacgagccagcggtgctccgagtgcgggtacatccacaagaacaaccgccagaaccagagcacgttcgagtgccagcagtgctcgttcaaggtgcacgcggactacaacgccgccaagaacatctcggtgtacaacatcgagaaggtgatccagcggcagctcaagctccaggagaagctgaacctcaccaagtacaaggagcagtacatcgagcagatggagaacatcaactga

SEQ ID NO: 2437 - DNA, 1332 bp, Unknown
  Bacillus sp. multi
atgaagtaccagatcgtctgccccgtgaacatcgagtggaagacgttcgagatctatctccggaccctcagctaccacttccggaccatcggcaaccgcaccatccagaagctctgggagtacgacaaccagtccctcaagcacttcaaggacacgggccagtacccctccgcccagcagctctacggctgcacccagaagaccatcagcgggtacatctacgaccagctcaaggaggagtaccaggacatcaacaaggcgaacatgagcaccaccctccagaagaccatcaagacctggaactcgcgcaagaaggagatctggagcggcgagatgtccatccccagcttccgcaacaacctccccatcgacatccacggcaacagcatccagatcatcaaggagaagtccggcgactacatcgcctcggtgagcctgttctcctccaagttcatcaaggagaacgacctgccgaacggcaagatcctggtgaagctgtccacccggaagcagaactccatgaaggtcatcctggaccggatcatcgactccacgtacgcgaagggcgcgtgcatgcttcacaagcacaagaagaagtggtatctgtccatcacctacaagtccaacatcaaggaggagcttaagttcgacgaagacctgatcatgggcatcgacatgggcaagatcaacgtgctgtacttcgcgttcaacaagggcctggtccggggcgcgatcagcggcgaggagatcgaggcgttccgcaagaagatcgagcaccgccggatctcgctcctgcgccagggcaaatactgctccggcaaccggatcgggaagggccgcaagaagcggatcaagcccatcgaggtgctgaacgacaagatcgccaagttccgcacggccaccaaccacaagtacgcgaactacatcgtccagcagtgcctcaagtacaactgcggcacgatccagctcgaagacctccagggcatcagcaaggagcagaccttcctcaagaactggacctacttcgacctccaggagaagatcaagaaccaggcgaaccagtacggcatcaaggtcgtgaagatcgacccctcctacaccagccagcgctgctcggagtgcggctacatccacaagaacaaccggcagaaccagagcaccttcgagtgccagcagtgctcgttcaaggtccacgccgactacaacgccgccaagaacatctcggtgtacaacatcgagaaggtgatccagcggcagctcaagctccaggagaagctcaacctgacgaagtacaaggagcagtacatcgagcagatggagaacatcaactag

SEQ ID NO: 2438 - DNA, 1332 bp, Unknown
  Bacillus sp. multi
atgaagtaccagatcgtgtgccccgtgaacatcgagtggaagacgttcgagatctacctgcggacgctgagctaccacttccgcaccatcggcaaccgcaccatccagaagctgtgggagtacgacaaccagtccctcaagcacttcaaggacaccggccagtacccgtcggcccagcagctctacggctgcacgcagaaaaccatctccggctacatctacgaccagctcaaggaggagtaccaggacatcaacaaggcgaacatgagcaccaccctccagaagaccatcaagacgtggaactcccgcaagaaggagatttggagcggcgagatgtccatcccgtcgttccgcaacaacctccccatcgacatccacggcaactcgatccagatcatcaaggagaagtccggcgactacatcgcctccgtgtccctgttctcctccaagttcatcaaggagaacgacctccccaacggcaagatcctggtgaagctgtccacccgcaagcagaactcgatgaaggtgatcctcgaccggatcatcgacagcacgtacgcgaagggcgcgtgcatgctccacaagcacaagaagaagtggtacctgagcatcacctacaagagcaacatcaaggaggagctaaagttcgacgaggatctgatcatgggcatcgacatgggcaagatcaacgtcctgtacttcgcgttcaacaagggcctggtgcgcggcgcgatcagcggcgaggagatcgaggcgttccgcaagaagatagagcaccgccggatctccctgctgcgccagggcaagtactgctccggcaaccggatcgggaagggccgcaagaaacgcatcaagcccatcgaggtgctgaacgacaagatcgccaagttccgcaccgcgacgaaccacaagtacgcgaactacatcgtgcagcagtgcctcaagtacaactgcgggaccatccagttggaggacctccagggcatcagcaaggagcagacgttcctcaagaactggacctacttcgacctccaggagaagatcaagaaccaggcgaaccagtacggcatcaaggtcgtgaagatcgaccccagctacacgagccagcgctgctcggagtgcggctacatccacaagaacaaccggcagaaccagtccaccttcgagtgccagcagtgcagcttcaaggtgcacgcggactacaacgcggccaagaacatcagcgtgtacaacatcgagaaggtgatccagcgccagctcaagctccaggagaagctgaacctcaccaagtacaaggagcagtacatcgagcagatggagaacatcaactag

SEQ ID NO: 2439 - DNA, 1332 bp, Unknown
  Bacillus sp. multi
atgaagtaccagatcgtctgcccggtgaacatcgagtggaagaccttcgagatatacctgcggaccctgagctaccacttccggaccatcggcaaccggacgatccagaagctctgggagtacgacaaccagtcgctcaagcacttcaaggacacgggccagtacccctcggcccagcagctctacggctgcacccagaagacgatcagcggctacatctacgaccagctcaaggaggagtaccaggacatcaacaaggcgaacatgagcacgaccctccagaagacgatcaagacgtggaactcccgcaagaaggagatatggagcggcgagatgtccatcccctccttccgcaacaacctgcccatcgacatccacggcaacagcatccagatcatcaaggagaagtcgggcgactacatcgcgtccgtctccctgttctcctcgaagttcatcaaggagaacgacctcccgaacgggaagatcctggtgaagctcagcacccgcaagcagaactccatgaaggtcatcctggaccgcatcatcgactcgacgtacgcgaagggcgcgtgcatgctccacaagcacaagaagaagtggtatctgtccatcacctacaagtccaacatcaaggaggagctaaagttcgacgaagacctgatcatggggatcgacatggggaagatcaacgtcctgtacttcgccttcaacaagggcctcgtgcgcggggccatctccggcgaggagatcgaggcgttccgcaagaagatagagcaccgccgcatctccctgctccgccagggcaagtactgctccggcaaccgcatcggcaagggccgcaagaagcgcatcaagcccatcgaggtgctgaacgacaagatcgccaagttccgcaccgccacgaaccacaagtacgcgaactacatcgtgcagcagtgcctcaagtacaactgcgggacgatccagttggaggacctccaggggatcagcaaggagcagaccttcctcaagaactggacgtacttcgacctccaggagaagatcaagaaccaggcgaaccagtacggcatcaaggtggtcaagatcgacccgagctacaccagccagcggtgctccgagtgcggctacatccacaagaacaaccggcagaaccagagcacgttcgagtgccagcagtgctcgttcaaggtgcacgccgactacaacgccgccaagaacatctccgtgtacaacatcgagaaggtgatccagcgccagctcaagctccaggagaagctcaacctgacgaagtacaaggagcagtacatcgagcagatggagaacatcaactag

SEQ ID NO: 2440 - DNA, 1353 bp, Unknown
  Bacillus sp. multi
ctcagcatcgcggtcaaggtcatgaagtaccagatcgtgtgccccgtcaacatcgagtggaagacgttcgagatctacctccgcaccctctcctaccacttccggaccatcggcaaccgcaccatccagaagctctgggagtacgacaaccagtccctcaagcacttcaaggacacggggcagtacccgtccgcccagcagctctacggctgcacgcagaaaacgatctccggctacatctacgaccagctcaaggaggagtaccaggacatcaacaaggccaacatgagcacgaccctccagaaaaccatcaagacgtggaacagccgcaagaaggagatctggagcggcgagatgagcatcccgtccttccgcaacaacctgcccatcgacatccacggcaactcgatccagatcatcaaggagaagtccggcgactacatcgcgtccgtctccctcttcagcagcaagttcatcaaggagaacgacctccccaacgggaagatcctggtcaagctcagcacccgcaagcagaactccatgaaggtgatcctggaccgcatcatcgactcgacgtacgcgaagggcgcgtgcatgctccacaagcacaagaagaaatggtacctctccatcacgtacaagagcaacatcaaggaggagctaaagttcgacgaggaccttatcatgggcatcgacatggggaagatcaacgtcctctacttcgccttcaacaagggcctcgtgcggggcgcgatctccggcgaggagatcgaggcgttccgcaagaagatcgagcaccggcgcatcagcctgctccgccaggggaaatactgctccggcaaccggatcggcaaggggcgcaagaagcgcatcaagcccatcgaggtgctgaacgacaagatcgccaagttccgcaccgcgaccaaccacaagtacgcgaactacatcgtgcagcagtgcctcaagtacaactgcggcaccatccagctcgaggatctccaggggatcagcaaggagcagaccttcctcaagaactggacctacttcgacctccaggagaagatcaagaaccaggcgaaccagtacggcatcaaggtcgtcaagatcgacccgagctacaccagccagcggtgctcggagtgcggctacatccacaagaacaaccgccagaaccagtccacgttcgagtgccagcagtgctcgttcaaggtgcacgcggactacaacgccgccaagaacatctccgtgtacaacatcgagaaggtgatccagaagcagctcaagctccaggagaagctgaacctgaccaagtacaaggcgcagtacatcgagcagatggagaacatcaactga

SEQ ID NO: 2441 - DNA, 1353 bp, Unknown
  Bacillus sp. multi
ctctccatcgcggtcaaggtgatgaagtaccagatcgtgtgcccggtcaacatcgagtggaagaccttcgagatatacctgcggacgctcagctaccacttccggaccatcggcaaccgcacgatccagaagctctgggagtacgacaaccagtcgctcaagcacttcaaggacaccggccagtacccgtccgcccagcagctctacgggtgcacgcagaaaactatcagcggctacatctacgaccagctcaaggaggagtaccaggacatcaacaaggccaacatgagcaccaccctccagaaaacgatcaagacctggaactcccgcaagaaggagatatggagcggcgagatgtccatcccctccttccgcaacaacctccccatcgacatccacgggaacagcatccagatcatcaaggagaagtccggcgactacatcgccagcgtgtccctgttcagcagcaagttcatcaaggagaacgacctccccaacggcaagatcctggtgaagctctccacgcggaagcagaacagcatgaaggtgatcctggaccgcatcatcgactcgacgtacgcgaagggcgcgtgcatgctccacaagcacaagaagaagtggtacttgagcatcacctacaagtccaacatcaaggaggagctgaagttcgacgaggacctgatcatgggcatcgacatggggaagatcaacgtcctgtacttcgcgttcaacaaggggctggtgcgcggggcgatctccggcgaggagatcgaggcgttccgcaagaagatcgagcaccggcgcatcagcctcctccgccagggcaagtactgctccggcaaccggatcggcaagggccgcaagaagcgcatcaagcccatcgaggtgctgaacgacaagatcgccaagttccgcacggcgacgaaccacaagtacgccaactacatcgtgcagcagtgcctcaagtacaactgcggcaccatccagttggaggacctccaggggatcagcaaggagcagaccttcctcaagaactggacgtacttcgacctccaggagaagatcaagaaccaggcgaaccagtacggcatcaaggtcgtgaagatcgacccgagctacacgagccagcgctgctcggagtgcggctacatccacaagaacaaccggcagaaccagtccaccttcgagtgccagcagtgcagcttcaaggtccacgccgactacaacgcggccaagaacatctcggtgtacaacatcgagaaggtgatccagaagcagctcaagctccaggagaagctgaacctcaccaagtacaaggcgcagtacatcgagcagatggagaacatcaactga

SEQ ID NO: 2442 - DNA, 1353 bp, Unknown
  Bacillus sp. multi
ctctccatcgcggtgaaggtcatgaagtaccagatcgtgtgccccgtgaacatcgagtggaagaccttcgagatatacctccggacgctctcctaccacttccggaccatcggcaaccgcaccatccagaagctgtgggagtacgacaaccagtccctcaagcacttcaaggacacgggccagtacccgtccgcccagcagctctacgggtgcacgcagaagacgatcagcggctacatctacgaccagctcaaggaggagtaccaggacatcaacaaggccaacatgagcaccaccctccagaaaacgatcaagacgtggaactcccgcaagaaggaaatctggagcggcgagatgagcatcccgtccttccgcaacaacctccccatcgacatccacgggaacagcatccagatcatcaaggagaagtcgggcgactacatcgcctccgtctccctcttcagcagcaagttcatcaaggagaacgacctcccgaacggcaagatcctggtcaagctctccacccggaagcagaactccatgaaggtgatcctggaccggatcatcgacagcacctacgcgaagggcgcgtgcatgctgcacaagcacaagaagaagtggtacctgtccatcacctacaagagcaacatcaaggaggagctgaagttcgacgaggacctcatcatgggcatcgacatggggaagatcaacgtcctctacttcgcgttcaacaagggcctcgtgcggggcgcgatcagcggggaggagatcgaggcgttccgcaagaagatcgagcaccggcgcatctcgctgctccgccagggcaaatactgttcgggcaaccgcatcgggaaggggcgcaagaagcgcatcaagcccatcgaggtgctgaacgacaagatcgccaagttccggacggcgaccaaccacaagtacgccaactacatcgtgcagcagtgcctcaagtacaactgcggcacgatccagttggaggatctccagggcatcagcaaggagcagaccttcctcaagaactggacgtacttcgacctccaggagaagatcaagaaccaggcgaaccagtacgggatcaaggtcgtcaagatcgacccctcctacacctcccagcgctgctcggagtgcgggtacatccacaagaacaaccggcagaaccagtccacgttcgagtgccagcagtgcagcttcaaggtgcacgcggactacaacgcggccaagaacatctccgtgtacaacatcgagaaggtcatccagaagcagctcaagctccaggagaagctcaacctcaccaagtacaaggcccagtacatcgagcagatggagaacatcaactga

SEQ ID NO: 2443 - DNA, 1353 bp, Unknown
  Bacillus sp. multi
ctctccatcgccgtgaaggtcatgaagtaccagatcgtgtgcccggtcaacatcgagtggaagacgttcgaaatctacctccgcacgctctcctaccacttccggaccatcgggaaccgcaccatccagaagctctgggagtacgacaaccagtcgctcaagcacttcaaggacacggggcagtacccctcggcgcagcagctctacggctgcacccagaagaccatctcgggctacatctacgaccagctcaaggaggagtaccaggacatcaacaaggcgaacatgagcacgaccctccagaagaccatcaagacgtggaactcccgcaagaaggagatatggagcggcgagatgagcatcccgtccttccggaacaacctccccatcgacatccacggcaacagcatccagatcatcaaggagaagtccggcgactacatcgcctcggtcagcctgttcagcagcaagttcatcaaggagaacgacctcccgaacgggaagatcctggtgaagctgtccacgcggaagcagaactcgatgaaggtgatcctcgaccggatcatcgactcgacctacgcgaagggcgcgtgcatgctgcacaagcacaagaagaagtggtacctgagcatcacctacaagagcaacatcaaggaggagctgaagttcgacgaggacttgatcatggggatcgacatgggcaagatcaacgtgctctacttcgcgttcaacaagggcctggtgcggggcgcgatctcgggcgaggagatcgaggcgttccgcaagaaaatcgagcaccgccggatcagcctcctgcgccaggggaaatactgctccggcaaccgcatcggcaagggccgcaagaagcgcatcaagcccatcgaggtgctgaacgacaagatcgccaagttccgcaccgcgacgaaccacaagtacgccaactacatcgtccagcagtgcctcaagtacaactgcgggacgatccagctcgaagacttgcagggcatcagcaaggagcagaccttcctcaagaactggacgtacttcgacctccaggagaagatcaagaaccaggccaaccagtacgggatcaaggtggtgaagatcgacccgtcctacaccagccagcggtgctcggagtgcggctacatccacaagaacaaccggcagaaccagagcaccttcgagtgccagcagtgcagcttcaaggtgcacgccgactacaacgcggccaagaacatcagcgtgtacaacatcgagaaggtgatccagaagcagctcaagctccaggagaagctcaacctcacgaagtacaaggcccagtacatcgagcagatggagaacatcaactga

SEQ ID NO: 2444 - DNA, 1353 bp, Unknown
  Bacillus sp. multi
ctgtccatcgccgtgaaggtgatgaagtaccagatcgtgtgccccgtgaacatcgagtggaagacgttcgagatctacctgcggacgctgagctaccacttccggaccatcgggaaccgcaccatccagaagctgtgggagtacgacaaccagtcgctcaagcacttcaaggacaccggccagtaccccagcgcccagcagctctacgggtgcacgcagaagacgatctccgggtacatctacgaccagctcaaggaggagtaccaggacatcaacaaggccaacatgagcaccaccctccagaaaactatcaagacgtggaactcccgcaagaaggagatctggagcggcgagatgagcatcccctccttccgcaacaacctgcccatcgacatccacgggaactccatccagatcatcaaggagaagtccggcgactacatcgcgtccgtcagcctgttctcctccaagttcatcaaggagaacgacctccccaacggcaagatcctggtcaagctcagcacccgcaagcagaactccatgaaggtcatcctcgaccgcatcatcgactcgacctacgcgaagggcgcgtgcatgctgcacaagcacaagaagaagtggtacctgtcgatcacctacaagtccaacatcaaggaggagttgaagttcgacgaggacctcatcatggggatcgacatgggcaagatcaacgtgctctacttcgcgttcaacaaggggctggtgcgcggggcgatcagcggggaggagatcgaggcgttccgcaagaagatcgagcaccggcgcatctccctgctgcgccagggcaagtattgctcgggcaaccgcatcggcaagggccgcaagaagcgcatcaagcccatcgaggtgctgaacgacaagatcgccaagttccgcacggccaccaaccacaagtacgccaactacatcgtgcagcagtgcctcaagtacaactgcggcaccatccaactggaagacctccaggggatcagcaaggagcagacgttcctcaagaactggacctacttcgacctccaggagaaaatcaagaaccaggcgaaccagtacggcatcaaggtggtgaagatcgacccctcctacaccagccagcggtgcagcgagtgcggctacatccacaagaacaaccgccagaaccagagcaccttcgagtgccagcagtgcagcttcaaggtccacgcggactacaacgccgccaagaacatcagcgtgtacaacatcgagaaggtcatccagaagcagctcaagctccaggagaagctcaacctcaccaagtacaaggcgcagtacatcgagcagatggagaacatcaactga

SEQ ID NO: 2445 - DNA, 1353 bp, Unknown
  Bacillus sp. multi
ctcagcatcgcggtgaaggtcatgaagtaccagatcgtgtgccccgtgaacatcgagtggaagacgttcgagatatacctccggaccctcagctaccacttccggaccatcgggaaccgcaccatccagaagctgtgggagtacgacaaccagtcgctcaagcacttcaaggacacgggccagtacccgagcgcccagcagctctacggctgcacgcagaaaaccatctccgggtacatctacgaccagctcaaggaggagtaccaggacatcaacaaggcgaacatgagcaccaccctccagaagaccatcaagacctggaactcgcgcaagaaggagatctggagcggcgagatgagcatcccgtcgttccgcaacaacctccccatcgacatccacggcaactccatccagatcatcaaggagaagtccggggactacatcgccagcgtgtccctgttcagcagcaagttcatcaaggagaacgacctccccaacgggaagatcctggtgaagctgagcacccgcaagcagaactcgatgaaggtgatcctggaccggatcatcgacagcacctacgcgaagggcgcgtgcatgttgcacaagcacaagaagaagtggtatctgagcatcacctacaagagcaacatcaaggaggagctgaagttcgacgaggacttgattatggggatcgacatggggaagatcaacgtcctctacttcgccttcaacaaggggctggtgcgcggggcgatcagcggcgaggagatcgaggcgttccgcaagaagatcgagcaccgccgcatctcgctgctgcgccaggggaagtactgctcggggaaccgcatcggcaagggccgcaagaagcggatcaagcccatcgaggtgctgaacgacaagatcgccaagttccggacggcgaccaaccacaagtacgcgaactacatcgtgcagcagtgcctcaagtacaactgcgggaccatacagctggaggatctccagggcatctcgaaggagcagaccttcctcaagaactggacgtacttcgacctccaggagaagatcaagaaccaggccaaccagtacggcatcaaggtcgtcaagatcgacccctcctacacctcgcagcggtgctccgagtgcggctacatccacaagaacaaccgccagaaccagtccaccttcgagtgccagcagtgcagcttcaaggtccacgccgactacaacgccgccaagaacatctccgtgtacaacatcgagaaggtgatccagcgccagctcaagctccaggagaagctgaacctgacgaagtacaaggagcagtacatcgagcagatggagaacatcaactga

SEQ ID NO: 2446 - DNA, 1353 bp, Unknown
  Bacillus sp. multi
ctctccatcgccgtgaaggtcatgaagtaccagatcgtgtgccccgtcaacatcgagtggaagaccttcgagatatacctgcggacgctctcgtaccacttccgcaccatcgggaaccgcacgatccagaagctgtgggagtacgacaaccagagcctcaagcacttcaaggacaccgggcagtacccgtccgcccagcagctctacggctgcacccagaagaccatctcgggctacatctacgaccagctcaaggaggagtaccaggacatcaacaaggccaacatgagcacgaccctccagaaaacgatcaagacctggaactcccgcaagaaggagatctggagcggggagatgagcatccccagcttccggaacaacctccccatcgacatccacggcaacagcatccagatcatcaaggagaagtcgggcgactacatcgcctccgtctccctgttctcctccaagttcatcaaggagaacgacctgcccaacggcaagatcctggtgaagctgtccacgcggaagcagaactccatgaaggtcatcctcgaccggatcatcgactccacgtacgcgaagggcgcgtgcatgctgcacaagcacaagaagaagtggtacttgtccatcacctacaagtcgaacatcaaggaggagctgaagttcgacgaggacctcattatgggcatcgacatgggcaagatcaacgtgctgtacttcgccttcaacaagggcctcgtgcgcggcgcgatcagcggcgaggagatcgaggcgttccgcaagaagatcgagcaccgccgcatcagcctgctgcgccagggcaaatactgctcggggaaccgcatcggcaagggccgcaagaagcggatcaagcccatcgaggtgctgaacgacaagatcgccaagttccgcaccgcgaccaaccacaagtacgccaactacatcgtgcagcagtgcctcaagtacaactgcgggacgatccagctcgaagacttacagggcatcagcaaggagcagaccttcctcaagaactggacgtacttcgacctccaggagaagatcaagaaccaggcgaaccagtacgggatcaaggtcgtgaagatcgacccgagctacacctcccagcggtgctccgagtgcggctacatccacaagaacaaccgccagaaccagtccaccttcgagtgccagcagtgctcgttcaaggtccacgcggactacaacgcggccaagaacatctcggtgtacaacatcgagaaggtgatccagcggcagctcaagctccaggagaagctcaacctcaccaagtacaaggagcagtacatcgagcagatggagaacatcaactga

SEQ ID NO: 2447 - DNA, 1353 bp, Unknown
  Bacillus sp. multi
ctctccatcgcggtcaaggtgatgaagtaccagatcgtgtgccccgtgaacatcgagtggaagaccttcgagatctacctgcggacgctctcctaccacttccggaccatcgggaaccggacgatccagaagctctgggagtacgacaaccagtccctcaagcacttcaaggacaccgggcagtacccgtcggcgcagcagctctacggctgcacccagaagacgatctccggctacatctacgaccagctcaaggaggagtaccaggacatcaacaaggcgaacatgagcaccaccctccagaaaaccatcaagacgtggaacagccgcaagaaggagatctggagcggcgagatgtccatcccgtcgttccgcaacaacctccccatcgacatccacggcaacagcatccagatcatcaaggagaagtccggcgactacatcgcctcggtgagcctcttcagcagcaagttcatcaaggagaacgacctcccgaacggcaagatcctggtcaagctgtccacccgcaagcagaactccatgaaggtcatcctggaccggatcatcgactccacgtacgcgaagggcgcgtgcatgctccacaagcacaagaagaagtggtacctgtccatcacctacaagtccaacatcaaggaggaactgaaattcgacgaagaccttatcatggggatcgacatgggcaagatcaacgtgctgtacttcgccttcaacaagggcctcgtccggggcgcgatctccggcgaggagatcgaggcgttccgcaagaaaatcgagcaccggcggatcagcctcctgcgccaggggaaatactgctcgggcaaccgcatcggcaaggggcgcaagaagcgcatcaagcccatcgaggtgctgaacgacaagatcgccaagttccgcacggcgaccaaccacaagtacgcgaactacatcgtgcagcagtgcctcaagtacaactgcggcaccatccagctcgaagacctgcaggggatcagcaaggagcagacgttcctcaagaactggacctacttcgacctccaggagaagatcaagaaccaggccaaccagtacggcatcaaggtggtcaagatcgacccgtcctacacgagccagcggtgcagcgagtgcggctacatccacaagaacaaccgccagaaccagagcacgttcgagtgccagcagtgctcgttcaaggtccacgccgactacaacgccgccaagaacatctcggtgtacaacatcgagaaggtcatccagcggcagctcaagctccaggagaagctgaacctcaccaagtacaaggagcagtacatcgagcagatggagaacatcaactag

SEQ ID NO: 2448 - DNA, 1353 bp, Unknown
  Bacillus sp. multi
ctcagcatcgccgtgaaggtcatgaagtaccagatcgtgtgcccggtcaacatcgagtggaagaccttcgagatctacctccggacgctctcctaccacttccgcaccatcggcaaccgcaccatccagaagctgtgggagtacgacaaccagtccctcaagcacttcaaggacacgggccagtacccgtccgcccagcagctctacggctgcacgcagaaaaccatcagcggctacatctacgaccagctcaaggaggagtaccaggacatcaacaaggcgaacatgagcacgaccctccagaaaacgatcaagacgtggaactcccgcaagaaggagatttggagcggcgagatgtccatcccgtcgttccgcaacaacctccccatcgacatccacggcaactcgatccagatcatcaaggagaagtccggcgactacatcgcgtccgtgagcctgttcagcagcaagttcatcaaggagaacgacctccccaacggcaagatcctggtgaagctctccacccggaagcagaactcgatgaaggtcatcctcgaccggatcatcgacagcacgtacgcgaagggcgcgtgcatgctgcacaagcacaagaagaagtggtatctgtccatcacctacaagtcgaacatcaaggaggagctcaagttcgacgaagatctcatcatgggcatcgacatgggcaagatcaacgtcctgtacttcgcgttcaacaagggcctggtgcgcggggccatcagcggcgaggagatcgaggcgttccgcaagaagatcgagcaccgccggatctccctgctccgccaggggaaatactgctccggcaaccgcatcgggaaggggcgcaagaagcggatcaagcccatcgaggtgctgaacgacaagatcgccaagttccgcaccgccaccaaccacaagtacgcgaactacatcgtgcagcagtgcctcaagtacaactgcgggaccatccagctcgaggacctccagggtatcagcaaggagcagaccttcctcaagaactggacgtacttcgacctccaggagaagatcaagaaccaggccaaccagtacggcatcaaggtggtcaagatcgacccctcctacacctcccagcggtgctccgagtgcggctacatccacaagaacaaccgccagaaccagagcacgttcgagtgccagcagtgctccttcaaggtgcacgccgactacaacgcggccaagaacatcagcgtgtacaacatcgagaaggtgatccagcgccagctcaagctccaggagaagctcaacctcacgaagtacaaggagcagtacatcgagcagatggagaacatcaactag

SEQ ID NO: 2449 - DNA, 1353 bp, Unknown
  Bacillus sp. multi
ctgtccatcgccgtgaaggtgatgaagtaccagatcgtgtgccccgtgaacatcgagtggaagaccttcgagatctacctgcggacgctctcctaccacttccgcaccatcgggaaccgcaccatccagaagctctgggagtacgacaaccagtccctcaagcacttcaaggacaccgggcagtacccgtcggcccagcagctctacggctgcacgcagaaaacgatctcggggtacatctacgaccagctcaaggaggagtaccaggacatcaacaaggcgaacatgagcaccaccctccagaagaccatcaagacgtggaactcgcgcaagaaggagatctggagcggcgagatgagcatcccgtccttccgcaacaacctccccatcgacatccacggcaacagcatccagatcatcaaggagaagtccggggactacatcgccagcgtgtcgctgttcagcagcaagttcatcaaggagaacgacctcccgaacgggaagatcctggtgaagctgtccacccgcaagcagaacagcatgaaggtgatcctggaccggatcatcgactcgacgtacgcgaagggcgcgtgcatgttgcacaagcacaagaagaagtggtatctcagcatcacctacaagagcaacatcaaggaggagctcaagttcgacgaagacctgatcatgggcatcgacatggggaagatcaacgtcctgtacttcgccttcaacaagggcctggtccggggcgcgatcagcggcgaggagatcgaggcgttccgcaagaagatagagcaccgccggatctcgctcctgcgccagggcaagtactgctccggcaaccgcatcggcaaggggcgcaagaagcgcatcaagcccatcgaggtgctgaacgacaagatcgccaagttccgcaccgcgaccaaccacaagtacgcgaactacatcgtccagcagtgcctcaagtacaactgcggcaccatccagttggaggacttgcagggcatcagcaaggagcagacgttcctcaagaactggacctacttcgacctccaggagaagatcaagaatcaggccaaccagtacgggatcaaggtggtgaagatcgaccccagctacacgagccagcggtgcagcgagtgcgggtacatccacaagaacaaccgccagaaccagagcaccttcgagtgccagcagtgcagcttcaaggtgcacgccgactacaacgccgccaagaacatctcggtgtacaacatcgagaaggtgatccagcggcagctcaagctccaggagaagctcaacctcacgaagtacaaggagcagtacatcgagcagatggagaacatcaactga

SEQ ID NO: 2450 - DNA, 1353 bp, Unknown
  Bacillus sp. multi
ctctccatcgccgtgaaggtcatgaagtaccagatcgtctgccccgtcaacatcgagtggaagaccttcgaaatctacctgcggaccctctcctaccacttccgcaccatcgggaaccgcacgatccagaagctgtgggagtacgacaaccagtccctcaagcacttcaaggacacgggccagtacccctccgcgcagcagctctacggctgcacgcagaaaacaatcagcggctacatctacgaccagctcaaggaggagtaccaggacatcaacaaggcgaacatgagcacgaccctccagaaaactatccgcacctggaacagccgcaagaaggagatctggagcggggagatgtccatcccctcgttccgcaacaacctgcccatcgacatccacggcaacagcatccagatcatcaaggagaagtccggggactacatcgcctccgtctccctgttcagctcgaagttcatcaaggagaacgacctccccaacggcaagatcctggtgaagctgagcacccggaagcagaactccatgaaggtgatcctggaccgcatcatcgactccacgtacgcgaagggcgcgtgcatgctccacaagcacaagaagaaatggtacctgagcatcacctacaagagcaacatcaaggaggagctgaagttcgacgaagacctcatcatgggcatcgacatgggcaagatcaacgtgctctacttcgccttcaacaaggggctggtgcgcggggccatctccggcgaggagatcgaggcgttccgcaagaagatcgagcaccgccggatcagcctgctccgccagggcaagtactgctcggggaaccgcatcggcaagggccgggagaagcggatcaagcccatcgacgtgctgaacgacaaggtggccaagttccgcaacgccaccaaccacaagtacgccaactacatcgtccagcagtgcctcaagtacaactgcggcaccatccagctcgaggacttgaaggggatcagcaaggagcagaccttcctcaagaactggacgtacttcgacctccaggagaagatcaagaaccaggccaaccagtacggcgtgaaggtggtgaagatcgacccgtcctacaccagccagcgctgctccgagtgcgagtacatccacaagaacaaccgccaggaccagtccaccttcgagtgccagcagtgctccttcaaggtccacgcggactacaacgccgccaagaacatctcggtgtacaacatcgagaaggtgatccagaagcagcttgagctgcaggagaagctgaaccagaccaagtacaaggagcagtacatcgagcagatgaagaacatcaactag

SEQ ID NO: 2451 - DNA, 1353 bp, Unknown
  Bacillus sp. multi
ctgtccatcgccgtgaaggtcatgaagtaccagatcgtctgcccggtcaacatcgagtggaagaccttcgagatctacctccggacgctctcctaccacttccgcaccatcggcaaccgcacgatccagaagctctgggagtacgacaaccagagcctcaagcacttcaaggacaccggccagtacccctccgcccagcagctctacggctgcacccagaaaacgatcagcggctacatctacgaccagctcaaggaggagtaccaggacatcaacaaggcgaacatgagcacgaccctccagaagaccatccggacctggaacagccgcaagaaggagatctggagcggcgagatgagcatccccagcttccgcaacaacctccccatcgacatccacggcaactcgatccagatcatcaaggagaagtccggggactacatcgcgtccgtctcgctgttcagctcgaagttcatcaaggagaacgacctgccgaacggcaagatcctggtgaagctgtccacccgcaagcagaactccatgaaggtgatcctcgaccgcatcatcgactccacgtacgcgaagggcgcgtgcatgctgcacaagcacaagaagaagtggtacctgtcgatcacctacaagtcgaacatcaaggaggagctcaagttcgacgaggatctcattatgggcatcgacatgggcaagatcaacgtgctctacttcgcgttcaacaagggcctggtgcggggcgcgatctcgggcgaggagatcgaggcgttccgcaagaagatcgagcaccggcggatctcgctcctccgccagggcaaatactgctccgggaaccgcatcggcaaggggcgcgagaagcgcatcaagcccatcgacgtgctgaacgacaaggtggccaagttccgcaacgcgacgaaccacaagtacgccaactacatcgtccagcagtgcctcaagtacaactgcggcacgatccagctagaggaccttaaggggatcagcaaggagcagaccttcctcaagaactggacgtacttcgacctccaggagaagatcaagaaccaggccaaccagtacggggtcaaggtcgtcaagatcgacccctcctacacctcccagcggtgcagcgagtgcgagtacatccacaagaacaaccgccaggaccagtccaccttcgagtgccagcagtgcagcttcaaggtgcacgcggactacaacgcggccaagaacatctcggtgtacaacatcgagaaggtgatccagaagcagttggagttgcaggagaagctgaaccagaccaagtacaaggagcagtacatcgagcagatgaagaatatcaactga

SEQ ID NO: 2452 - DNA, 1353 bp, Unknown
  Bacillus sp. multi
ctgtccatcgcggtgaaggtgatgaagtaccagatcgtgtgcccggtgaacatcgagtggaagaccttcgagatctacctgcggaccctcagctaccacttccgcaccatcggcaaccggacgatccagaagctgtgggagtacgacaaccagtcgctcaagcacttcaaggacacgggccagtacccctccgcgcagcagctctacggctgcacgcagaagaccatctcggggtacatctacgaccagctcaaggaggagtaccaggacatcaacaaggcgaacatgagcaccaccctccagaagaccatccggacctggaacagccgcaagaaggagatctggagcggcgagatgagcatcccgtccttccgcaacaacctgcccatcgacatccacgggaactcgatccagatcatcaaggagaagtccggcgactacatcgcctccgtctccctgttcagcagcaagttcatcaaggagaacgacctgccgaacggcaagatcctggtcaagctctccacccgcaagcagaacagcatgaaggtgatcctggaccggatcatcgactccacgtacgcgaagggcgcgtgcatgttacacaagcacaagaagaagtggtacctctccatcacgtacaagtcgaacatcaaggaggagctgaaattcgacgaggatctcatcatggggatcgacatgggcaagatcaacgtgctctacttcgccttcaacaagggcctggtgcggggcgcgatcagcggggaggagatcgaggcgttccgcaagaagatcgagcaccggcggatcagcctcctgcgccaggggaagtactgctccggcaaccggatcggcaagggccgcgagaagcgcatcaagcccatcgacgtgctcaacgacaaggtggccaagttccgcaacgccaccaaccacaagtacgccaactacatcgtccagcagtgcctcaagtacaactgcgggaccattcagcttgaggacctcaaggggatcagcaaggagcagacgttcctcaagaactggacctacttcgacctccaggagaagatcaagaaccaggcgaaccagtacggcgtcaaggtcgtcaagatcgacccctcctacacctcgcagcggtgcagcgagtgcgagtacatccacaagaacaaccgccaggaccagtccaccttcgagtgccagcagtgcagcttcaaggtccacgccgactacaacgccgccaagaacatctccgtgtacaacatcgagaaggtgatccagaagcagcttgagttgcaggagaagctgaaccagacgaagtacaaggagcagtacatcgagcagatgaagaatatcaactga

SEQ ID NO: 2453 - DNA, 1353 bp, Unknown
  Bacillus sp. multi
ctcagcatcgcggtgaaggtgatgaagtaccagatcgtgtgcccggtcaacatcgagtggaagaccttcgaaatctacctccggacgctcagctaccacttccggaccatcggcaaccggacgatccagaagctctgggagtacgacaaccagtccctcaagcacttcaaggacaccgggcagtacccgtcggcccagcagctctacggctgcacgcagaaaacgatctccgggtacatctacgaccagctcaaggaggagtaccaggacatcaacaaggcgaacatgagcaccaccctccagaaaaccatccgcacgtggaactcccgcaagaaggagatctggagcggcgagatgtccatccccagcttccggaacaacctgcccatcgacatccacggcaacagcatccagatcatcaaggagaagtccggggactacatcgcctccgtgtccctgttctccagcaagttcatcaaggagaacgacctgccgaacgggaagatcctggtcaagctctcgacccgcaagcagaacagcatgaaggtgatcctcgaccgcatcatcgacagcacgtacgcgaagggcgcgtgcatgctgcacaagcacaagaagaagtggtacttgtcgatcacctacaagtcgaacatcaaggaggagcttaagttcgacgaggacttgattatgggcatcgacatgggcaagatcaacgtgctctacttcgcgttcaacaagggcctggtgcggggcgcgatctccggcgaggagatcgaggcgttccgcaagaagatcgagcaccgccgcatcagcctcctgcgccagggcaagtactgctccgggaaccgcatcggcaagggccgggagaagcggatcaagcccatcgacgtcctcaacgacaaggtggccaagttccgcaacgccaccaaccacaagtacgccaactacatcgtccagcagtgcctcaagtacaactgcggcaccatccagctcgaagacctgaaggggatcagcaaggagcagacgttcctcaagaactggacctacttcgacctccaggagaagatcaagaaccaggcgaaccagtacggggtcaaggtggtgaagatcgacccgagctacacgagccagcgctgctcggagtgcgagtacatccacaagaacaaccgccaggaccagtccaccttcgagtgccagcagtgctccttcaaggtgcacgcggactacaacgcggccaagaacatctccgtgtacaacatcgagaaggtcatccagaagcagcttgagctccaggagaagctgaaccagacgaagtacaaggagcagtacatcgagcagatgaagaacatcaactag

SEQ ID NO: 2454 - DNA, 1353 bp, Unknown
  Bacillus sp. multi
ctctccatcgcggtcaaggtgatgaagtaccagatcgtgtgccccgtcaacatcgagtggaagacgttcgagatttacctccggacgctctcctaccacttccgcaccatcgggaaccgcacgatccagaagctgtgggagtacgacaaccagagcctcaagcacttcaaggacaccgggcagtacccgtccgcgcagcagctctacggctgcacccagaaaacgatcagcgggtacatctacgaccagctcaaggaggagtaccaggacatcaacaaggccaacatgagcaccaccctccagaaaacgatccggacgtggaactcccgcaagaaggagatctggagcggcgagatgtccatcccgtcgttccgcaacaacctccccatcgacatccacggcaactcgatccagatcatcaaggagaagtccggcgactacatcgcctcggtgagcctgttctcctcgaagttcatcaaggagaacgacctcccgaacggcaagatcctggtgaagctctccacgcggaagcagaactcgatgaaggtgatcctggaccggatcatcgactcgacgtacgcgaagggcgcgtgcatgctccacaagcacaagaagaaatggtatctctccatcacctacaagtccaacatcaaggaggagctaaagttcgacgaggacctgatcatggggatcgacatgggcaagatcaacgtcctgtacttcgccttcaacaaggggctcgtgcggggcgcgatcagcggcgaggagatcgaggcgttccgcaagaagatcgagcaccggcgcatcagcctcctgcgccaggggaaatactgctcgggcaaccggatcggcaaggggcgggagaagcgcatcaagcccatcgacgtcctgaacgacaaggtggccaagttccgcaacgcgacgaaccacaagtacgcgaactacatcgtgcagcagtgcctcaagtacaactgcgggacgatccagctcgaagacctgaaggggatcagcaaggagcagaccttcctcaagaactggacctacttcgacctccaggagaagatcaagaaccaggccaaccagtacggcgtgaaggtggtgaagatcgacccgagctacacctcccagcggtgctccgagtgcgagtacatccacaagaacaaccgccaggaccagagcaccttcgagtgccagcagtgcagcttcaaggtgcacgccgactacaacgcggccaagaacatcagcgtgtacaacatcgagaaggtcatccagaagcagctggagttgcaggagaagctgaaccagaccaagtacaaggagcagtacatcgagcagatgaagaacatcaactga

SEQ ID NO: 2455 - DNA, 1353 bp, Unknown
  Bacillus sp. multi
ctgagcaaggtcgtcaaggtgatgaagtaccagatcgtctgcccgctcaacatcgagtggaaggtcttcgagatctacctgcggacgctctcgtaccacttccgcaccatcggcaaccggacgatccagaagctctgggagtacgacaaccagtcgctcaagcacttcaaggacacgggccagtacccgtccgtgcagcagctctacggctgcacgcagaaaacagtgagcgggtacatctacgaccagctcaaggaggagtaccaggacatcaacaaggcgaacatgagcacgaccctccagaaaacgatcaagacgtggaacagccgcaagaaggaaatttggagcggcgagatgagcatcccgagcttccgcaacaacctgcccatcgacgtccacggcaactccgtccaggtgacgaaggagaagtccggcgactacatcgcgtcggtgtcgctgttctccagcaagttcatcaaggagaacgacctcccgaacgggaagatcctggtgaagctctcgacgcgcaagcagaacagcatgaaggtgatcctcgacaagatcatcgacagcacctacgcgaagggcgcgtgcatgttgcacaagcacaagaacaagtggtacctgtcgatcacctacaaggccaccaagaaggaggggcacaagttcgacgaggacctcatcatggggatcgacatggggaagatcaacgccctctacttcgcctacaacaaggggctggtccggggcgtcatctcgggcgaggagatcgaggcgttccgcaagaaggtcgagtaccggcgcatcagcctgctccgccagggcaaatactgctccgagaaccgcatcggcaagggccgcaagaagcgcatcaagcccatcgaggtgctcaacgacaagatcgccaagttccgcaacgccaccaaccacaagtacgccaactacatcgtccagcagtgcctcaagtacaactgcggcaccatccagcttgaggatctcaaggggatctcgaaggagcagaccttcctcaagaactggacgtacttcgacctccaggagaagatcaagaaccaggcgaaccagtacggggtcaaggtcgtgaagatcgacccgtcctacacctcccagcgctgctccgagtgcgggtacatccacaagaacaaccgccaggaccagagcacgttcgagtgccagcagtgcagcttcaaggcccacgccgactacaacgcggccaagaacatctcgatctacaacatcgagaaggtgatccagaagcagctcgagttgcaggagaagctgaacctgacgaagtacaaggagcagtacatcgagcagatggagaacatcaactga

SEQ ID NO: 2456 - DNA, 1353 bp, Unknown
  Bacillus sp. multi
ctgagcaaggtcgtgaaggtgatgaagtaccagatcgtctgcccgctcaacatcgagtggaaggtcttcgagatatacctgcggacgctcagctaccacttccggaccatcggcaaccggacgatccagaagctctgggagtacgacaaccagtccctcaagcacttcaaggacaccggccagtacccctccgtccagcagctctacgggtgcacgcagaagaccgtgagcggctacatctacgaccagctcaaggaggagtaccaggacatcaacaaggcgaacatgagcacgaccctccagaagaccatcaagacctggaactcgcgcaagaaggagatttggagcggcgagatgtccatcccgtccttccggaacaacctccccatcgacgtccacgggaactcggtccaggtcacgaaggagaagtccggcgactacatcgcctccgtgtcgctgttctcctcgaagttcatcaaggagaacgacctgcccaacgggaagatcctggtcaagctgtccacccgcaagcagaactccatgaaggtcatcctcgacaagatcatcgacagcacgtacgcgaagggcgcgtgcatgctccacaagcacaagaacaagtggtacttgagcatcacctacaaggccaccaagaaggagggccacaagttcgacgaagaccttatcatgggcatcgacatggggaagatcaacgcgctgtacttcgcctacaacaaggggctcgtgcgcggggtgatctcgggcgaggagatcgaggcgttccgcaagaaggtcgagtaccggcgcatcagcctgctgcgccagggcaagtactgctcggagaaccggatcgggaagggccgcaagaagcggatcaagcccatcgaggtgctgaacgacaagatcgccaagttccgcaacgcgacgaaccacaagtacgccaactacatcgtgcagcagtgcctcaagtacaactgcggcaccatccagcttgaagacctgaaggggatctcgaaggagcagaccttcctcaagaactggacctacttcgacctccaggagaagatcaagaatcaggccaaccagtacggggtgaaggtcgtcaagatcgacccgagctacaccagccagcggtgcagcgagtgcgggtacatccacaagaacaaccgccaggaccagagcacgttcgagtgccagcagtgctcgttcaaggcccacgccgactacaacgccgccaagaacatctcgatctacaacatcgagaaggtgatccagaagcagttagagctccaggagaagctgaacctgacgaagtacaaggagcagtacatcgagcagatggagaacatcaactag

SEQ ID NO: 2457 - DNA, 1353 bp, Unknown
  Bacillus sp. multi
ctgagcaaggtcgtcaaggtcatgaagtaccagatcgtctgcccgctgaacatcgagtggaaggtcttcgagatatacctgcggacgctcagctaccacttccgcaccatcgggaaccgcaccatccagaagctgtgggagtacgacaaccagtcgctcaagcacttcaaggacaccgggcagtacccgtccgtccagcagctctacggctgcacgcagaaaacagtgagcggctacatctacgaccagctcaaggaggagtaccaggacatcaacaaggccaacatgagcaccaccctccagaaaacgatcaagacgtggaactcccgcaagaaggagatctggagcggcgagatgagcatcccgagcttccgcaacaacctgcccatcgacgtccacggcaacagcgtccaggttacgaaggagaagtcgggcgactacatcgcctcggtgtcgctgttcagctccaagttcatcaaggagaacgacctcccgaacgggaagatcctggtcaagctcagcacgcgcaagcagaacagcatgaaggtcatcctcgacaagatcatcgacagcacgtacgcgaagggcgcgtgcatgttgcacaagcacaagaacaagtggtacctgtccatcacctacaaggcgaccaagaaggagggccacaagttcgacgaggacctgataatggggatcgacatggggaagatcaacgcgctgtacttcgcctacaacaaggggctcgtgcggggcgtcatcagcggggaggagatcgaggcgttccgcaagaaggtcgagtaccggcggatctcgctcctgcgccaggggaagtactgctccgagaaccggatcgggaagggccgcaagaagcgcatcaagcccatcgaggtgctgaacgacaagatcgccaagttccgcaacgcgaccaaccacaagtacgccaactacatcgtgcagcagtgcctcaagtacaactgcgggacgatccagcttgaggacttgaaggggatcagcaaggagcagacgttcctcaagaactggacctacttcgacctccaggagaagatcaagaaccaggcgaaccagtacggggtcaaggtcgtgaagatcgaccccagctacacgagccagcgctgctcggagtgcgggtacatccacaagaacaaccgccaggaccagagcaccttcgagtgccagcagtgcagcttcaaggcgcacgcggactacaacgccgccaagaacatcagcatctacaacatcgagaaggtcatccagaagcagctagagctccaggagaagctgaacctcaccaagtacaaggagcagtacatcgagcagatggagaacatcaactga

SEQ ID NO: 2458 - DNA, 1353 bp, Unknown
  Bacillus sp. multi
ctgtcgaaggtcgtcaaggtcatgaagtaccagatcgtctgcccgctgaacatcgagtggaaggtcttcgaaatctacctgcggaccctctcgtaccacttccgcaccatcggcaaccgcacgatccagaagctgtgggagtacgacaaccagagcctcaagcacttcaaggacacgggccagtacccgtccgtgcagcagctctacgggtgcacgcagaagaccgtgagcggctacatctacgaccagctcaaggaggagtaccaggacatcaacaaggcgaacatgagcaccaccctccagaagaccatcaagacctggaactcccgcaagaaggaaatctggagcggcgagatgtcgatcccgtcgttccgcaacaacctccccatcgacgtccacggcaactcggtccaggtgacgaaggagaagtccggggactacatcgccagcgtcagcctgttctcctccaagttcatcaaggagaacgacctcccgaacggcaagatcctggtgaagctgtccacccggaagcagaactccatgaaggtgatcctggacaagatcatcgactcgacgtacgcgaagggcgcgtgcatgttgcacaagcacaagaacaagtggtacctctccatcacctacaaggccaccaagaaggaggggcacaagttcgacgaagatctcatcatggggatcgacatgggcaagatcaacgcgctgtacttcgcctacaacaagggcctggtgcggggcgtcatctccggcgaggagatcgaggcgttccgcaagaaggtggagtaccgccgcatcagcctcctccgccagggcaaatactgctccgagaaccggatcgggaaggggcgcaagaagcgcatcaagcccatcgaggtgctcaacgacaagatcgccaagttccgcaacgcgacgaaccacaagtacgccaactacatcgtccagcagtgcctcaagtacaactgcggcaccatccagcttgaggaccttaaggggatcagcaaggagcagaccttcctcaagaactggacgtacttcgacctccaggagaagatcaagaaccaggccaaccagtacggcgtgaaggtggtgaagatcgacccctcctacacctcccagcgctgctccgagtgcggctacatccacaagaacaaccgccaggaccagagcaccttcgagtgccagcagtgcagcttcaaggcccacgcggactacaacgcggccaagaacatctcgatctacaacatcgagaaggtcatccagaagcagttggagctacaggagaagctgaacctcacgaagtacaaggagcagtacatcgagcagatggagaacatcaactag

SEQ ID NO: 2459 - DNA, 1353 bp, Unknown
  Bacillus sp. multi
ctcagcaaggtcgtcaaggtgatgaagtaccagatcgtgtgcccgctcaacatcgagtggaaggtgttcgagatctacctccggacgctctcctaccacttccggaccatcgggaaccgcaccatccagaagctctgggagtacgacaaccagtccctcaagcacttcaaggacaccgggcagtacccctcggtgcagcagctctacgggtgcacgcagaaaaccgtgagcggctacatctacgaccagctcaaggaggagtaccaggacatcaacaaggccaacatgagcaccaccctccagaagaccatcaagacctggaacagccgcaagaaggaaatctggagcggcgagatgagcatcccgtcgttccgcaacaacctccccatcgacgtgcacggcaactcggtccaagtaacgaaggagaagtcgggcgactacatcgcctccgtgagcctcttcagcagcaagttcatcaaggagaacgacctccccaacggcaagatcctggtcaagctcagcacccgcaagcagaactccatgaaggtgatcctggacaagatcatcgacagcacctacgcgaagggcgcgtgtatgctccacaagcacaagaacaagtggtacctctccatcacctacaaggcgaccaagaaggaggggcacaagttcgacgaggacctcatcatgggcatcgacatggggaagatcaacgccctctacttcgcctacaacaaggggctggtgcgcggcgtcatctccggcgaggagatcgaggcgttccgcaagaaggtggagtaccgccggatctccctgctccgccagggcaaatactgttccgagaaccggatcggcaaggggcgcaagaagcgcatcaagcccatcgaggtgctgaacgacaagatcgccaagttccgcaacgccacgaaccacaagtacgcgaactacatcgtccagcagtgcctcaagtacaactgcggcacgatccaactggaggacttgaaggggatctcgaaggagcagacgttcctcaagaactggacgtacttcgacctccaggagaagatcaagaaccaggcgaaccagtacggggtcaaggtggtgaagatcgacccgtcctacacctcccagcggtgctccgagtgcggctacatccacaagaacaaccgccaggaccagagcacgttcgagtgccagcagtgcagcttcaaggcgcacgcggactacaacgccgccaagaacatcagcatctacaacatcgagaaggtgatccagaagcagctggagttgcaggagaagctgaacctcaccaagtacaaggagcagtacatcgagcagatggagaacatcaactga

SEQ ID NO: 2460 - DNA, 1353 bp, Unknown
  Bacillus sp. multi
ctcagcatcgcggtgaaggtgatgaagtaccagatcgtgtgccccgtcaacatcgagtggaagaccttcgagatatacctgcggacgctcagctaccacttccgcaccatcggcaaccgcaccatccagaagctctgggagtacgacaaccagtccctcaagcacttcaaggacaccggccagtacccctcggcccagcagctctacgggtgcacgcagaagacgatctccggctacatctacgaccagctcaaggaggagtaccaggacatcaacaaggccaacatgagcacgaccctccaaaagactatcaagacctggaactcccgcaagaaggagatctggagcggcgagatgagcatccccagcttccggaacaacctgcccatcgacatccacgggaactccatccagatcatcaaggagaagtccggcgactacatcgcctcggtgtcgctgttcagctcgaagttcatcaaggagaacgacctgcccaacgggaagatcctggtgaagctctcgacgcgcaagcagaactccatgaaggtcatcctggaccgcatcatcgactcgacctacgcgaagggcgcgtgcatgctccacaagcacaagaagaagtggtatctctccatcacctacaagtccaacatcaaggaggagctcaagttcgacgaggatctcatcatgggcatcgacatggggaagatcaacgtgctgtacttcgccttcaacaagggcctcgtgcgcggggccatcagcggggaggagatcgaggcgttccgcaagaagatcgagcaccgccgcatctccctcctccgccagggcaagtactgctcggggaaccggatcggccagggccgcaagaagcgcatcaagcccatcgaggtgctgaacgacaagatcgccaagttccgcaccgccaccaaccacaagtacgccaactacatcgtccagcagtgcctcaagtacaactgcggcaccatccagcttgaagacctacaggggatcagcaaggagcagaccttcctcaagaactggacgtacttcgacctccaggagaagattaagaaccaggcgaaccagtacgggatcaaggtcgtgaagatcgaccccagctacacctcgcagcggtgcagcgagtgcggctacatccacaagaacaaccgccagaaccagagcacgttcgagtgccagcagtgctcgttcaaggtccacgcggactacaacgcggccaagaacatctcggtgtacaacatcgagaaggtcatccagcgccagctcaagctccaggagaagctcaacctgacgaagtacaaggagcagtacatcgagcagatggagaacatcaactag

SEQ ID NO: 2461 - DNA, 1353 bp, Unknown
  Bacillus sp. multi
ctgagcatcgcggtgaaggtcatgaagtaccagatcgtctgccccgtgaacatcgagtggaagaccttcgagatctacctgcggaccctctcgtaccacttccgcaccatcgggaaccgcaccatccagaagctctgggagtacgacaaccagtccctcaagcacttcaaggacacgggccagtacccctccgcccagcagctctacggctgcacgcagaaaacgatcagcgggtacatctacgaccagctcaaggaggagtaccaggacatcaacaaggcgaacatgagcacgaccctccagaaaacgatcaagacctggaacagccgcaagaaggagatctggagcggcgagatgtccatcccctccttccgcaacaacctccccatcgacatccacgggaactcgatccagatcatcaaggagaagtccggggactacatcgcgtccgtgtcgctcttcagcagcaagttcatcaaggagaacgacctgccgaacgggaagatcctggtgaagctctccacccgcaagcagaactccatgaaggtgatcctcgaccgcatcatcgacagcacctacgcgaagggcgcgtgtatgctgcacaagcacaagaagaagtggtacttgtccatcacctacaagagcaacatcaaggaggagctaaagttcgacgaggacctcattatgggcatcgacatgggcaagatcaacgtcctctacttcgcgttcaacaaggggctggtgcggggcgcgatctcgggcgaggagatcgaggcgttccgcaagaagatagagcaccggcgcatctccctcctgcgccaggggaagtactgctccggcaaccggatcggccaggggcgcaagaaacggatcaagcccatcgaggtgctgaacgacaagatcgccaagttccgcaccgcgacgaaccacaagtacgcgaactacatcgtccagcagtgcctcaagtacaactgcgggaccatccagctcgaagacctccagggcatcagcaaggagcagacgttcctcaagaactggacctacttcgacctccaggagaagatcaagaaccaggcgaaccagtacggcatcaaggtcgtgaagatcgaccccagctacacctcgcagcggtgcagcgagtgcggctacatccacaagaacaaccgccagaaccagtccaccttcgagtgccagcagtgcagcttcaaggtgcacgccgactacaacgccgccaagaacatcagcgtgtacaacatcgagaaggtcatccagcggcagctcaagctccaggagaagctgaacctgacgaagtacaaggagcagtacatcgagcagatggagaacatcaactag

SEQ ID NO: 2462 - DNA, 1353 bp, Unknown
  Bacillus sp. multi
ctctccatcgcggtcaaggtgatgaagtaccagatcgtgtgcccggtcaacatcgagtggaagacgttcgagatctacctccgcacgctctcctaccacttccgcaccatcggcaaccggaccatccagaagctctgggagtacgacaaccagtcgctcaagcacttcaaggacacggggcagtacccgtcggcccagcagctctacggctgcacgcagaagaccatctccgggtacatctacgaccagctcaaggaggagtaccaggacatcaacaaggccaacatgagcacgaccctccagaagacgatcaagacctggaacagccgcaagaaggagatatggagcggggagatgtccatcccgagcttccggaacaacctgcccatcgacatccacggcaacagcatccagatcatcaaggagaagtccggcgactacatcgcgtccgtgagcctgttctcctccaagttcatcaaggagaacgacctccccaacgggaagatcctggtcaagctgtccacccggaagcagaactccatgaaggtgatcctcgaccgcatcatcgactccacgtacgcgaagggcgcgtgcatgttacacaagcacaagaagaagtggtacttgagcatcacctacaagagcaacatcaaggaggagctaaagttcgacgaggatctgatcatggggatcgacatgggcaagatcaacgtgctctacttcgccttcaacaaggggctggtgcgcggggccatctccggcgaggagatcgaggcgttccgcaagaaaatcgagcaccggcgcatctcgctgctccgccagggcaagtactgctccggcaaccggatcggccagggccgcaagaagcgcatcaagcccatcgaggtgctgaacgacaagatcgccaagttccgcacggccaccaaccacaagtacgcgaactacatcgtgcagcagtgcctcaagtacaactgcggcaccatccagcttgaggacctccagggtatcagcaaggagcagaccttcctcaagaactggacctacttcgacctccaggagaagatcaagaaccaggcgaaccagtacgggatcaaggtcgtcaagatcgaccccagctacaccagccagcggtgcagcgagtgcgggtacatccacaagaacaaccgccagaaccagtccacgttcgagtgccagcagtgctcgttcaaggtccacgccgactacaacgcggccaagaacatcagcgtgtacaacatcgagaaggtcatccagcggcagctcaagctccaggagaagctcaacctgaccaagtacaaggagcagtacatcgagcagatggagaacatcaactag

SEQ ID NO: 2463 - DNA, 1353 bp, Unknown
  Bacillus sp. multi
ctgagcatcgccgtcaaggtgatgaagtaccagatcgtgtgcccggtcaacatcgagtggaagaccttcgagatctacctgcggaccctctcctaccacttccgcaccatcggcaaccggacgatccagaagctgtgggagtacgacaaccagtcgctcaagcacttcaaggacaccggccagtacccgtccgcgcagcagctctacggctgcacccagaaaaccatcagcggctacatctacgaccagctcaaggaggagtaccaggacatcaacaaggcgaacatgagcaccaccctccagaagaccatcaagacgtggaacagccgcaagaaggagatatggagcggggagatgagcatcccgagcttccgcaacaacctccccatcgacatccacgggaactcgatccagatcatcaaggagaagtccggggactacatcgccagcgtcagcctgttcagctcgaagttcatcaaggagaacgacctgccgaacggcaagatcctggtgaagctcagcacccgcaagcagaacagcatgaaggtcatcctggaccgcatcatcgactcgacgtacgcgaagggcgcgtgcatgctgcacaagcacaagaagaaatggtacttgtccatcacctacaagtcgaacatcaaggaggagttgaagttcgacgaggacctgatcatgggcatcgacatgggcaagatcaacgtcctgtacttcgccttcaacaaggggctggtccggggcgcgatcagcggggaggagatcgaggcgttccgcaagaaaatcgagcaccggcggatctccctgctgcgccagggcaagtattgttccggcaaccgcatcggccagggccgcaagaagcgcatcaagcccatcgaggtgctgaacgacaagatcgccaagttccgcacggcgaccaaccacaagtacgcgaactacatcgtccagcagtgcctcaagtacaactgcgggacgatccagctcgaagacctccaggggatcagcaaggagcagacgttcctcaagaactggacgtacttcgacctccaggagaagatcaagaaccaggccaaccagtacggcatcaaggtcgtgaagatcgacccgagctacacctcgcagcggtgctcggagtgcggctacatccacaagaacaaccgccagaaccagtccaccttcgagtgccagcagtgctccttcaaggtgcacgccgactacaacgcggccaagaacatctccgtgtacaacatcgagaaggtgatccagcgccagctcaagctccaggagaagctgaacctcaccaagtacaaggagcagtacatcgagcagatggagaacatcaactag

SEQ ID NO: 2464 - DNA, 1353 bp, Unknown
  Bacillus sp. multi
ctctccatcgccgtgaaggtcatgaagtaccagatcgtgtgcccggtcaacatcgagtggaagaccttcgagatctacctgcggaccctcagctaccacttccgcaccatcgggaaccgcaccatccagaagctctgggagtacgacaaccagtcgctcaagcacttcaaggacacgggccagtacccctccgcgcagcagctctacggctgcacccagaagacgatcagcggctacatctacgaccagctcaaggaggagtaccaggacatcaacaaggccaacatgagcaccaccctccagaaaaccatcaagacgtggaactcccgcaagaaggagatatggagcggcgagatgtccatccccagcttccggaacaacctccccatcgacatccacggcaacagcatccagatcatcaaggagaagtccggcgactacatcgccagcgtgagcctgttctcgtccaagttcatcaaggagaacgacctgcccaacggcaagatcctggtgaagctctccacccgcaagcagaactcgatgaaggtcatcctcgaccgcatcatcgactccacctacgcgaagggcgcgtgcatgctccacaagcacaagaagaagtggtacctgagcatcacctacaagtccaacatcaaggaggagttgaagttcgacgaagacctgatcatgggcatcgacatggggaagatcaacgtgctctacttcgcgttcaacaagggcctggtgcgcggcgcgatctcgggcgaggagatcgaggcgttccgcaagaagatcgagcaccggcgcatcagcctgctgcgccagggcaaatactgctccggcaaccgcatcggccagggccgcaagaagcgcatcaagcccatcgaggtgctgaacgacaagatcgccaagttccggacggcgaccaaccacaagtacgccaactacatcgtccagcagtgcctcaagtacaactgcggcacgatccagttggaggatctccagggcatcagcaaggagcagaccttcctcaagaactggacgtacttcgacctccaggaaaagattaagaaccaggccaaccagtacggcatcaaggtcgtgaagatcgacccgtcctacaccagccagcgctgctcggagtgcgggtacatccacaagaacaaccggcagaaccagagcacgttcgagtgccagcagtgctcgttcaaggtgcacgccgactacaacgcggccaagaacatcagcgtgtacaacatcgagaaggtgatccagcggcagctcaagctccaggagaagctcaacctcaccaagtacaaggagcagtacatcgagcagatggagaacatcaactag

SEQ ID NO: 2465 - DNA, 1353 bp, Unknown
  Bacillus sp. multi
ctgtccatcgcggtgaaggtgatgaagtaccagatcgtgtgccccgtgaacatcgagtggaagaccttcgagatctacctgcggacgctctcctaccacttccgcaccatcggcaaccggacgatccagaagctgtgggagtacgacaaccagagcctcaagcacttcaaggacacgggccagtaccccagcgcgcagcagctctacgggtgcacgcagaaaaccatcagcgggtacatctacgaccagctcaaggaggagtaccaggacatcaacaaggcgaacatgagcaccaccctccagaagaccatccgcacgtggaacagccgcaagaaggaaatctggagcggcgagatgagcatcccgtccttccggaacaacctccccatcgacatccacgggaacagcatccagatcatcaaggagaagtccgggaactacatcgcctccgtctcgctcttcagcagcaagttcatcaaggagaacgacctgccgaacgggaagatcctggtcaagctcagcacgcgcaagcagaactcgatgaaggtgatcctggaccgcatcatcgacagcacgtacgcgaagggcgcgtgcatgctgcacaagcacaagaagaagtggtacctctccatcacctacaagtcgaacatcaaggaggagttgaagttcgacgaggacctcatcatggggatcgacatgggcaagatcaacgtcctgtacttcgccttcaacaaggggctggtccggggcgcgatcagcggcgaggagatcgaggcgttccgcaagaagatagagcaccggcgcatcagcctgctgcgccagggcaagtactgctccgggaaccgcatcgggaagggccgggagaagcgcatcaagcccatcgacgtgctcaacgacaaggtggccaagttccgcaacgccaccaaccacaagtacgccaactacatcgtgcagcagtgcctcaagtacaactgcggcaccatccagttggaggatcttaaggggatctcgaaggagcagacgttcctcaagaactggacctacttcgacctccaggagaagatcaagaaccaggcgaaccagtacggggtcaaggtcgtcaagatcgacccctcctacaccagccagcggtgctcggagtgcgagtacatccacaagaacaaccgccaggaccagagcaccttcgagtgccagcagtgctcgttcaaggtccacgcggactacaacgccgccaagaacatctcggtgtacaacatcgagaaggtgatccagaagcagcttgagctgcaggagaagctgaaccagacgaagtacaaggagcagtacatcgagcagatgaagaacatcaactga

SEQ ID NO: 2466 - DNA, 1353 bp, Unknown
  Bacillus sp. multi
ctgagcatcgcggtgaaggtcatgaagtaccagatcgtgtgcccggtgaacatcgagtggaagacgttcgagatctacctccgcacgctctcctaccacttccgcaccatcggcaaccgcaccatccagaagctctgggagtacgacaaccagtccctcaagcacttcaaggacaccggccagtacccctccgcgcagcagctctacggctgcacccagaaaaccatcagcggctacatctacgaccagctcaaggaggagtaccaggacatcaacaaggccaacatgagcacgaccctccagaagaccatccggacgtggaactcccgcaagaaggagatctggagcggggagatgagcatcccctccttccggaacaacctgcccatcgacatccacggcaacagcatccagatcatcaaggagaagtcggggaactacatcgcctcggtgtcgctcttcagcagcaagttcatcaaggagaacgacctgccgaacgggaagatcctggtcaagctgtccacgcggaagcagaactcgatgaaggtgatcctggaccggatcatcgactccacgtacgcgaagggcgcgtgcatgctccacaagcacaagaagaaatggtacctgagcatcacctacaagagcaacatcaaggaggagctaaagttcgacgaggacctgatcatggggatcgacatggggaagatcaacgtgctctacttcgccttcaacaagggcctggtgcggggcgcgatcagcggcgaggagatcgaggcgttccgcaagaagatcgagcaccgccgcatctccctcctgcgccagggcaagtactgctcgggcaaccgcatcggcaagggccgggagaagcggatcaagcccatcgacgtgctcaacgacaaggtggcgaagttccgcaacgcgaccaaccacaagtacgccaactacatcgtccagcagtgcctcaagtacaactgcggcacgatccaacttgaagacctcaaggggatcagcaaggagcagacgttcctcaagaactggacctacttcgacctccaggagaagatcaagaaccaggcgaaccagtacggcgtgaaggtggtgaagatcgacccgtcctacaccagccagcgctgctcggagtgcgagtacatccacaagaacaaccgccaggaccagtccacgttcgagtgccagcagtgctccttcaaggtgcacgccgactacaacgcggccaagaacatcagcgtgtacaacatcgagaaggtgatccagaagcagttggagctacaggagaagctgaaccagaccaagtacaaggagcagtacatcgagcagatgaagaacatcaactag

SEQ ID NO: 2467 - DNA, 1353 bp, Unknown
  Bacillus sp. multi
ctcagcatcgccgtcaaggtgatgaagtaccagatcgtgtgcccggtgaacatcgagtggaagacgttcgagatatacctgcggacgctctcgtaccacttccgcaccatcgggaaccgcaccatccagaagctgtgggagtacgacaaccagtccctcaagcacttcaaggacaccggccagtacccctccgcccagcagctctacgggtgcacgcagaagaccatctccgggtacatctacgaccagctcaaggaggagtaccaggacatcaacaaggcgaacatgagcaccaccctccagaaaaccatccggacgtggaacagccgcaagaaggagatctggagcggcgagatgtccatccccagcttccgcaacaacctgcccatcgacatccacgggaactcgatccagatcatcaaggagaagtccggcaactacatcgcctcggtgtccctgttctcctccaagttcatcaaggagaacgacctccccaacggcaagatcctggtgaagctcagcacccgcaagcagaactccatgaaggtcatcctggaccgcatcatcgacagcacgtacgcgaagggcgcgtgcatgctgcacaagcacaagaagaagtggtacctgtccatcacctacaagagcaacatcaaggaggaactgaagttcgacgaggacctcataatgggcatcgacatgggcaagatcaacgtgctctacttcgcgttcaacaagggcctcgtgcgcggggccatcagcggggaggagatcgaggcgttccgcaagaagatcgagcaccgccggatctccctgctgcgccaggggaagtactgctcggggaaccggatcggcaaggggcgggagaagcgcatcaagcccatcgacgtgctcaacgacaaggtggcgaagttccgcaacgccaccaaccacaagtacgccaactacatcgtgcagcagtgcctcaagtacaactgcgggacgattcagctcgaagacctcaaggggatctcgaaggagcagaccttcctcaagaactggacctacttcgacctccaggagaagatcaagaaccaggccaaccagtacggggtgaaggtcgtgaagatcgacccgagctacacgagccagcggtgctccgagtgcgagtacatccacaagaacaaccgccaggaccagtccacgttcgagtgccagcagtgctcgttcaaggtccacgcggactacaacgcggccaagaacatcagcgtgtacaacatcgagaaggtgatccagaagcagctcgaactccaggagaagctgaaccagaccaagtacaaggagcagtacatcgagcagatgaagaatatcaactga

SEQ ID NO: 2468 - DNA, 1353 bp, Unknown
  Bacillus sp. multi
ctgtccatcgcggtcaaggtcatgaagtaccagatcgtgtgcccggtgaacatcgagtggaagacgttcgagatatacctgcggacgctcagctaccacttccgcaccatcggcaaccggaccatccagaagctgtgggagtacgacaaccagagcctcaagcacttcaaggacaccggccagtacccgtccgcgcagcagctctacggctgcacgcagaaaaccatctccggctacatctacgaccagctcaaggaggagtaccaggacatcaacaaggcgaacatgagcaccaccctccagaagacgatccgcacgtggaactcgcgcaagaaggagatctggagcggcgagatgtccatccccagcttccggaacaacctccccatcgacatccacggcaactcgatccagatcatcaaggagaagtccggcaactacatcgcgtcggtcagcctgttcagctcgaagttcatcaaggagaacgacctcccgaacgggaagatcctggtgaagctcagcacccggaagcagaactcgatgaaggtcatcctcgaccgcatcatcgacagcacctacgcgaagggcgcgtgcatgttgcacaagcacaagaagaagtggtacttgtccatcacctacaagtcgaacatcaaggaggagctcaagttcgacgaggacctcataatggggatcgacatggggaagatcaacgtgctctacttcgccttcaacaagggcctcgtgcgcggcgcgatctccggcgaggagatcgaggcgttccgcaagaagatagagcaccgccgcatctcgctgctgcgccagggcaagtactgctcgggcaaccgcatcggcaagggccgcgagaagcggatcaagcccatcgacgtcctcaacgacaaggtggccaagttccgcaacgccaccaaccacaagtacgcgaactacatcgtgcagcagtgcctcaagtacaactgcggcaccatccagctcgaagacctcaaggggatctcgaaggagcagaccttcctcaagaactggacgtacttcgacctccaggagaagatcaagaaccaggccaaccagtacggggtgaaggtggtgaagatcgacccctcctacacgagccagcggtgctccgagtgcgagtacatccacaagaacaaccgccaggaccagagcaccttcgagtgccagcagtgcagcttcaaggtccacgcggactacaacgccgccaagaacatctccgtgtacaacatcgagaaggtgatccagaagcagcttgagctgcaggagaagctgaaccagaccaagtacaaggagcagtacatcgagcagatgaagaacatcaactga

SEQ ID NO: 2469 - DNA, 1353 bp, Unknown
  Bacillus sp. multi
ctgtccatcgcggtgaaggtcatgaagtaccagatcgtgtgcccggtgaacatcgagtggaagacgttcgagatctacctgcggaccctctcctaccacttccgcaccatcggcaaccgcaccatccagaagctctgggagtacgacaaccagagcctcaagcacttcaaggacacgggccagtacccctccgcccagcagctctacgggtgcacgcagaagacgatcagcgggtacatctacgaccagctcaaggaggagtaccaggacatcaacaaggccaacatgagcaccaccctccagaagaccatccgcacctggaactcgcgcaagaaggaaatctggagcggcgagatgtccatcccgtccttccgcaacaacctccccatcgacatccacggcaactcgatccagatcatcaaggagaagtccggcaactacatcgcctccgtgtccctgttcagcagcaagttcatcaaggagaacgacctccccaacgggaagatcctggtcaagctcagcacgcggaagcagaactccatgaaggtgatcctcgaccggatcatcgacagcacctacgcgaagggcgcgtgcatgttgcacaagcacaagaagaagtggtacctcagcatcacctacaagagcaacatcaaggaggagctcaaattcgacgaagacctcatcatgggcatcgacatgggcaagatcaacgtcctctacttcgcgttcaacaaggggctcgtgcgcggcgcgatcagcggcgaggagatcgaggcgttccgcaagaagatcgagcaccgccggatctcgctgctgcgccagggcaaatactgctcggggaaccgcatcggcaaggggcgggagaagcgcatcaagcccatcgacgtgctcaacgacaaggtggcgaagttccgcaacgccaccaaccacaagtacgcgaactacatcgtgcagcagtgcctcaagtacaactgcgggaccatccagcttgaggacttgaaggggatctcgaaggagcagaccttcctcaagaactggacgtacttcgacctccaggagaagatcaagaaccaggccaaccagtacggcgtgaaggtggtgaagatcgaccccagctacacctcgcagcggtgcagcgagtgcgagtacatccacaagaacaaccgccaggaccagtccaccttcgagtgccagcagtgcagcttcaaggtgcacgcggactacaacgcggccaagaacatcagcgtgtacaacatcgagaaggtcatccagaagcagctcgagttgcaggagaagctgaaccagaccaagtacaaggagcagtacatcgagcagatgaagaacatcaactag

SEQ ID NO: 2470 - DNA, 1332 bp, Unknown
  Bacillus sp. multi
atgaagtaccagatcgtgtgccccgtgaacatcgagtggaagaccttcgagatctacctgcggacgctctcgtaccacttccgcaccatcggcaaccgcaccatccagaagctgtgggagtacgacaaccagagcctcaagcacttcaaggacaccggccagtacccgagcgcgcagcagctctacggctgcacgcagaaaacgatctcgggctacatctacgaccagctcaaggaggagtaccaggacatcaacaaggccaacatgagcaccaccctccagaagacgatcaagacctggaactcgcgcaagaaggagatctggagcggcgagatgagcatcccgtcgttccgcaacaacctgcccatcgacatccacgggaactccatccagatcatcaaggagaagtcgggcgactacatcgcctccgtgtccctgttctcgtccaagttcatcaaggagaacgacctcccgaacggcaagatcctggtcaagctctccacgcgcaagcagaactcgatgaaggtcatcctcgaccggatcatcgactccacgtacgcgaagggcgcgtgcatgctgcacaagcacaagaagaagtggtacctctccatcacgtacaagtcgaacatcaaggaggagctgaagttcgacgaagacctcatcatgggcatcgacatgggcaagatcaacgtgctgtacttcgccttcaacaagggcctcgtccggggcgcgatcagcggcgaggagatcgaggcgttccgcaagaaaatcgagcaccgccggatctccctgctgcgccagggcaagtactgctccgggaaccgcatcgggaagggccgcaagaagcggatcaagcccatcgaggtgctgaacgacaagatcgccaagttccgcaccgccaccaaccacaagtacgccaactacatcgtgcagcagtgcctcaagttcaactgcggcacgatacagctggaagacctccagggcatctcgaaggagcagaccttcctcaagaactggacgtacttcgacctccaggagaagattaagaaccaggcgaaccagtacggcatcaaggtggtcaagatcgacccgagctacaccagccagcggtgctcggagtgcggctgcatccacaagaacaaccgccagaaccagtccacgttcgagtgccagcagtgcagcttcaaggtgcacgccgactacaacgccgccaagaacatctccgtgtacaacatcgagaaggtcatccagaagcagctcaagctccaggagaagctgaacctgaccaagtacaaggagcagtacatcgagcagatggagaacatcaactga

SEQ ID NO: 2471 - DNA, 1332 bp, Unknown
  Bacillus sp. multi
atgaagtaccagatcgtctgccccgtcaacatcgagtggaagacgttcgagatctacctgcggacgctctcctaccacttccgcaccatcggcaaccggacgatccagaagctgtgggagtacgacaaccagtccctcaagcacttcaaggacacgggccagtacccgagcgcccagcagctctacggctgcacccagaagacgatcagcgggtacatctacgaccagctcaaggaggagtaccaggacatcaacaaggccaacatgagcacgaccctccagaaaaccatcaagacctggaacagccgcaagaaggaaatctggagcggcgagatgagcatccccagcttccggaacaacctccccatcgacatccacggcaactcgatccagatcatcaaggagaagtccggggactacatcgccagcgtctcgctgttcagcagcaagttcatcaaggagaacgacctgccgaacggcaagatcctggtcaagctgtccacgcgcaagcagaactccatgaaggtgatcctcgaccgcatcatcgactcgacctacgcgaagggcgcgtgcatgttgcacaagcacaagaagaagtggtacctgtccatcacctacaagagcaacatcaaggaggagctcaagttcgacgaggacctgatcatgggcatcgacatggggaagatcaacgtgctctacttcgccttcaacaagggcctggtgcggggcgcgatctccggcgaggagatcgaggcgttccgcaagaagatcgagcaccgccggatctccctcctgcgccagggcaagtactgctccggcaaccgcatcgggaagggccgcaagaagcgcatcaagcccatcgaggtgctgaacgacaagatcgccaagttccgcaccgcgacgaaccacaagtacgccaactacatcgtgcagcagtgcctcaagttcaactgcggcacgatacagctcgaggatctccagggcatcagcaaggagcagaccttcctcaagaactggacgtacttcgacctccaggagaagatcaagaatcaggcgaaccagtacgggatcaaggtcgtcaagatcgacccctcctacacgagccagcgctgctcggagtgcgggtgcatccacaagaacaaccgccagaaccagtccaccttcgagtgccagcagtgcagcttcaaggtccacgccgactacaacgcggccaagaacatctccgtgtacaacatcgagaaggtgatccagaagcagctcaagctccaggagaagctgaacctcacgaagtacaaggagcagtacatcgagcagatggagaacatcaactga

SEQ ID NO: 2472 - DNA, 1332 bp, Unknown
  Bacillus sp. multi
atgaagtaccagatcgtgtgccccgtcaacatcgagtggaagacgttcgagatctatctccggaccctctcctaccacttccgcaccatcggcaaccgcacgatccagaagctgtgggagtacgacaaccagtcgctcaagcacttcaaggacaccgggcagtaccccagcgcgcagcagctctacggctgcacgcagaagacgatctccggctacatctacgaccagctcaaggaggagtaccaggacatcaacaaggcgaacatgagcacgaccctccagaagacgatcaagacgtggaactcccgcaagaaggagatctggagcggcgagatgagcatcccgtccttccgcaacaacctccccatcgacatccacggcaacagcatccagatcatcaaggagaagtccggcgactacatcgccagcgtgtcgctgttctcctccaagttcatcaaggagaacgacctgcccaacggcaagatcctggtgaagctcagcacccggaagcagaactcgatgaaggtgatcctggaccggatcatcgactccacctacgcgaagggcgcgtgcatgctgcacaagcacaagaagaagtggtacctcagcatcacctacaagagcaacatcaaggaggaactcaagttcgacgaggacttgataatggggatcgacatgggcaagatcaacgtgctgtacttcgccttcaacaagggcctggtgcgcggggccatctccggggaggagatcgaggcgttccgcaagaagatcgagcaccggcggatctccctcctgcgccaggggaagtactgctccggcaaccgcatcgggaagggccgcaagaagcggatcaagcccatcgaggtgctgaacgacaagatcgccaagttccggacggcgacgaaccacaagtacgccaactacatcgtccagcagtgcctcaagttcaactgcgggaccatccagctcgaggatctccagggcatcagcaaggagcagaccttcctcaagaactggacctacttcgacctccaggagaagattaagaaccaggccaaccagtacggcatcaaggtggtcaagatcgaccccagctacaccagccagcggtgctcggagtgcgggtgcatccacaagaacaaccggcagaaccagagcacgttcgagtgccagcagtgcagcttcaaggtccacgccgactacaacgccgccaagaacatcagcgtgtacaacatcgagaaggtgatccagaagcagctcaagctccaggagaagctcaacctgaccaagtacaaggagcagtacatcgagcagatggagaacatcaactga

SEQ ID NO: 2473 - DNA, 1332 bp, Unknown
  Bacillus sp. multi
atgaagtaccagatcgtgtgccccgtcaacatcgagtggaagacgttcgagatctacctccggaccctctcctaccacttccgcaccatcgggaaccgcaccatccagaagctctgggagtacgacaaccagtccctcaagcacttcaaggacacgggccagtacccctcggcgcagcagctctacggctgcacgcagaagacgatctccggctacatctacgaccagctcaaggaggagtaccaggacatcaacaaggccaacatgagcacgaccctccagaagacgatcaagacctggaacagccgcaagaaggagatatggagcggcgagatgtccatcccgagcttccggaacaacctccccatcgacatccacggcaactcgatccagatcatcaaggagaagtccggggactacatcgccagcgtcagcctgttctcctccaagttcatcaaggagaacgacctcccgaacggcaagatcctggtgaagctctccacgcggaagcagaactccatgaaggtcatcctggaccggatcatcgacagcacctacgcgaagggcgcgtgcatgctgcacaagcacaagaagaagtggtacctgtccatcacctacaagtcgaacatcaaggaggagctcaagttcgacgaggatctcatcatgggcatcgacatgggcaagatcaacgtcctctacttcgcgttcaacaaggggctcgtccggggcgcgatctccggcgaggagatcgaggcgttccgcaagaaaatcgagcaccgccgcatcagcctcctccgccagggcaaatactgctccgggaaccggatcggcaaggggcgcaagaagcgcatcaagcccatcgaggtgctgaacgacaagatcgccaagttccggacggccacgaaccacaagtacgccaactacatcgtccagcagtgcctcaagttcaactgcgggaccatccagctcgaggacttgcaggggatcagcaaggagcagaccttcctcaagaactggacctacttcgacctccaggagaagattaagaaccaggccaaccagtacggcatcaaggtggtgaagatcgacccctcctacacgagccagcggtgcagcgagtgcggctgcatccacaagaacaaccgccagaaccagagcacgttcgagtgccagcagtgcagcttcaaggtccacgccgactacaacgccgccaagaacatctcggtgtacaacatcgagaaggtgatccagaagcagctcaagctccaggagaagctcaacctgaccaagtacaaggagcagtacatcgagcagatggagaacatcaactag

SEQ ID NO: 2474 - DNA, 1332 bp, Unknown
  Bacillus sp. multi
atgaagtaccagatcgtgtgcccggtgaacatcgagtggaagaccttcgaaatctacctgcggacgctctcctaccacttccggaccatcgggaaccgcaccatccagaagctgtgggagtacgacaaccagagcctcaagcacttcaaggacaccggccagtacccgtcggcccagcagctctacggctgcacgcagaagaccatctcgggctacatctacgaccagctcaaggaggagtaccaggacatcaacaaggccaacatgagcaccaccctccagaagaccatcaagacgtggaactcgcgcaagaaggagatctggagcggcgagatgtccatcccctccttccgcaacaacctccccatcgacatccacggcaactcgatccagatcatcaaggagaagtccggcgactacatcgcgtccgtcagcctcttcagcagcaagttcatcaaggagaacgacctgcccaacgggaagatcctggtcaagctctcgacccggaagcagaactccatgaaggtgatcctggaccggatcatcgactcgacctacgcgaagggcgcgtgcatgctgcacaagcacaagaagaagtggtacctctcgatcacctacaagtcgaacatcaaggaggagctgaagttcgacgaggacctcatcatgggcatcgacatgggcaagatcaacgtcctgtacttcgccttcaacaagggcctggtgcgcggggcgatctccggggaggagatcgaggcgttccgcaagaaaatcgagcaccgccggatctccctgctccgccagggcaagtattgttccggcaaccggatcggcaagggccgcaagaagcggatcaagcccatcgaggtgctgaacgacaagatcgccaagttccgcaccgccaccaaccacaagtacgcgaactacatcgtccagcagtgcctcaagttcaactgcggcacgatccagctagaggatctccagggcatcagcaaggagcagaccttcctcaagaactggacctacttcgacctccaggagaagatcaagaaccaggccaaccagtacggcatcaaggtggtcaagatcgaccccagctacaccagccagcggtgctccgagtgcggctgcatccacaagaacaaccggcagaaccagtccaccttcgagtgccagcagtgctcgttcaaggtgcacgccgactacaacgccgccaagaacatcagcgtgtacaacatcgagaaggtgatccagaagcagctcaagctccaggagaagctcaacctcaccaagtacaaggagcagtacatcgagcagatggagaacatcaactga

SEQ ID NO: 2475 - DNA, 1353 bp, Unknown
  Bacillus sp. multi
ctgtccatcgccgtgaaggtgatgaagtaccagatcgtgtgcccggtcaacatcgagtggaagaccttcgaaatctacctgcggacgctctcctaccacttccgcaccatcgggaaccgcaccatccagaagctgtgggagtacgacaaccagagcctcaagcacttcaaggacacgggccagtacccgtcggcgcagcagctctacggctgcacccagaaaaccatcagcggctacatctacgaccagctcaaggaggagtaccaggacatcaacaaggcgaacatgagcaccaccctccagaagaccatccgcacgtggaacagccgcaagaaggagatctggagcggcgagatgagcatcccgagcttccgcaacaacctgcccatcgacatccacggcaactccatccagatcatcaaggagaagtccggcgactacatcgcgtccgtgtcgctgttctcgtccaagttcatcaaggagaacgacctccccaacgggaagatcctggtgaagctcagcacccgcaagcagaactcgatgaaggtgatcctcgaccgcatcatcgactcgacgtacgcgaagggcgcgtgcatgctccacaagcacaagaagaagtggtacctcagcatcacctacaagtcgaacatcaaggaggagctcaagttcgacgaggatctcatcatgggcatcgacatgggcaagatcaacgtgctctacttcgccttcaacaaggggctcgtgcggggcaccatctccggcgaggagatcgaggcgttccgcaagaaaatcgagcaccgccgcatcagcctcctccgccaggggaagtattgctccggcaaccggatcgggaaggggcgcgagaagcgcatcaagcccatcgacgtcctcaacgacaaggtggccaagttccgcaacgccacgaaccacaagtacgcgaactacatcgtccagcagtgcctcaagtacaactgcggcacgatccagctcgaggatctgaaggggatcagcaaggagcagaccttcctcaagaactggacctacttcgacctccaggagaagatcaagaaccaggcgaaccagtacggcgtgaaggtggtcaagatcgacccgtcctacacctcgaagcgctgctcggagtgcgagtacatccacaagaacaaccgccaggaccagtccacgttcgagtgccagcagtgctccttcaaggtccacgcggactacaacgcggccaagaacatctcggtgtacaacatcgagaaggtgatccagaagcagctcgaactccaggagaagctgaaccagacgaagtacaaggagcagtacatcgagcagatgaagaacatcaactga

SEQ ID NO: 2476 - DNA, 1353 bp, Unknown
  Bacillus sp. multi
ctgagcatcgcggtcaaggtgatgaagtaccagatcgtgtgcccggtcaacatcgagtggaagacgttcgagatatacctccggacgctctcctaccacttccggaccatcgggaaccgcaccatccagaagctgtgggagtacgacaaccagagcctcaagcacttcaaggacaccgggcagtacccctccgcccagcagctctacggctgcacgcagaaaaccatctcgggctacatctacgaccagctcaaggaggagtaccaggacatcaacaaggcgaacatgagcaccaccctccagaagacgatccggacgtggaacagccgcaagaaggagatctggagcggcgagatgagcatcccgtcgttccgcaacaacctccccatcgacatccacggcaactccatccagatcatcaaggagaagtccggcgactacatcgcctccgtgagcctgttctccagcaagttcatcaaggagaacgacctgccgaacggcaagatcctggtcaagctgtccacccggaagcagaactcgatgaaggtcatcctggaccggatcatcgacagcacgtacgcgaagggcgcgtgcatgctgcacaagcacaagaagaagtggtacctgtccatcacctacaagagcaacatcaaggaggaactcaagttcgacgaggacctcatcatgggcatcgacatggggaagatcaacgtcctctacttcgccttcaacaaggggctggtccggggcacgatcagcggggaggagatcgaggcgttccgcaagaagatcgagcaccgccggatctcgctcctccgccagggcaagtattgctccgggaaccggatcggcaagggccgcgagaagcggatcaagcccatcgacgtgctgaacgacaaggtggccaagttccgcaacgcgaccaaccacaagtacgccaactacatcgtccagcagtgcctcaagtacaactgcggcaccatccagctcgaagacctcaaggggatcagcaaggagcagacgttcctcaagaactggacctacttcgacctccaggagaagattaagaaccaggcgaaccagtacggcgtgaaggtggtgaagatcgaccccagctacacctccaagcggtgctcggagtgcgagtacatccacaagaacaaccgccaggaccagagcaccttcgagtgccagcagtgctccttcaaggtgcacgcggactacaacgcggccaagaacatcagcgtgtacaacatcgagaaggtgatccagaagcagctggaactgcaggagaagctcaaccagaccaagtacaaggagcagtacatcgagcagatgaagaacatcaactag

SEQ ID NO: 2477 - DNA, 1353 bp, Unknown
  Bacillus sp. multi
ctctccatcgcggtcaaggtgatgaagtaccagatcgtgtgcccggtcaacatcgagtggaagaccttcgagatatacctccggacgctcagctaccacttccggaccatcggcaaccgcacgatccagaagctctgggagtacgacaaccagtcgctcaagcacttcaaggacaccgggcagtacccgagcgcccagcagctctacggctgcacccagaagaccatcagcggctacatctacgaccagctcaaggaggagtaccaggacatcaacaaggccaacatgagcacgaccctccagaagacaatccggacctggaacagccgcaagaaggagatctggagcggcgagatgagcatccccagcttccgcaacaacctccccatcgacatccacggcaactcgatccagatcatcaaggagaagtcgggcgactacatcgccagcgtgtcgctgttctcctcgaagttcatcaaggagaacgacctgcccaacggcaagatcctggtgaagctgagcacccgcaagcagaactcgatgaaggtgatcctcgaccgcatcatcgactcgacgtacgcgaagggcgcgtgcatgctccacaagcacaagaagaagtggtacctgtcgatcacctacaagagcaacatcaaggaggagctgaaattcgacgaagacctgatcatggggatcgacatgggcaagatcaacgtcctgtacttcgcgttcaacaaggggctggtgcggggcaccatctcgggcgaggagatcgaggcgttccgcaagaaaatcgagcaccggcgcatcagcctcctgcgccagggcaagtattgctcgggcaaccggatcgggaagggccgcgagaagcggatcaagcccatcgacgtgctcaacgacaaggtggccaagttccgcaacgccacgaaccacaagtacgccaactacatcgtccagcagtgcctcaagtacaactgcggcacgatccagctcgaggacctcaaggggatcagcaaggagcagaccttcctcaagaactggacgtacttcgacctccaggagaagatcaagaaccaggccaaccagtacggggtgaaggtcgtcaagatcgacccctcctacacctccaagcggtgctcggagtgcgagtacatccacaagaacaaccgccaggaccagtccacgttcgagtgccagcagtgcagcttcaaggtgcacgccgactacaacgcggccaagaacatcagcgtgtacaacatcgagaaggtgatccagaagcagctcgaactccaggagaagctgaaccagacgaagtacaaggagcagtacatcgagcagatgaagaacatcaactga

SEQ ID NO: 2478 - DNA, 1353 bp, Unknown
  Bacillus sp. multi
ctctccatcgccgtcaaggtgatgaagtaccagatcgtgtgcccggtcaacatcgagtggaagacgttcgagatctacctccggacgctctcctaccacttccggaccatcggcaaccggaccatccagaagctgtgggagtacgacaaccagagcctcaagcacttcaaggacaccggccagtacccgtccgcgcagcagctctacggctgcacccagaagaccatctccgggtacatctacgaccagctcaaggaggagtaccaggacatcaacaaggcgaacatgagcaccaccctccagaaaacgatccgcacgtggaactcccgcaagaaggagatctggagcggggagatgagcatcccgtccttccgcaacaacctgcccatcgacatccacgggaacagcatccagatcatcaaggagaagtccggggactacatcgcctcggtcagcctcttcagcagcaagttcatcaaggagaacgacctgccgaacgggaagatcctggtcaagctgagcacccggaagcagaactcgatgaaggtcatcctggaccggatcatcgacagcacctacgcgaagggcgcgtgcatgttgcacaagcacaagaagaagtggtacctgtccatcacctacaagagcaacatcaaggaggagctcaagttcgacgaagacctcatcatgggcatcgacatgggcaagatcaacgtcctctacttcgcgttcaacaaggggctcgtgcggggcaccatcagcggcgaggagatcgaggcgttccgcaagaagatcgagcaccgccggatcagcctcctccgccagggcaaatactgctccgggaaccggatcggcaagggccgcgagaagcgcatcaagcccatcgacgtcctcaacgacaaggtggcgaagttccgcaacgccaccaaccacaagtacgccaactacatcgtgcagcagtgcctcaagtacaactgcggcaccatccagttggaggacctcaaggggatcagcaaggagcagaccttcctcaagaactggacctacttcgacctccaggagaagatcaagaaccaggccaaccagtacggcgtcaaggtcgtgaagatcgacccctcctacacctccaagcggtgcagcgagtgcgagtacatccacaagaacaaccgccaggaccagtccacgttcgagtgccagcagtgctccttcaaggtgcacgccgactacaacgcggccaagaacatcagcgtgtacaacatcgagaaggtcatccagaagcagctggagttacaggagaagctcaaccagacgaagtacaaggagcagtacatcgagcagatgaagaacatcaactag

SEQ ID NO: 2479 - DNA, 1353 bp, Unknown
  Bacillus sp. multi
ctgtccatcgcggtgaaggtcatgaagtaccagatcgtgtgcccggtgaacatcgagtggaagaccttcgaaatctacctgcggacgctgagctaccacttccgcaccatcgggaaccgcacgatccagaagctgtgggagtacgacaaccagtccctcaagcacttcaaggacacgggccagtacccgagcgcccagcagctctacggctgcacccagaagaccatctccggctacatctacgaccagctcaaggaggagtaccaggacatcaacaaggccaacatgagcaccaccctccagaagacgatccgcacgtggaactcgcgcaagaaggagatttggagcggcgagatgagcatcccgagcttccgcaacaacctgcccatcgacatccacggcaacagcatccagatcatcaaggagaagtccggcgactacatcgcgtccgtctcgctcttcagcagcaagttcatcaaggagaacgacctgccgaacgggaagatcctggtgaagctcagcacccgcaagcagaacagcatgaaggtcatcctggaccgcatcatcgactcgacctacgcgaagggcgcgtgcatgttgcacaagcacaagaagaagtggtatctgtccatcacgtacaagtcgaacatcaaggaggaactgaagttcgacgaggacctcatcatggggatcgacatgggcaagatcaacgtgctgtacttcgccttcaacaagggcctggtccggggcaccatctcgggcgaggagatcgaggcgttccgcaagaagatagagcaccgccgcatcagcctcctgcgccagggcaagtactgctccggcaaccggatcggcaagggccgcgagaagcgcatcaagcccatcgacgtcctgaacgacaaggtggcgaagttccgcaacgccacgaaccacaagtacgcgaactacatcgtgcagcagtgcctcaagtacaactgcggcacgatccagctcgaggacctcaaggggatctcgaaggagcagaccttcctcaagaactggacctacttcgacctccaggagaagatcaagaaccaggcgaaccagtacggcgtcaaggtggtgaagatcgacccctcctacaccagcaagcggtgctcggagtgcgagtacatccacaagaacaaccgccaggaccagtccaccttcgagtgccagcagtgctcgttcaaggtgcacgcggactacaacgccgccaagaacatctcggtgtacaacatcgagaaggtgatccagaagcagctcgaactccaggagaagctgaaccagaccaagtacaaggagcagtacatcgagcagatgaagaacatcaactga

SEQ ID NO: 2480 - DNA, 1353 bp, Unknown
  Bacillus sp. multi
ctctccatcgcggtcaaggtcatgaagtaccagatcgtgtgccccgtcaacatcgagtggaagacgttcgagatctacctgcggaccctctcctaccacttccggaccatcggcaaccggaccatccagaagctgtgggagtacgacaaccagtcgctcaagcacttcaaggacaccggccagtacccctccgcgcagcagctctacggctgcacgcagaagaccatctccgggtacatctacgaccagctcaaggaggagtaccaggacatcaacaaggccaacatgagcaccaccctccagaagaccatccggacgtggaactcgcgcaagaaggagatatggagcggggagatgtccatcccctccttccgcaacaacctgcccatcgacatccacggcaacagcatccagatcatcaaggagaagtccggcgactacatcgcctcggtcagcctgttctcgtccaagttcatcaaggagaacgacctggccaacggcaagatcctggtcaagctgagcacgcgcaagcagaacagcatgaaggtgatcctggaccggatcatcgactccacctacgcgaagggcgcgtgcatgcttcacaagcacaagaagaagtggtacctgtccatcacctacaagagcaacatcaaggaggagttgaagttcgacgaagacctcatcatgggcatcgacatgggcaagatcaacgtgctctacttcgcgttcaacaaggggctggtgcgcggggcgatctcgggcgaggagatcgaggcgttccgcaagaaaatcgagcaccggcggatctccctgctgcgccagggcaagtactgctcgggcaaccgcatcggcaaggggcgcgagaagcgcatcaagcccatcgacgtgctcaacgacaaggtggcgaagttccgcaacgccacgaaccacaagtacgccaactacatcgtccagcagtgcctcaagtacaactgcggcaccatccagcttgaagacctcaaggggatcagcaaggagcagacgttcctcaagaactggacgtacttcgacctccaggagaagatcaagaaccaggcgaaccagtacggcgtgaaggtggtgaagatcgacccgagctacacctcccagcgctgctcggagtgcgagtacatccacaagaacaaccgccaggaccagagcaccttcgagtgccagcagtgctccttcaaggtccacgccgactacaacgccgccaagaacatcagcgtgtacaacatcgagaaggtgatccagaagcagctggagctgcaggaaaagctgaaccagaccaagtacaaggagcagtacatcgagcagatgaagaatatcaactga

SEQ ID NO: 2481 - DNA, 1353 bp, Unknown
  Bacillus sp. multi
ctgtccatcgcggtgaaggtgatgaagtaccagatcgtgtgccccgtcaacatcgagtggaagaccttcgagatctacctccggacgctcagctaccacttccggaccatcggcaaccgcaccatccagaagctctgggagtacgacaaccagtcgctcaagcacttcaaggacaccgggcagtacccctccgcccagcagctctacggctgcacccagaagactatcagcgggtacatctacgaccagctcaaggaggagtaccaggacatcaacaaggcgaacatgagcacgaccctccagaaaacgatccgcacctggaactcccgcaagaaggagatttggagcggcgagatgtccatcccgagcttccgcaacaacctgcccatcgacatccacgggaactccatccagatcatcaaggagaagtccggggactacatcgcgtccgtgtccctgttctccagcaagttcatcaaggagaacgacctggcgaacggcaagatcctggtcaagctgagcacccgcaagcagaacagcatgaaggtcatcctggaccggatcatcgactccacctacgcgaagggcgcgtgcatgctccacaagcacaagaagaaatggtacctcagcatcacctacaagagcaacatcaaggaggagctcaagttcgacgaggatctgatcatgggcatcgacatggggaagatcaacgtgctgtacttcgccttcaacaagggcctcgtgcgcggggccatctccggcgaggagatcgaggcgttccgcaagaagatcgagcaccggcggatctccctgctgcgccagggcaagtactgctcgggcaaccgcatcgggaagggccgcgagaagcggatcaagcccatcgacgtgctgaacgacaaggtggccaagttccgcaacgcgaccaaccacaagtacgccaactacatcgtccagcagtgcctcaagtacaactgcgggacgattcagctcgaagacctcaaggggatctcgaaggagcagaccttcctcaagaactggacctacttcgacctccaggagaagatcaagaaccaggccaaccagtacggcgtcaaggtcgtcaagatcgacccctcctacaccagccagcgctgctccgagtgcgagtacatccacaagaacaaccgccaggaccagtccacgttcgagtgccagcagtgcagcttcaaggtccacgcggactacaacgcggccaagaacatctccgtgtacaacatcgagaaggtgatccagaagcaactagagctccaggagaagctgaaccagaccaagtacaaggagcagtacatcgagcagatgaagaacatcaactga

SEQ ID NO: 2482 - DNA, 1353 bp, Unknown
  Bacillus sp. multi
ctctccatcgcggtgaaggtgatgaagtaccagatcgtgtgcccggtgaacatcgagtggaagacgttcgagatctacctccggaccctcagctaccacttccgcaccatcggcaaccgcacgatccagaagctctgggagtacgacaaccagtcgctcaagcacttcaaggacaccggccagtacccgagcgcccagcagctctacggctgcacgcagaaaaccatctccggctacatctacgaccagctcaaggaggagtaccaggacatcaacaaggccaacatgagcaccaccctccagaagaccatccggacgtggaactcccgcaagaaggagatttggagcggcgagatgagcatcccgtccttccgcaacaacctgcccatcgacatccacggcaacagcatccagatcatcaaggagaagtccggcgactacatcgcgtcggtgagcctgttcagcagcaagttcatcaaggagaacgacctcgccaacggcaagatcctggtcaagctgagcacccggaagcagaacagcatgaaggtgatcctggaccgcatcatcgacagcacgtacgcgaagggcgcgtgcatgctgcacaagcacaagaagaagtggtacttatccatcacctacaagagcaacatcaaggaggagttaaagttcgacgaggacctcatcatgggcatcgacatggggaagatcaacgtcctctacttcgccttcaacaaggggctggtgcgcggggccatctcgggcgaggagatcgaggcgttccgcaagaagatcgagcaccggcgcatcagcctcctgcgccagggcaagtactgctcggggaaccggatcggcaaggggcgggagaagcggatcaagcccatcgacgtgctgaacgacaaggtggccaagttccgcaacgccacgaaccacaagtacgcgaactacatcgtgcagcagtgcctcaagtacaactgcggcaccatccagcttgaagacctcaaggggatctcgaaggagcagacgttcctcaagaactggacctacttcgacctccaggagaagatcaagaaccaggccaaccagtacggcgtcaaggtggtcaagatcgaccccagctacacgagccagcggtgctcggagtgcgagtacatccacaagaacaaccgccaggaccagagcacgttcgagtgccagcagtgcagcttcaaggtgcacgcggactacaacgcggccaagaacatctcggtgtacaacatcgagaaggtcatccagaagcagttggagctgcaggagaagctgaaccagaccaagtacaaggagcagtacatcgagcagatgaagaacatcaactag

SEQ ID NO: 2483 - DNA, 1353 bp, Unknown
  Bacillus sp. multi
ctctccatcgccgtgaaggtgatgaagtaccagatcgtgtgccccgtgaacatcgagtggaagacgttcgagatctacctccggaccctcagctaccacttccgcaccatcggcaaccgcacgatccagaagctctgggagtacgacaaccagtcgctcaagcacttcaaggacaccgggcagtacccctcggcccagcagctctacggctgcacccagaaaaccatctccgggtacatctacgaccagctcaaggaggagtaccaggacatcaacaaggcgaacatgagcacgaccctccagaagacgatccgcacgtggaactcccgcaagaaggaaatctggagcggcgagatgagcatcccctcgttccgcaacaacctccccatcgacatccacggcaactccatccagatcatcaaggagaagtcgggcgactacatcgccagcgtgagcctgttctcctcgaagttcatcaaggagaacgacctggccaacggcaagatcctggtcaagctcagcacccgcaagcagaactcgatgaaggtcatcctcgaccggatcatcgactccacctacgcgaagggcgcgtgcatgctccacaagcacaagaagaagtggtacctgtcgatcacctacaagtccaacatcaaggaggagctgaaattcgacgaagaccttatcatggggatcgacatgggcaagatcaacgtgctctacttcgccttcaacaagggcctcgtccggggcgcgatcagcggcgaggagatcgaggcgttccgcaagaagatcgagcaccgccgcatcagcctcctgcgccagggcaagtactgctccgggaaccgcatcgggaaggggcgcgagaagcgcatcaagcccatcgacgtgctgaacgacaaggtggccaagttccgcaacgccacgaaccacaagtacgcgaactacatcgtgcagcagtgcctcaagtacaactgcggcaccatccagctcgaagacctgaaagggatctcgaaggagcagacgttcctcaagaactggacctacttcgacctccaggagaagatcaagaaccaggcgaaccagtacggcgtgaaggtcgtgaagatcgacccgtcctacacgagccagcggtgctcggagtgcgagtacatccacaagaacaaccgccaggaccagtccaccttcgagtgccagcagtgctcgttcaaggtccacgcggactacaacgccgccaagaacatctccgtgtacaacatcgagaaggtcatccagaagcagctcgaactgcaggaaaagctgaaccagaccaagtacaaggagcagtacatcgagcagatgaagaacatcaactga

SEQ ID NO: 2484 - DNA, 1353 bp, Unknown
  Bacillus sp. multi
ctgagcatcgccgtgaaggtgatgaagtaccagatcgtgtgccccgtgaacatcgagtggaagaccttcgaaatctacctccggacgctctcctaccacttccgcaccatcgggaaccgcaccatccagaagctgtgggagtacgacaaccagtccctcaagcacttcaaggacaccggccagtacccgtccgcccagcagctctacggctgcacccagaaaacgatctccggctacatctacgaccagctcaaggaggagtaccaggacatcaacaaggccaacatgagcaccaccctccagaagacgatccgcacctggaacagccgcaagaaggagatttggagcggggagatgtccatcccgagcttccgcaacaacctgcccatcgacatccacggcaacagcatccagatcatcaaggagaagtccggcgactacatcgcctccgtgagcctgttctccagcaagttcatcaaggagaacgacctggccaacggcaagatcctggtcaagctctcgacccgcaagcagaactcgatgaaggtcatcctggaccgcatcatcgactccacctacgcgaagggcgcgtgcatgctccacaagcacaagaagaagtggtacttgagcatcacctacaagtccaacatcaaggaggagctgaagttcgacgaggacctcatcatgggcatcgacatggggaagatcaacgtcctgtacttcgcgttcaacaaggggctggtgcgcggggccatctcgggcgaggagatcgaggcgttccgcaagaagatcgagcaccgccgcatctccctcctgcgccagggcaagtactgctccgggaaccggatcggcaagggccgggagaagcgcatcaagcccatcgacgtgctgaacgacaaggtggcgaagttccgcaacgccaccaaccacaagtacgccaactacatcgtccagcagtgcctcaagtacaactgcggcaccatccagcttgaggatctcaaagggatctcgaaggagcagaccttcctcaagaactggacctacttcgacctccaggagaagatcaagaaccaggccaaccagtacggggtcaaggtcgtgaagatcgacccgtcctacacgagccagcggtgctccgagtgcgagtacatccacaagaacaaccgccaggaccagagcaccttcgagtgccagcagtgcagcttcaaggtgcacgcggactacaacgcggccaagaacatctcggtgtacaacatcgagaaggtgatccagaagcagctcgaacttcaggagaagctgaaccagaccaagtacaaggagcagtacatcgagcagatgaagaacatcaactga

SEQ ID NO: 2485 - DNA, 1359 bp, Unknown
  Bacillus sp. multi
atgtacctgtcgaaggtggtcaaggtcatgaagtaccagatcgtgtgccccgtcaacatcgagtggaaggcgttcgaaatctacctgcggacgctctcgtaccacttccgcaccatcggcaaccgcacgatccagaagctgtgggagtacgacaaccactccctcaagcacttcaaggacaccggccagtaccccagcgcccagcagctctacggctgcacccagaaaacgatctcggggtacatctacgaccagctcaaggaggagtaccaggacatcaacaaggcgaacatgagcaccaccctccagaagaccatcaagacctggaacagccgcaagaaggagatttggagcggggagatgagcatcccgagcttccgcaacaacctccccatcgacatccacgggaactccatccagatcatcaaggagaagtcgggcgactacatcgccaacgtctcgctgttctcctccaagttcatcaaggagaacgacctgcccaacgggaagatcctggtgaagctctccacccgcaagcagaacagcatgaaggtcatcctggaccgcatcatcgacagcacctacgcgaagggcgcgtgcatgctgcacaagcacaagaacaagtggtacctcagcatcacctacaaggcgacgatcaaggaggagcacaagttcgacgaggagctgataatggggatcgacatgggcaagatcaacgtgctctacttcgcctacaacaaggggagcgtgcgcggggccatctcgggcgaggagatcgaggcgttccgcaagaaaaccgagtaccgccggatctccctgctgcgccagggcaagcactgctccgagaaccgcatcggcaaggggcgcaagaagcgcatcaagcccatcgacgtgctcaacgacaaggtggccaagttccgcaacgccaccaaccacaagtacgccaactacatcgtccagcagtgcctcaagtacaactgcggcaccatccagcttgaggatctgcaggggatcagcaaggagcagaccttcctcaagaactggacctacttcgacctccaggagaagatcaagaaccaggcgaaccagtacggggtcaaggtcgtcaagatcgacccgtgctacacctcccagcggtgctcggagtgcggctacatccacaagaacaaccgccaggaccagagcaccttcgagtgccagcagtgctccttcaaggtccacgcggactacaacgccgccaagaacatctccgtgtacaacatcgagaaggtcatcaagaagcagctagagctgcaggagaagctgaacctgaccaagtacaaggagcagtacatcgagcagatggagaacatcaactag

SEQ ID NO: 2486 - DNA, 1359 bp, Unknown
  Bacillus sp. multi
atgtacctgagcaaggtcgtcaaggtgatgaagtaccagatcgtgtgccccgtgaacatcgagtggaaggcgttcgagatttacctgcggaccctctcctaccacttccggaccatcgggaaccgcacgatccagaagctctgggagtacgacaaccactccctcaagcacttcaaggacacgggccagtacccctccgcccagcagctctacgggtgcacgcagaagaccatctcgggctacatctacgaccagctcaaggaggagtaccaggacatcaacaaggccaacatgagcaccaccctccagaaaaccatcaagacgtggaactcccgcaagaaggaaatctggagcggcgagatgtccatcccctcgttccgcaacaacctccccatcgacatccacggcaacagcatccagatcatcaaggagaagtcgggcgactacatcgccaacgtctccctcttcagctcgaagttcatcaaggagaacgacctgccgaacgggaagatcctcgtcaagctcagcacgcgcaagcagaacagcatgaaggtcatcctggaccgcatcatcgacagcacgtacgcgaagggcgcgtgtatgctccacaagcacaagaacaagtggtacctcagcatcacctacaaggccaccatcaaggaggagcacaagttcgacgaggagcttatcatgggcatcgacatgggcaagatcaacgtcctgtacttcgcctacaacaaggggtcggtgcggggcgcgatcagcggcgaggagatcgaggcgttccgcaagaagacggagtaccgccgcatctcgctgctccgccagggcaagcactgctccgagaaccgcatcgggaaggggcgcaagaagcggatcaagcccatcgacgtgctcaacgacaaggtggccaagttccgcaacgcgacgaaccacaagtacgccaactacatcgtccagcagtgcctcaagtacaactgcgggacgatccagctcgaagacctacaggggatcagcaaggagcagacgttcctcaagaactggacctacttcgacctccaggagaagatcaagaaccaggcgaaccagtacggcgtgaaggtcgtgaagatcgacccgtgctacacctcccagcgctgctcggagtgcggctacatccacaagaacaaccgccaggaccagagcacgttcgagtgccagcagtgctcgttcaaggtccacgcggactacaacgccgccaagaacatctccgtgtacaacatcgagaaggtcatcaagaagcagctcgaactccaggagaagctgaacctcaccaagtacaaggagcagtacatcgagcagatggagaacatcaactga

SEQ ID NO: 2487 - DNA, 1359 bp, Unknown
  Bacillus sp. multi
atgtacctgtcgaaggtggtgaaggtgatgaagtaccagatcgtgtgcccggtgaacatcgagtggaaggcgttcgaaatctacctccggaccctctcctaccacttccgcaccatcggcaaccggaccatccagaagctgtgggagtacgacaaccactccctcaagcacttcaaggacaccggccagtacccgtcggcccagcagctctacgggtgcacgcagaagaccatcagcggctacatctacgaccagctcaaggaggagtaccaggacatcaacaaggccaacatgagcaccaccctccagaagaccatcaagacgtggaacagccgcaagaaggagatctggagcggcgagatgtccatcccctcgttccgcaacaacctccccatcgacatccacgggaactcgatccagatcatcaaggagaagtccggcgactacatcgccaacgtctccctgttctcctccaagttcatcaaggagaacgacctgccgaacgggaagatcctggtcaagctgagcacccgcaagcagaacagcatgaaggtcatcctcgaccggatcatcgacagcacctacgcgaagggcgcgtgcatgctccacaagcacaagaacaagtggtacttgtccatcacctacaaggccacgatcaaggaggagcacaagttcgacgaggagctaatcatggggatcgacatgggcaagatcaacgtgctctacttcgcctacaacaaggggagcgtgcgcggcgcgatctcgggcgaggagatcgaggcgttccgcaagaagaccgagtaccgccgcatcagcctgctgcgccaggggaagcactgctccgagaaccgcatcggcaagggccgcaagaagcgcatcaagcccatcgacgtgctcaacgacaaggtggcgaagttccgcaacgcgacgaaccacaagtacgcgaactacatcgtccagcagtgcctcaagtacaactgcggcaccattcagctcgaggatctccagggcatcagcaaggagcagaccttcctcaagaactggacctacttcgacctccaggagaagattaagaaccaggcgaaccagtacggggtcaaggtggtcaagatcgacccctgctacacgagccagcggtgctcggagtgcggctacatccacaagaacaaccgccaggaccagagcaccttcgagtgccagcagtgctcgttcaaggtgcacgccgactacaacgcggccaagaacatcagcgtgtacaacatcgagaaggtcatcaagaagcagcttgagctgcaggaaaagctgaacctcacgaagtacaaggagcagtacatcgagcagatggagaacatcaactga

SEQ ID NO: 2488 - DNA, 1359 bp, Unknown
  Bacillus sp. multi
atgtacctgagcaaggtggtgaaggtcatgaagtaccagatcgtctgccccgtcaacatcgagtggaaggcgttcgagatctacctgcggaccctcagctaccacttccgcaccatcggcaaccgcaccatccagaagctctgggagtacgacaaccacagcctcaagcacttcaaggacaccggccagtacccgtcggcccagcagctctacggctgcacccagaaaactatcagcggctacatctacgaccagctcaaggaggagtaccaggacatcaacaaggccaacatgagcacgaccctccagaaaaccatcaagacgtggaactcccgcaagaaggagatctggagcggggagatgtccatcccgtccttccgcaacaacctccccatcgacatccacgggaactccatccagatcatcaaggagaagtccggggactacatcgccaacgtgagcctgttcagctcgaagttcatcaaggagaacgacctgccgaacggcaagatcctggtgaagctgagcacccggaagcagaactccatgaaggtcatcctggaccgcatcatcgacagcacgtacgcgaagggcgcgtgcatgctgcacaagcacaagaacaagtggtacttgtccatcacctacaaggccacgatcaaggaggagcacaagttcgacgaggagttgatcatggggatcgacatgggcaagatcaacgtcctctacttcgcctacaacaagggcagcgtgcgcggggcgatcagcggcgaggagatcgaggcgttccgcaagaagacagagtaccgccggatcagcctcctgcgccaggggaagcactgctcggagaaccggatcggcaagggccgcaagaagcggatcaagcccatcgacgtcctgaacgacaaggtggccaagttccgcaacgcgacgaaccacaagtacgcgaactacatcgtgcagcagtgcctcaagtacaactgcggcaccatccagctcgaagacctccagggcatcagcaaggagcagacgttcctcaagaactggacgtacttcgacctccaggagaagatcaagaaccaggcgaaccagtacggcgtgaaggtggtcaagatcgacccgtgctacacgagccagcgctgctccgagtgcgggtacatccacaagaacaaccgccaggaccagagcaccttcgagtgccagcagtgcagcttcaaggtgcacgccgactacaacgccgccaagaacatctcggtgtacaacatcgagaaggtcatcaagaagcagctggaactccaggagaagctgaacctcaccaagtacaaggagcagtacatcgagcagatggagaacatcaactga

SEQ ID NO: 2489 - DNA, 1359 bp, Unknown
  Bacillus sp. multi
atgtacctctcgaaggtggtgaaggtgatgaagtaccagatcgtctgcccggtgaacatcgagtggaaggcgttcgagatctacttgcggacgctctcctaccacttccggaccatcggcaaccggaccatccagaagctgtgggagtacgacaaccactccctcaagcacttcaaggacacgggccagtacccgtccgcccagcagctctacggctgcacccagaagaccatcagcgggtacatctacgaccagctcaaggaggagtaccaggacatcaacaaggccaacatgagcaccaccctccagaaaaccatcaagacctggaacagccgcaagaaggaaatctggagcggggagatgagcatcccctccttccgcaacaacctgcccatcgacatccacgggaacagcatccagatcatcaaggagaagtccggcgactacatcgccaacgtcagcctgttctcctccaagttcatcaaggagaacgacctgcccaacgggaagatcctcgtgaagctctcgacgcgcaagcagaacagcatgaaggtcatcctcgaccgcatcatcgactccacctacgcgaagggcgcgtgcatgttgcacaagcacaagaacaagtggtacctttccatcacctacaaggccaccatcaaggaggagcacaagttcgacgaggagctcatcatgggcatcgacatggggaagatcaacgtgctgtacttcgcctacaacaagggctccgtgcgcggcgcgatcagcggcgaggagatcgaggcgttccgcaagaagacggagtaccgccgcatctccctgctccgccaggggaagcactgctccgagaaccgcatcggcaaggggcgcaagaagcgcatcaagcccatcgacgtgctgaacgacaaggtggcgaagttccgcaacgcgaccaaccacaagtacgccaactacatcgtccagcagtgcctcaagtacaactgcgggaccatccagcttgaggatctccaggggatcagcaaggagcagacgttcctcaagaactggacctacttcgacctccaggagaagatcaagaaccaggcgaaccagtacggcgtcaaggtcgtcaagatcgacccgtgctacaccagccagcggtgctcggagtgcggctacatccacaagaacaaccgccaggaccagtccaccttcgagtgccagcagtgctcgttcaaggtgcacgccgactacaacgccgccaagaacatctcggtgtacaacatcgagaaggtcatcaagaagcagcttgagctccaggagaagctgaacctcaccaagtacaaggagcagtacatcgagcagatggagaacatcaactga

SEQ ID NO: 2490 - DNA, 1353 bp, Unknown
  Bacillus sp. multi
ctcagcatcgccgtgaaggtgatgaagtaccagatcgtgtgcccggtcaacatcgagtggaagacgttcgagatatacctgcggaccctctcgtaccacttccggaccatcggcaaccggaccatccagaagctgtgggagtacgacaaccagtccctcaagcacttcaaggacaccggccagtacccgtcggcccagcagctctacggctgcacccagaaaaccatcagcgggtacatctacgaccagctcaaggaggagtaccaggacatcaacaaggcgaacatgagcaccaccctccagaaaactatccgcacgtggaactcccgcaagaaggagatctggagcggcgagatgagcatcccctcgttccgcaacaacctccccatcgacatccacggcaactcgatccagatcatcaaggagaagtccggcgactacatcgcctcggtgtcgctgttctcctccaagttcatcaaggagaacgacctgccgaacgggaagatcctggtcaagctgagcacgcggaagcagaactccatgaaggtcatcctggaccgcatcatcgactccacctacgcgaagggcgcgtgcatgctgcacaagcacaagaagaagtggtacctgtcgatcacctacaagtcgaacatcaaggaggagttgaagttcgacgaggacttaatcatgggcatcgacatggggaagatcaacgtcctctacttcgccttcaacaagggcctcgtgcggggcgcgatcagcggcgaggagatcgaggcgttccgcaagaagatcgagcaccgccgcatctccctcctccgccagggcaagtactgctcgggcaaccgcatcgggaagggccgcgagaagcgcatcaagcccatcgacgtgctcaacgacaacgtggccaagttccgcaacgcgacgaaccacaagtacgcgaactacatcgtgcagcagtgcctcaagtacaactgcgggacgatccagctcgaggacctcaaggggatcagcaaggagcagacgttcctcaagaactggacgtacttcgacctccaggagaagatcaagaaccaggcgaaccagtacggggtcaaggtggtgaagatcgacccctcctacacctcccagcggtgctccgagtgcggctacatccacaagaacaaccgccaggaccagtccaccttcgagtgccagcactgctcgttcaaggtccacgccgactacaacgccgccaagaacatcagcctctacaacatcgagaaggtgatccagaagcagcttgaactacaggagaagctgaaccagaccaagtacaaggagcagtacatcgagcagatgaagaacatcaactga

SEQ ID NO: 2491 - DNA, 1353 bp, Unknown
  Bacillus sp. multi
ctgtccatcgccgtcaaggtgatgaagtaccagatcgtgtgcccggtcaacatcgagtggaagaccttcgagatctacctgcggacgctctcgtaccacttccgcaccatcggcaaccggaccatccagaagctgtgggagtacgacaaccagtcgctcaagcacttcaaggacaccggccagtacccgtccgcccagcagctctacggctgcacccagaagaccatctccgggtacatctacgaccagctcaaggaggagtaccaggacatcaacaaggccaacatgagcaccaccctccagaaaaccatccggacgtggaactcccgcaagaaggagatatggagcggggagatgtccatcccctcgttccgcaacaacctgcccatcgacatccacgggaacagcatccagatcatcaaggagaagtccggcgactacatcgcctccgtgagcctgttctcctccaagttcatcaaggagaacgacctcccgaacggcaagatcctggtcaagctcagcacccggaagcagaacagcatgaaggtgatcctcgaccgcatcatcgactccacgtacgcgaagggcgcgtgcatgttgcacaagcacaagaagaagtggtacctgtcgatcacgtacaagtccaacatcaaggaggagctcaagttcgacgaggacttaatcatggggatcgacatggggaagatcaacgtcctgtacttcgccttcaacaagggcctggtgcgcggggcgatctccggggaggagatcgaggcgttccgcaagaaaatcgagcaccgccggatcagcctcctgcgccagggcaagtactgctccggcaaccggatcgggaagggccgcgagaagcggatcaagcccatcgacgtcctcaacgacaacgtggccaagttccgcaacgccacgaaccacaagtacgcgaactacatcgtccagcagtgcctcaagtacaactgcggcacgatccagctcgaggacttgaaggggatcagcaaggagcagacgttcctcaagaactggacgtacttcgacctccaggagaagattaagaaccaggccaaccagtacggggtgaaggtcgtcaagatcgaccccagctacaccagccagcggtgcagcgagtgcggctacatccacaagaacaaccgccaggaccagagcacgttcgagtgccagcactgctcgttcaaggtgcacgcggactacaacgcggccaagaacatcagcctctacaacatcgagaaggtgatccagaagcagcttgagctacaggagaagctcaaccagaccaagtacaaggagcagtacatcgagcagatgaagaacatcaactga

SEQ ID NO: 2492 - DNA, 1353 bp, Unknown
  Bacillus sp. multi
ctctccatcgccgtcaaggtgatgaagtaccagatcgtgtgcccggtgaacatcgagtggaagaccttcgagatctacctgcggacgctcagctaccacttccgcaccatcgggaaccgcacgatccagaagctctgggagtacgacaaccagtccctcaagcacttcaaggacacggggcagtacccctccgcccagcagctctacgggtgcacgcagaagacaatctcgggctacatctacgaccagctcaaggaggagtaccaggacatcaacaaggccaacatgagcaccaccctccagaaaaccatccgcacgtggaactcccgcaagaaggagatctggagcggggagatgtccatcccgtccttccgcaacaacctccccatcgacatccacgggaactccatccagatcatcaaggagaagtcgggcgactacatcgcctccgtcagcctgttctcctccaagttcatcaaggagaacgacctgcccaacggcaagatcctggtgaagctgagcacccggaagcagaactcgatgaaggtgatcctcgaccgcatcatcgactccacctacgcgaagggcgcgtgcatgctccacaagcacaagaagaagtggtacctgtccatcacctacaagagcaacatcaaggaggagctgaagttcgacgaagacctcatcatggggatcgacatggggaagatcaacgtgctctacttcgcgttcaacaaggggctggtgcgcggggcgatcagcggcgaggagatcgaggcgttccgcaagaagattgagcaccgccggatctcgctgctgcgccagggcaagtattgctccggcaaccgcatcggcaagggccgcgagaagcgcatcaagcccatcgacgtcctcaacgacaacgtggccaagttccgcaacgcgaccaaccacaagtacgcgaactacatcgtgcagcagtgcctcaagtacaactgcggcacgatacaactggaagacctgaaggggatcagcaaggagcagaccttcctcaagaactggacgtacttcgacctccaggagaagatcaagaaccaggcgaaccagtacggggtgaaggtggtcaagatcgacccgtcctacacctcccagcggtgctcggagtgcggctacatccacaagaacaaccgccaggaccagtccaccttcgagtgccagcactgctcgttcaaggtccacgcggactacaacgccgccaagaacatctccctctacaacatcgagaaggtgatccagaagcagctggaactacaggagaagctgaaccagaccaagtacaaggagcagtacatcgagcagatgaagaacatcaactag

SEQ ID NO: 2493 - DNA, 1353 bp, Unknown
  Bacillus sp. multi
ctgagcatcgccgtcaaggtgatgaagtaccagatcgtgtgcccggtcaacatcgagtggaagaccttcgaaatctacctccggaccctgagctaccacttccgcaccatcggcaaccggaccatccagaagctctgggagtacgacaaccagagcctcaagcacttcaaggacacgggccagtacccgagcgcccagcagctctacggctgcacccagaagaccatctccgggtacatctacgaccagctcaaggaggagtaccaggacatcaacaaggcgaacatgagcaccaccctccagaaaaccatccgcacctggaacagccgcaagaaggaaatctggagcggggagatgtccatccccagcttccgcaacaacctccccatcgacatccacggcaactccatccagatcatcaaggagaagtcgggcgactacatcgcctccgtcagcctgttcagcagcaagttcatcaaggagaacgacctcccgaacgggaagatcctggtcaagctctccacgcgcaagcagaactcgatgaaggtgatcctggaccggatcatcgacagcacgtacgcgaagggcgcgtgcatgctccacaagcacaagaagaagtggtacctcagcatcacctacaagtccaacatcaaggaggagttgaaattcgacgaagacctgatcatggggatcgacatgggcaagatcaacgtcctgtacttcgcgttcaacaagggcctcgtgcgcggggcgatcagcggggaggagatcgaggcgttccgcaagaagatcgagcaccggcggatcagcctgctgcgccaggggaagtattgctccggcaaccgcatcgggaagggccgggagaagcgcatcaagcccatcgacgtgctgaacgacaacgtggcgaagttccgcaacgccacgaaccacaagtacgcgaactacatcgtgcagcagtgcctcaagtacaactgcggcaccatccagttggaggacctcaaggggatctcgaaggagcagaccttcctcaagaactggacctacttcgacctccaggagaaaatcaagaaccaggccaaccagtacggggtgaaggtggtgaagatcgacccctcctacaccagccagcgctgctccgagtgcggctacatccacaagaacaaccgccaggaccagagcaccttcgagtgccagcactgctcgttcaaggtccacgcggactacaacgcggccaagaacatctccctctacaacatcgagaaggtcatccagaagcagctagagctccaggagaagctgaaccagaccaagtacaaggagcagtacatcgagcagatgaagaacatcaactga

SEQ ID NO: 2494 - DNA, 1353 bp, Unknown
  Bacillus sp. multi
ctcagcatcgccgtgaaggtgatgaagtaccagatcgtgtgccccgtcaacatcgagtggaagacgttcgagatctacctgcggacgctctcctaccacttccgcaccatcgggaaccggacgatccagaagctgtgggagtacgacaaccagtcgctcaagcacttcaaggacaccggccagtacccctccgcgcagcagctctacggctgcacgcagaaaaccatctccggctacatctacgaccagctcaaggaggagtaccaggacatcaacaaggcgaacatgagcacgaccctccagaaaacgatccgcacctggaactcccgcaagaaggagatctggagcggcgagatgtccatcccctccttccggaacaacctccccatcgacatccacggcaactccatccagatcatcaaggagaagtccggcgactacatcgcctccgtctccctgttctccagcaagttcatcaaggagaacgacctgcccaacgggaagatcctggtgaagctgtccacccggaagcagaactccatgaaggtcatcctcgaccgcatcatcgacagcacctacgcgaagggcgcgtgcatgctccacaagcacaagaagaagtggtacttgagcatcacctacaagtccaacatcaaggaggagctcaaattcgacgaggacctcatcatgggcatcgacatggggaagatcaacgtcctgtacttcgcgttcaacaagggcctggtgcggggcgcgatcagcggggaggagatcgaggcgttccgcaagaagatcgagcaccggcgcatcagcctgctccgccagggcaaatactgctccgggaaccgcatcggcaagggccgcgagaagcgcatcaagcccatcgacgtgctgaacgacaacgtggcgaagttccgcaacgcgacgaaccacaagtacgcgaactacatcgtgcagcagtgcctcaagtacaactgcggcaccattcagctcgaagaccttaaagggatcagcaaggagcagaccttcctcaagaactggacctacttcgacctccaggagaagatcaagaaccaggccaaccagtacggggtcaaggtggtcaagatcgacccgagctacaccagccagcggtgctcggagtgcgggtacatccacaagaacaaccgccaggaccagtccaccttcgagtgccagcactgctcgttcaaggtccacgcggactacaacgccgccaagaacatcagcctgtacaacatcgagaaggtgatccagaagcagctggagcttcaggagaagctgaaccagacgaagtacaaggagcagtacatcgagcagatgaagaacatcaactga

SEQ ID NO: 2495 - DNA, 1359 bp, Unknown
  Bacillus sp. multi
atgtacctctcgaaggtggtgaaggtcatgaagtaccagatcgtgtgcccggtcaacatcgagtggaaggcgttcgagatctacctgcggacgctcagctaccacttccgcaccatcggcaacaagacgatccagaagctctgggagtacgacaaccacagcctcaagcacttcaaggacaccggccagtacccgtcggcgcagcagctctacggctgcacccagaagacgatctccggctacatctacgaccagctcaaggaggagtaccaggacatcaacaaggccaacatgagcacgaccctccagaagaccatcaagacctggaactcccgcaagaaggagatctggagcggggagatgtccatcccgagcttccgcaacaacctccccatcgacatccacggcaactcgatccagatcatcaaggagaagtccggggactacatcgccaacgtctcgctgttctcctccaagttcatcaaggagaacgacctccccaacgggaagatcctcgtgaagctgtccacccggaagcagaactccatgaaggtcatcctcgaccgcatcatcgacagcacctacgcgaagggcgcgtgcatgctgcacaagcacaagaacaagtggtacttgagcatcacctacaaggccacgatcaaggaggagcacaagttcgacgaggagcttatcatggggatcgacatggggaagatcaacgtcctctacttcgcctacaacaaggggctggtgcgcggggcgatcagcggggaggagatcgaggcgttccgcaagaagaccgagtaccgccgcatcagcctgctgcgccagggcaaatactgctccgagaaccgcatcggcaagggccgcaagaagcgcatcaagcccatcgacgtgctcaacgacaaggtggccaagttccgcaacgcgaccaaccacaagtacgcgaactacatcgtccagcagtgcctcaagtacaactgcgggaccatccaacttgaggacctccaggggatcagcaaggagcagaccttcctcaagaactggacccacttcgacctccaggagaagatcaagaaccaggccaaccagtacggggtgaaggtggtcaagatcgacccgtcctacacctcgcagcggtgctccgagtgcgggtacatccacaagaacaaccgccaggaccagagcaccttcgagtgccagcagtgctccttcaaggtccacgcggactacaacgcggccaagaacatctccgtgtacaacatcgagaaggtgatccagaagcagcttgagctccaggaaaagctgaacctgacgaagtacaaggagcagtacatcgagcagatggagaacatcaactga

SEQ ID NO: 2496 - DNA, 1359 bp, Unknown
  Bacillus sp. multi
atgtacctgagcaaggtcgtgaaggtgatgaagtaccagatcgtgtgccccgtgaacatcgagtggaaggcgttcgagatctatctccggacgctcagctaccacttccgcaccatcggcaacaagaccatccagaagctctgggagtacgacaaccactcgctcaagcacttcaaggacaccgggcagtacccgtcggcccagcagctctacggctgcacccagaagacgatcagcggctacatctacgaccagctcaaggaggagtaccaggacatcaacaaggccaacatgagcaccaccctccagaaaacgatcaagacctggaactcccgcaagaaggaaatctggagcggggagatgagcatccccagcttccggaacaacctccccatcgacatccacggcaactccatccagatcatcaaggagaagtccggggactacatcgccaacgtctccctcttcagcagcaagttcatcaaggagaacgacctgccgaacggcaagatcctggtcaagctgtccacgcgcaagcagaactccatgaaggtgatcctggaccggatcatcgactcgacgtacgcgaagggcgcgtgcatgctacacaagcacaagaacaagtggtacctttccatcacctacaaggccacgatcaaggaggagcacaagttcgacgaggagctcatcatggggatcgacatgggcaagatcaacgtgctgtacttcgcctacaacaagggcctggtgcggggcgcgatctcgggcgaggagatcgaggcgttccgcaagaagaccgagtaccggcgcatctcgctcctgcgccagggcaagtactgctcggagaaccgcatcggcaaggggcgcaagaagcggatcaagcccatcgacgtcctcaacgacaaggtggccaagttccgcaacgccaccaaccacaagtacgcgaactacatcgtccagcagtgcctcaagtacaactgcggcacgatccagctcgaagacctccagggcatcagcaaggagcagacgttcctcaagaactggacccacttcgacctccaggagaagatcaagaaccaggcgaaccagtacggggtcaaggtggtcaagatcgacccgagctacacgagccagcggtgctcggagtgcggctacatccacaagaacaaccgccaggaccagagcaccttcgagtgccagcagtgcagcttcaaggtgcacgccgactacaacgccgccaagaacatcagcgtgtacaacatcgagaaggtgatccagaagcagctcgaactccaggagaagctcaacctgaccaagtacaaggagcagtacatcgagcagatggagaacatcaactga

SEQ ID NO: 2497 - DNA, 1359 bp, Unknown
  Bacillus sp. multi
atgtacctcagcaaggtcgtgaaggtcatgaagtaccagatcgtgtgcccggtgaacatcgagtggaaggcgttcgagatctacctgcggacgctcagctaccacttccggaccatcgggaacaagacgatccagaagctctgggagtacgacaaccactccctcaagcacttcaaggacaccggccagtacccgagcgcccagcagctctacggctgcacgcagaagacgatcagcgggtacatctacgaccagctcaaggaggagtaccaggacatcaacaaggcgaacatgagcacgaccctccagaagacgatcaagacgtggaactcgcgcaagaaggagatctggagcggggagatgtccatcccctccttccgcaacaacctgcccatcgacatccacggcaacagcatccagatcatcaaggagaagtccggggactacatcgccaacgtgagcctgttctccagcaagttcatcaaggagaacgacctgccgaacggcaagatcctcgtcaagctgagcacgcggaagcagaactcgatgaaggtcatcctcgaccggatcatcgacagcacctacgcgaagggcgcgtgcatgctgcacaagcacaagaacaagtggtacttgtccatcacctacaaggcgaccatcaaggaggagcacaagttcgacgaggagctgataatgggcatcgacatggggaagatcaacgtcctgtacttcgcctacaacaaggggctcgtgcgcggggcgatctcgggcgaggagatcgaggcgttccgcaagaaaacagagtaccgccggatctccctcctgcgccagggcaagtactgctcggagaaccgcatcggcaaggggcgcaagaagcggatcaagcccatcgacgtcctgaacgacaaggtggcgaagttccgcaacgccacgaaccacaagtacgcgaactacatcgtgcagcagtgcctcaagtacaactgcgggaccatccagcttgaggatctgcaggggatctcgaaggagcagaccttcctcaagaactggacccacttcgacctccaggagaagatcaagaaccaggccaaccagtacggcgtcaaggtggtgaagatcgaccccagctacacctcgcagcggtgcagcgagtgcgggtacatccacaagaacaaccgccaggaccagtccacgttcgagtgccagcagtgcagcttcaaggtgcacgcggactacaacgccgccaagaacatctcggtgtacaacatcgagaaggtgatccagaagcagcttgagctccaggagaagctgaacctgaccaagtacaaggagcagtacatcgagcagatggagaacatcaactga

SEQ ID NO: 2498 - DNA, 1359 bp, Unknown
  Bacillus sp. multi
atgtacctcagcaaggtcgtgaaggtcatgaagtaccagatcgtgtgcccggtcaacatcgagtggaaggcgttcgagatctacctgcggacgctcagctaccacttccggaccatcggcaacaagaccatccagaagctctgggagtacgacaaccacagcctcaagcacttcaaggacaccggccagtacccgagcgcccagcagctctacggctgcacccagaagacgatctccgggtacatctacgaccagctcaaggaggagtaccaggacatcaacaaggcgaacatgagcacgaccctccagaagacgatcaagacgtggaacagccgcaagaaggagatttggagcggggagatgtccatcccgagcttccgcaacaacctgcccatcgacatccacggcaactccatccagatcatcaaggagaagtccggcgactacatcgccaacgtctcgctgttctcctccaagttcatcaaggagaacgacctccccaacgggaagatcctcgtcaagctcagcacgcgcaagcagaacagcatgaaggtcatcctcgaccggatcatcgactcgacgtacgcgaagggcgcgtgcatgctgcacaagcacaagaacaagtggtacctttccatcacgtacaaggccaccatcaaggaggagcacaagttcgacgaggagctgatcatggggatcgacatgggcaagatcaacgtcctgtacttcgcctacaacaagggcctggtccggggcgcgatctccggcgaggagatcgaggcgttccgcaagaaaaccgagtaccggcgcatctccctgctccgccagggcaaatactgctcggagaaccggatcggcaagggccgcaagaagcggatcaagcccatcgacgtgctgaacgacaaggtggccaagttccgcaacgccacgaaccacaagtacgccaactacatcgtgcagcagtgcctcaagtacaactgcggcacgatccagctcgaagacctccagggaatctcgaaggagcagacgttcctcaagaactggacccacttcgacctccaggagaagatcaagaaccaggccaaccagtacggggtgaaggtcgtcaagatcgacccgagctacaccagccagcggtgctccgagtgcggctacatccacaagaacaaccgccaggaccagtccaccttcgagtgccagcagtgctcgttcaaggtgcacgccgactacaacgccgccaagaacatctcggtgtacaacatcgagaaggtgatccagaagcagctcgaactccaggagaagctcaacctcacgaagtacaaggagcagtacatcgagcagatggagaacatcaactga

SEQ ID NO: 2499 - DNA, 1359 bp, Unknown
  Bacillus sp. multi
atgtacctctcgaaggtcgtgaaggtgatgaagtaccagatcgtgtgcccggtgaacatcgagtggaaggcgttcgagatctacctgcggaccctcagctaccacttccgcaccatcggcaacaagaccatccagaagctgtgggagtacgacaaccacagcctcaagcacttcaaggacacggggcagtacccgtcggcccagcagctctacgggtgcacgcagaagacgatctccggctacatctacgaccagctcaaggaggagtaccaggacatcaacaaggcgaacatgagcacgaccctccagaaaaccatcaagacgtggaacagccgcaagaaggagatctggagcggcgagatgagcatcccctccttccgcaacaacctgcccatcgacatccacggcaactcgatccagatcatcaaggagaagtccggggactacatcgccaacgtctccctgttctccagcaagttcatcaaggagaacgacctgcccaacggcaagatcctggtgaagctcagcacccggaagcagaacagcatgaaggtgatcctcgaccggatcatcgacagcacctacgcgaagggcgcgtgcatgttgcacaagcacaagaacaagtggtacctttccatcacctacaaggcgaccatcaaggaggagcacaagttcgacgaggagttgatcatgggcatcgacatgggcaagatcaacgtgctctacttcgcctacaacaagggcctggtccggggcgcgatctcgggcgaggagatcgaggcgttccgcaagaagacggagtaccgccgcatctcgctgctccgccagggcaagtattgctccgagaaccggatcgggaaggggcgcaagaagcgcatcaagcccatcgacgtgctgaacgacaaggtggcgaagttccgcaacgcgaccaaccacaagtacgccaactacatcgtccagcagtgcctcaagtacaactgcgggaccatccagctcgaagacctccagggcatcagcaaggagcagacgttcctcaagaactggacgcacttcgacctccaggagaagatcaagaaccaggccaaccagtacggcgtgaaggtcgtgaagatcgaccccagctacacctcccagcggtgcagcgagtgcggctacatccacaagaacaaccgccaggaccagtccacgttcgagtgccagcagtgcagcttcaaggtgcacgcggactacaacgcggccaagaacatctcggtgtacaacatcgagaaggtcatccagaagcaactggagctgcaggagaagctgaacctgaccaagtacaaggagcagtacatcgagcagatggagaacatcaactga

SEQ ID NO: 2500 - DNA, 1353 bp, Unknown
  Bacillus sp. multi
ctctccaccgtggtgaaggtcatgaagtaccagatcgtgtgcccgctcaacctggactggaagatgttcgagaagtacctgcggaccctctcgtaccaagtccgcaccatcgggaaccgcaccatccagaagctctgggacttcgacaaccagtcgctgaaccacttccgcgagaacggcgtgtacccctccgcgaagcagctctacggctgcacccagaaaacaatctcgggctacatctacgaccagctcaaggaggagtaccaggacatcaacaaggccaacatgagcaccacgctccagaagacgatcaagacgtggaacagccgcaagaaggagatacgcagcggcgacatgagcatcccgtcgttccgcaacaacctccccatcgacatccacggcaactccatccagatcacgaaggagaagtccggggactacatcgcgtccctctccctgttcagcagcaacttcatcaaggagaacaacctcccgaacggcaagatccaggtcaagctgagcacccgcaagcagaactccatgaaggtgatcctggaccggatcatcgagaacacctacgcgaagggcgcgtgcatcctccacaagcacaagaacaagtggtacctgtccatcatctacaagcccatcgtgaaggaggagcacaagttcgaggaagaccttgtgatggggatcgacatggggaagatcaacgtgctctacttcgccttcaacaagggctggatcaggggcgcgatctccggggaggagatcgaggcgttccgcaagaaaatcgagcaccggcggatcagcctgctccgccaggggaagtactgctcgggcaaccgcgtcggcaagggccgggagaagcggatcaagccgatcaacgtcctcaacaacaaggtggccaagttccgcaacgcgacgaaccacaagtacgccaactacatcgtccagcagtgcctcaagtacaactgcgggacgatccagcttgagaacctccagggcatcagcaaggagcagacgttcctcaagaactggacgtacttcgacctccaggagaagatcaagcaacaagcgcaccagtacggcatcaaggtcgtcaccatcgacccgtcctacacctcccagcggtgctccgagtgcggctacatccacaagaacaaccggcagagccagagcaccttcgagtgccagcgctgcaacctcaaggtccacgcggactacaacgccgccaagaacatcagcatctacaacatcgagaaggtgatccagaagcagctcaagctccaggagaagctcaactccaagaagttcacggagcagtacatcgagcagatcgagaacatcaactga

SEQ ID NO: 2501 - DNA, 1353 bp, Unknown
  Bacillus sp. multi
ctctccacggtcgtgaaggtcatgaagtaccagatcgtgtgcccgctgaacctggactggaagatgttcgagaagtacctccgcacgctcagctaccaagtccggaccatcgggaaccggacgatccagaagctctgggacttcgacaaccagtccctcaaccacttccgggagaacggggtgtacccgtcggccaagcagctctacggctgcacccagaaaacgatctccggctacatctacgaccagctcaaggaggagtaccaggacatcaacaaggccaacatgagcaccaccctccagaaaacgatcaagacgtggaactcccgcaagaaggagatccggagcggggacatgagcatcccgtccttccggaacaacctgcccatcgacatccacggcaacagcatccagatcacgaaggagaagtccggcgactacatcgcctccctctccctgttcagctccaacttcatcaaggagaacaacctgccgaacgggaagatccaggttaagctctccacccgcaagcagaacagcatgaaggtgatcctggaccggatcatcgagaacacctacgcgaagggcgcgtgcatcctgcacaagcacaagaacaagtggtatctgtccatcatctacaagcccatcgtcaaggaggagcacaagttcgaggaggacttggtgatgggcatcgacatggggaagatcaacgtcctctacttcgcgttcaacaagggctggatcaggggcgcgatctccggcgaggagatcgaggcgttccgcaagaagatcgagcaccgccggatcagcctcctgcgccagggcaagtactgctccgggaaccgggtgggcaagggccgcgagaagcggatcaagccgatcaacgtcctgaacaacaaggtggccaagttccgcaacgcgacgaaccacaagtacgcgaactacatcgtccagcagtgcctcaagtacaactgcggcacgatccagctcgaaaacctccagggcatctcgaaggagcagacgttcctcaagaactggacctacttcgacctccaggagaagataaagcagcaagctcaccagtacgggatcaaggtggtgaccatcgacccgtcctacaccagccagcggtgctcggagtgcggctacatccacaagaacaaccgccagagccagagcacgttcgagtgccagcgctgcaacctcaaggtgcacgccgactacaacgccgccaagaacatctccatctacaacatcgagaaggtcatccagaagcagctcaagctccaggagaagctcaacagcaagaagttcaccgagcagtacatcgagcagatcgagaacatcaactag

SEQ ID NO: 2502 - DNA, 1353 bp, Unknown
  Bacillus sp. multi
ctgagcaccgtggtgaaggtgatgaagtaccagatcgtgtgcccgctcaacctcgactggaagatgttcgagaagtacctccgcacgctctcctaccaagtccggaccatcgggaaccggacgatccagaagctctgggacttcgacaaccagtccctcaaccacttccgggagaacggggtgtaccccagcgcgaagcagctctacggctgcacccagaaaacgatcagcggctacatctacgaccagctcaaggaggagtaccaggacatcaacaaggccaacatgagcaccacgctccagaaaactatcaagacctggaactcgcgcaagaaggagatccggtcgggcgacatgagcatcccctccttccgcaacaacctccccatcgacatccacggcaactccatccagatcacgaaggagaagtcgggcgactacatcgcctcgctctcgctcttcagcagcaacttcatcaaggagaacaacctcccgaacggcaagatccaggtcaagctcagcacgcgcaagcagaacagcatgaaggtgatcctcgaccgcatcatcgagaacacctacgcgaagggcgcgtgcatcctgcacaagcacaagaacaagtggtacctgtccatcatctacaagcccatcgtcaaggaggagcacaagttcgaggaggacttagtgatgggcatcgacatgggcaagatcaacgtgctctacttcgcgttcaacaagggctggattcgcggcgcgatctccggcgaggagatcgaggcgttccgcaagaaaattgagcaccggcgcatctccctcctccgccagggcaagtattgctcgggcaaccgcgtggggaagggccgggagaagcgcatcaagccgatcaacgtgctgaacaacaaggtggcgaagttccgcaacgcgaccaaccacaagtacgccaactacatcgtccagcagtgcctcaagtacaactgcggcacgatccagctcgagaacctccagggcatctcgaaggagcagaccttcctcaagaactggacctacttcgacctccaggagaagatcaagcaacaggcgcaccagtacgggatcaaggtcgtgaccatcgaccccagctacaccagccagcgctgctcggagtgcgggtacatccacaagaacaaccggcagtcgcagagcacgttcgagtgccagcggtgcaacctcaaggtgcacgccgactacaacgccgccaagaacatcagcatctacaacatcgagaaggtcatccagaagcagctcaagctccaggagaagctgaactccaagaagttcacggagcagtacatcgagcagatcgagaacatcaactag

SEQ ID NO: 2503 - DNA, 1353 bp, Unknown
  Bacillus sp. multi
ctcagcaccgtggtgaaggtcatgaagtaccagatcgtgtgcccgctcaacctggactggaagatgttcgagaagtacctccggacgctctcctaccaggtgcggaccatcggcaaccgcaccatccagaagctctgggacttcgacaaccagtcgctcaaccacttccgcgagaacggcgtgtacccctccgccaagcagctctacggctgcacgcagaaaactatcagcgggtacatctacgaccagctcaaggaggagtaccaggacatcaacaaggccaacatgagcacgacgctccagaaaaccatcaagacctggaactcccgcaagaaggagatccggagcggggacatgagcatcccgagcttccgcaacaacctgcccatcgacatccacggcaactccatccagatcacgaaggagaagtccggcgactacatcgccagcctctcgctcttcagctccaacttcatcaaggagaacaacctgccgaacggcaagatccaggttaaactcagcacgcggaagcagaactccatgaaggtgatcctggaccgcatcatcgagaacacctacgcgaagggcgcgtgcatcctgcacaagcacaagaacaagtggtacttgtcgatcatctacaagcccatcgtgaaggaggagcacaagttcgaggaggatctcgtgatggggatcgacatgggcaagatcaacgtgctgtacttcgccttcaacaagggctggattcgtggcgcgatctccggcgaggagatcgaggcgttccgcaagaagattgagcaccggcgcatcagcctcctccgccaggggaagtactgctcgggcaaccgcgtcggcaaggggcgcgagaagcggatcaagccgatcaacgtcctgaacaacaaggtggcgaagttccgcaacgcgacgaaccacaagtacgccaactacatcgtgcagcagtgcctcaagtacaactgcggcaccatccagctcgagaacctccagggcatctcgaaggagcagacgttcctcaagaactggacgtacttcgacctccaggagaagattaagcagcaggcccaccagtacggcatcaaggtcgtcaccatcgaccccagctacacctcccagcgctgctcggagtgcggctacatccacaagaacaaccggcagtcgcagtccacgttcgagtgccagcgctgcaacctcaaggtccacgccgactacaacgcggccaagaacatcagcatctacaacatcgagaaggtcatccagaagcagctcaagctccaggagaagctcaactccaagaagttcacggagcagtacatcgagcagatcgagaacatcaactga

SEQ ID NO: 2504 - DNA, 1353 bp, Unknown
  Bacillus sp. multi
ctgagcaccgtggtgaaggtcatgaagtaccagatcgtgtgcccgctcaacctcgactggaagatgttcgagaagtacctgcggacgctctcctaccaagtccggaccatcgggaaccggaccatccagaagctctgggacttcgacaaccagtcgctcaaccacttccgggagaacggcgtgtacccgagcgcgaagcagctctacggctgcacccagaaaaccatcagcggctacatctacgaccagctcaaggaggagtaccaggacatcaacaaggccaacatgagcacgaccctccagaaaacgatcaagacgtggaactcccgcaagaaggagatccgctccggggacatgagcatcccgtccttccgcaacaacctccccatcgacatccacggcaacagcatccagatcacgaaggagaagtccggggactacatcgcctccctgagcctgttcagcagcaacttcatcaaggagaacaacctcccgaacggcaagatccaggtcaagctgagcacgcgcaagcagaactccatgaaggtgatcctcgaccggatcatcgagaacacctacgcgaagggcgcgtgcatcctccacaagcacaagaacaagtggtacctgagcatcatctacaagcccatcgtcaaggaggagcacaagttcgaggaagaccttgttatgggcatcgacatgggcaagatcaacgtgctctacttcgccttcaacaagggctggattcgtggcgcgatcagcggcgaggagatcgaggcgttccgcaagaagatcgagcaccgccgcatcagcctcctgcgccaggggaaatactgctcgggcaaccgggtggggaaggggcgggagaagcgcatcaagcccatcaacgtgctcaacaacaaggtggcgaagttccgcaacgccaccaaccacaagtacgcgaactacatcgtgcagcagtgcctcaagtacaactgcggcaccatccagttggagaacctccaggggatcagcaaggagcagacgttcctcaagaactggacgtacttcgacctccaggagaagatcaagcagcaagcgcaccagtacgggatcaaggtcgtcaccatcgacccctcctacaccagccagcgctgctccgagtgcggctacatccacaagaacaaccgccagtcgcagtccacgttcgagtgccagcgctgcaacctcaaggtgcacgccgactacaacgccgccaagaacatcagcatctacaacatcgagaaggtcatccagaagcagctcaagctccaggagaagctgaacagcaagaagttcaccgagcagtacatcgagcagatcgagaacatcaactag

SEQ ID NO: 2505 - DNA, 990 bp, Unknown
  Bacillus sp. multi
atgtcggtcctgattaagacctacctccacggctaccactccatcctctacaataagcgcaagacgagctacgaggtcgggcggggcaagccgatgagcaaccagcagctcgtcaacctccggatcgacttcgcgttcaagcagctcttcggcacgtcgggcaacgaggacatcctcatcgccttccttaacgccatactccaagacagccttgaatcccctatcgtctcccttcaattggaagacccgcatctccatcgggagcacgaggaggataagctatccatcctcgacatctcggcgaccctcgacaccggcacgaaggtcaacgtggagatccagctcaacaacaaccacgacatgattaagcggagcctctactactggggacgcctctacacgagccagcttcaaaaggggatgccctactccagcctgcacaagaccatcacgatcaacctgctgaacttcgtgatgttcccggagtacgaggcgttccacacaaccggcatcctctggaaccagcagcagcagaagaagctgagcgacgacatcgaggtccacatggtcgaaatccccaagctcatgcagcagtggaggaacgaacaagtgaatccgtgggaggactcgttcgtgcgctggctcctcctgctccctgctaacgaggacgagcagctcacgcagacgctggaggacatcgccatgaatcaggatcctatcctacagaaggccatcaacaagtgggagcggatgtcccaggactcgtcattccgacaggcgtacgaggcgcgggagaaggccctcatggacgaggcggcgaagttcgcctacgcggagcagaagggcatcgagaaggggatcgagaaggggatcgagcaaggaaagatccagctcatccgtggtatgcacaagaacgggatgccgatcaaggacatcgccaagttcaccaacctctccatcgaggagatccaggagatcctggagctgtga

SEQ ID NO: 2506 - DNA, 990 bp, Unknown
  Bacillus sp. multi
atgagcgtgctgattaagacgtacctccacggctaccactcgatcctctacaacaagcggaagacctcctacgaggtgggacgcggcaaaccgatgtccaaccagcagctcgtgaacctgcggattgacttcgccttcaagcagctcttcgggacgtccggcaacgaggacatcctcatcgccttcctcaacgccatattgcaagacagcctcgaaagcccgatagtcagccttcagctcgaagatccccacctccaccgcgagcacgaggaggacaagctctcgatcctggacatctccgcgaccctcgacacgggcacgaaggtgaatgtggagatacagctcaacaacaaccacgacatgattaagcgctcgctctactactggggccgactttacacctcccagctccagaagggtatgccctacagctcgctgcacaagaccatcaccatcaacctgctcaacttcgtgatgttcccggagtacgaggcgttccacaccaccggcatcctgtggaaccagcagcagcagaagaaactgagcgacgacatcgaggtgcacatggtcgagatccccaagctgatgcagcagtggcggaacgaacaagtcaacccgtgggaggactctttcgtgcggtggctcctcctccttcctgccaacgaggacgagcagttgacgcagaccctggaggacatcgccatgaatcaggatcctatcctccagaaggctatcaacaagtgggagcggatgagccaggacagttccttccgacaggcgtacgaggcgcgcgagaaggctctgatggacgaggcggccaagttcgcctacgccgagcagaaggggatcgagaagggcatcgagaaggggatcgaacagggcaagattcagctcatcaggggtatgcacaagaacgggatgcccatcaaggacattgccaaattcaccaacctcagcatcgaggagatccaggagatccttgaactgtga

SEQ ID NO: 2507 - DNA, 990 bp, Unknown
  Bacillus sp. multi
atgtccgtgcttatcaagacctacctccacggctaccactcaatcctgtacaacaagcggaagacctcctacgaggtgggccggggcaagcccatgtccaaccagcagctcgtaaacctccgcatcgacttcgccttcaagcagttattcggcacctccggcaacgaggacatcctgatcgcgttcctgaacgcaatcctccaggactcgctagaatcgcccatcgtctccctgcaacttgaagaccctcacctccatagggagcacgaggaggacaagctcagcatcctcgacatctccgctaccctcgacaccgggaccaaagtgaacgtggagatccagctcaacaacaaccacgacatgattaagcggtccctttactactggggccgtctctacacctcgcagctccagaaggggatgccctacagttccctgcacaagaccatcacgatcaacctcctcaacttcgtgatgttccccgagtacgaagcgttccacacgacgggcatcctctggaatcagcaacaacagaagaagctgtcggacgacatcgaggtccacatggtcgaaatcccgaagctcatgcagcagtggcgcaacgaacaagtgaacccctgggaggactccttcgtccgctggctcttgctcctgcccgcgaacgaggacgagcagctcacgcagaccctggaggacatcgccatgaaccaagatccgatcctccagaaggccatcaacaagtgggagcgcatgtcccaggacagctccttccgccaagcgtacgaggcgcgcgagaaggcgctcatggacgaggccgcgaagttcgcgtacgccgagcagaagggcattgagaaggggatcgagaagggcatcgagcaaggcaagatccaattgatacgtgggatgcacaagaacgggatgcccatcaaggacatcgccaagttcacgaacctcagcatcgaggagatccaggagatcctggagctgtag

SEQ ID NO: 2508 - DNA, 990 bp, Unknown
  Bacillus sp. multi
atgagcgtgctcatcaagacctacctgcacggctaccacagcatcctgtacaacaagcgcaagacatcctacgaggtcggccgtggcaaacctatgtccaaccagcaactcgtcaacctccgaatcgacttcgcgttcaagcaactcttcggcacctccggcaacgaggacatcctgatcgccttccttaacgcgatcctacaggacagcctggagtcgcccatcgtgtcgctccagcttgaagaccctcatctacaccgggagcacgaggaggacaagctcagcatcctcgacatctccgcgaccctcgacacgggcacgaaagtgaacgtcgagatccagctcaacaacaatcacgacatgattaagcgttccctctactactggggacgcctctatacctcgcagctccagaaggggatgccgtacagctcgctccacaagacgatcacgatcaacctgctgaacttcgtcatgttcccggagtacgaggctttccacacgaccggcatcctgtggaaccagcagcagcagaagaaactctccgacgacatcgaggtgcacatggtggagatcccgaagctgatgcagcagtggcgtaacgaacaagtgaacccctgggaggactccttcgtgcgttggctgctcctgctgcccgccaacgaggacgagcagctcacgcagacgcttgaggatatagctatgaaccaagacccgatcctccagaaggccatcaacaagtgggagcggatgtcccaggactccagtttccgccaggcgtacgaggcccgcgagaaggccctcatggacgaggctgcgaagttcgcctacgccgagcagaaggggatcgaaaagggcatcgagaaggggatcgaacaggggaagatccagctcatcagagggatgcacaagaacgggatgccgatcaaggacatcgccaagttcacgaacctcagcatcgaggagatccaggagatcctggaactgtga

SEQ ID NO: 2509 - DNA, 990 bp, Unknown
  Bacillus sp. multi
atgtccgtcctcatcaagacgtacctccacggctaccactccatcctctacaacaagcgcaagacgagctacgaggtcggtaggggaaagccgatgtcaaaccagcagctcgtgaacctccggatcgacttcgccttcaagcagctcttcggcacgtcggggaacgaggacatcctcatcgcgttcctcaacgccatcctccaagacagcttggagagccccatcgtctcgctccagttggaagacccacatctccaccgggaacacgaggaggacaagctcagcatactggacatcagcgccaccctggacaccggcacgaaggtgaacgtggagatccagctcaacaacaaccacgacatgattaagcgcagcctgtactactggggccgcctctacacctctcagctccagaaggggatgccctacagctcgctccacaagaccatcacgatcaacctcctcaacttcgtgatgttccccgagtacgaggctttccacacgaccggcatcctgtggaaccagcagcagcagaagaagctctcagacgatattgaggtgcacatggtggagatccctaagctgatgcagcagtggcggaacgagcaagtgaacccgtgggaggacagtttcgtccgctggctgctcctcctccccgcgaacgaggacgagcagttgacgcagacgctggaggacatcgccatgaaccaagatccgatcctccagaaggcgatcaacaagtgggaacggatgagtcaagacagcagcttccgccaggcttacgaggcgcgcgagaaggccctgatggacgaggcggccaagttcgcctacgccgagcagaagggcatcgagaagggcatcgagaaggggatcgagcaaggcaagatccagttaattcgcggaatgcacaagaatggtatgccgatcaaggacatcgccaagttcacgaacctgtcaatcgaggagatccaggagatccttgagctgtga

SEQ ID NO: 2510 - DNA, 996 bp, Unknown
  Bacillus sp. multi
atgtacggctcgaaacaagcgctgatgtccactgacattcgggcgtgcctccacatggaccacagcttcatgtacaacgagcgcaagacgtcctacgagatggggcgcgggaagccgatgtccaatcagcagctcgtcaacctccgcatcgacttcgccttcaagcagctcttcgggacgagcggcaacgaggacatcctcatcgccttcctgaacgccatgctgcaagactccctggagtcgcctatcgcctcgctccaactcgaagacccacacctccaccgggagcacgaggaggataagctgtccatcctcgacatctccgccaccctcgacaccggcacgaaggtcaacgtcgagatccagcttaacaacaaccacgacatgattaagcgttcgctctactactggggccgcctctacacctctcagctccagaagggaatgccttattcctcacttcacaagactatcaccatcaacctgctcaacttcgtgatcttcccagaatacgaggcgttccacacgaccggcatcctgtggaaccagcagcagcagaccatcctgtcttcggacatcgaggtccacatcgtcgagatccccaaacttatgcagcagtggcgaaacgaacaagtcaacccgtgggaggacagcttcgtgcgctggctcctcctgctgcccgccaacgaggacgagcagctcacgcaaaccctggaagacatcgccatgaaccaagatccaatcttacagaaggctatgaacaaatgggagcgcatgtcccaggactcgtcctttcggcaagcgtacgaggcacgcgagaaggcgctgatggacgaggcggccaagttcgcgcacgcgcggaatgagggcatccaggaggggaaaatccagatgattaaggggatgcacgaactcggggtgcctatcgagacaattgcgaaggccagcaagttgtctattgaggaggtgcagcacatcctttcacggaactcgtga

SEQ ID NO: 2511 - DNA, 996 bp, Unknown
  Bacillus sp. multi
atgtacgggtccaagcaagctcttatgtccacggacatccgcgcgtgcctgcacatggaccactcgttcatgtacaacgaacgcaagacgtcatacgagatgggtcggggcaaaccgatgagcaaccagcagctcgtcaacctccggatcgacttcgccttcaagcagctcttcggcaccagcggcaacgaggacatcctgatcgccttcctcaacgcgatgttgcaagactctctggagtctccaatcgcctcccttcaactggaagacccgcacctccaccgcgagcacgaggaggacaagctgtccatcctcgacatctcggcgaccctggacaccggcacgaaggtgaacgtcgagatccagctcaacaacaaccacgacatgattaagcgcagcctctactactggggtcgtctatacacaagccagctccagaagggtatgccctactccagcctgcacaagacgatcacgatcaacctcctcaacttcgtgatcttcccagagtacgaagcgttccacacgaccggcatcctctggaatcagcagcagcagacgatcctgtccagcgacatcgaggtgcacatcgtggagatccccaagttgatgcagcagtggcggaacgaacaagtcaacccgtgggaggactcgttcgtgcggtggctgctcctgcttccggcgaacgaggacgagcagctcacgcagacgctggaggatattgccatgaaccaagatcccatacttcaaaaggctatgaacaagtgggagcggatgagccaagactcgtcgtttcgccaagcctatgaggcgcgggaaaaggccctcatggacgaggcggcgaagttcgcccacgcccggaacgaggggatacaggagggcaagatccagatgattaagggtatgcacgaattgggcgtgccgattgagacaatagccaaagcgtcgaagctcagcatcgaggaggtccagcacatactcagccggaactcgtag

SEQ ID NO: 2512 - DNA, 996 bp, Unknown
  Bacillus sp. multi
atgtacgggtccaaacaagccctaatgtccaccgacatccgggcctgcttacacatggaccacagcttcatgtacaacgagcgcaagacgtcctacgagatggggcggggcaagccgatgtcgaaccagcagctcgtcaacctgcggatcgacttcgcgttcaaacagctcttcggcacgtcgggcaacgaggacatcctgatcgcgttcttgaacgccatgctccaggactccctggagtctcccatcgcgtcgctacagcttgaagacccgcacttgcaccgcgagcacgaggaggacaagctctcgatcctggacatcagcgccacgctcgacaccgggacaaaagtcaacgtggagatccagctcaacaacaaccacgacatgattaagcgcagcctgtactactggggccgcctctacaccagccagctccagaagggtatgccctactcctcactgcacaagacaatcaccatcaacctcctaaacttcgtgatcttccctgagtacgaagcgttccacaccacgggcattctgtggaatcagcagcagcagaccatcctcagcagcgacatcgaagtgcacatcgtcgagatcccgaagctgatgcagcagtggcggaacgagcaagtcaatccctgggaggactcgttcgtgcggtggctgttgctcctccccgccaacgaggacgagcagctcacgcagacattggaagacattgcgatgaaccaagatccaatcctccaaaaggcgatgaacaaatgggagcgaatgtcgcaagacagctcctttcgccaggcgtacgaggcccgcgaaaaggccctcatggacgaggcggcaaagttcgcgcacgcgcgtaacgagggtattcaagaggggaagatccaaatgattaaggggatgcacgagctgggcgtgccgatagagacaatagcaaaggcgtccaagctgtccatcgaggaggtccagcacatactgagccgcaactcctga

SEQ ID NO: 2513 - DNA, 996 bp, Unknown
  Bacillus sp. multi
atgtacggctcgaaacaggcgctgatgtcaactgacatccgcgcgtgcctccacatggaccactccttcatgtacaacgagcggaagacgtcctatgagatggggcggggcaagccgatgagcaatcagcagctcgtcaacctccgcatcgacttcgcgttcaagcagctcttcgggacgtccgggaacgaggacatcctcatcgccttcctcaacgccatgctacaagattcgctggagagccccatcgcctccctccagttggaagatccccaccttcaccgtgagcacgaggaggacaagttgtcgatcctggacatctccgcgacactcgacacgggcacaaaagtcaacgtcgagatccagctcaacaacaaccacgacatgattaagcgctccctctactactggggacggctttacaccagccaattgcaaaaggggatgccgtactcctccctccacaagaccatcacgatcaacctcctcaacttcgtgatcttcccggaatacgaggcgttccatacgacgggcatcctgtggaaccagcagcagcagaccatcctgtcgagcgacatcgaggtgcacatcgtcgaaatccccaaactgatgcaacagtggcgcaacgaacaagtcaatccgtgggaggactccttcgtgcgctggctcctcctgctgcccgccaacgaggacgagcagctcacgcaaaccctggaggacatcgccatgaaccaagatcctatcctccagaaggctatgaacaagtgggagcgcatgtcccaggactcgtccttccgacaagcgtatgaggcccgtgagaaggccctgatggacgaggctgccaagttcgcccacgcgcggaacgagggtatccaggagggaaagatacagatgattaaggggatgcacgagttgggcgtccccatcgaaaccatcgcaaaggctagtaagctctcgattgaggaggtccagcacatcctctctaggaactcctag

SEQ ID NO: 2514 - DNA, 996 bp, Unknown
  Bacillus sp. multi
atgtacggctccaagcaagccctcatgtccaccgacatccgcgcctgcctccacatggaccacagcttcatgtacaacgagcggaagacatcttacgagatgggccggggcaagccgatgtcgaaccagcagctcgtcaacctccggatcgacttcgccttcaagcagctcttcgggacgtcgggcaacgaggacatcctgatcgcattcctcaacgcgatgcttcaagacagcctggagagccctattgccagcctccaactcgaagatccacacctccaccgcgagcacgaggaggacaagctgtccatcttggacatctcggcgacgctcgacaccgggacgaaggtgaacgtggagatccagcttaacaacaaccacgacatgattaagcggtcgctgtactactggggccgtctctacacctcccagctccagaaggggatgccctacagctccctccacaagaccatcacgatcaacctactgaacttcgtgatcttcccggagtacgaggcgttccacacgaccggcatactgtggaaccagcaacaacaaacgatcctgtcctcggacatcgaggtgcacatcgtcgaaattcccaagctgatgcaacagtggcgaaacgaacaagtcaacccgtgggaggactccttcgtgcgctggctcctcctcttacccgcaaacgaggacgagcagcttactcaaaccctcgaagatatagctatgaaccaagacccaatcctccagaaggccatgaacaagtgggagcgcatgagccaggacagctcctttcgtcaggcgtatgaagcgcgggagaaggccctcatggacgaggccgcgaagttcgcccacgcccgcaacgagggcatacaggaggggaagatccagatgattaaggggatgcacgagctgggagtccctatcgagacaatagcaaaggccagtaagctctccatcgaggaggtgcagcacatcctgtcgcggaactcgtga

SEQ ID NO: 2515 - DNA, 996 bp, Bacillus thuringiensis
atgtacgggtccaaacaggccctcatgtccaccgacatccgggcctgcctgcacatggaccactcgttcatgtacaacgagcggaagacgtcctacgagatgggtcgcgggaaaccgatgagcaaccagcagctcgtgaacctccgcatcgacttcgccttcaagcagctcttcggcacatccggcaatgaggacatcctgatcgcattcctgaacgccatgctacaggactccctggagtcccctatcgcgtcgcttcagttggaagatccacatctccaccgggagcacgaggaggacaaactctccatcctggacattagcgcgaccctggacaccggcacgaaggtcaacgtggagatccagctcaacaacaaccacgacatgattaagcgctccctctactattggggacgcctctatacttcacaactccaaaagggaatgccttactcgtccctccacaagaccatcaccatcaacctcctaaacttcgtcatcttcccggagtacgaggcgttccataccacgggcatcctctggaaccagcagcagcagaccatcctgtcgagcgacatcgaggtgcacatcgtggagatccccaagctcatgcagcagtggcgcaacgaacaagtcaacccgtgggaggactcgttcgtccgttggctcctgctgttgcccgcgaacgaggacgagcagcttacgcagacgctggaggacattgcgatgaaccaagacccaatcctccagaaggccatgaacaagtgggagcgaatgtcccaggactcgtccttccgccaggcgtacgaggcgcgcgagaaggctctgatggacgaggcggccaagttcgcgcacgcgcgcaacgagggcatacaggagggcaagatacagatgattaagggaatgtacgagctgggcgtgcccatcgagacaattgccaaagcgagcaaactgtccattgaggaggtggaactaatcctcaagggcaactcatga

SEQ ID NO: 2516 - DNA, 996 bp, Bacillus thuringiensis
atgtacgggtccaaacaggccctgatgtccacggacatccgggcgtgcctgcacatggaccacagcttcatgtacaacgagcgtaagacgtcctacgagatgggccggggcaagccgatgtcgaaccagcaactcgtcaacctccggatcgacttcgcgttcaagcagctcttcggcacgtcgggcaacgaggacatcctcatcgctttcctcaatgctatgcttcaagattccctggaaagcccgattgccagcttgcaactcgaagacccgcatcttcaccgagaacacgaggaggacaaactgtcaatcctcgacatatccgcgaccctcgacacggggacgaaggtcaacgtggagatccagctcaacaataaccacgacatgattaagaggtcgctctactactggggcagactctacacgagccagctccaaaaggggatgccgtacagctccctccacaagaccatcaccatcaacctcctgaatttcgtcatcttccccgagtacgaggcgttccacacgaccggcatcctctggaaccagcagcagcagactatcctatcctccgacattgaggtgcacatcgtggagatcccgaagctcatgcagcagtggcgcaacgaacaagtgaatccgtgggaggactccttcgtgcggtggctcctcctgctccctgccaacgaggacgagcagcttacccagactctcgaagacattgccatgaaccaagaccccatccttcaaaaggccatgaacaagtgggagcgcatgtcccaggactcctccttccgccaggcgtacgaggcacgcgagaaggccctgatggacgaggcggcgaagttcgcgcacgcccggaacgagggcatccaggaggggaagatccagatgattaaggggatgtacgagctgggcgtgcccatcgagaccattgccaaagctagtaagctctctatcgaggaggtcgagctgatcctcaaggggaactcctga

SEQ ID NO: 2517 - DNA, 996 bp, Bacillus thuringiensis
atgtacggctccaaacaggccctcatgtccacagacatccgagcgtgcctgcacatggaccacagcttcatgtacaacgagcggaagaccagctacgagatggggcggggcaaaccgatgtccaaccagcaactcgtgaacctgcggatcgacttcgcgttcaagcagttgttcggaacctctggcaacgaggacatcctgattgccttcctcaacgccatgcttcaagacagcctggagtcgccaatcgcctccctacagcttgaagatccgcatctgcaccgggagcacgaggaggacaagctgtcgatcctcgacatcagcgccacgctcgacacggggacgaaggtgaacgtcgagatccaactcaacaacaaccacgacatgattaagcgctcgctctactactggggccgactctacacgagccagctccagaagggaatgccgtactcgtccctccacaagacgatcaccatcaacttgctgaacttcgtcatattccctgagtacgaggcgttccacaccaccggcattctctggaaccagcagcagcagacgatcctcagctcggacattgaggtccacatcgttgagatcccgaagctcatgcagcagtggaggaacgaacaagtcaatccctgggaggactccttcgtgcgctggctgctcctgctgcccgccaacgaggacgagcagctcacgcagaccctggaggacatcgccatgaaccaagacccgatcctccagaaggcgatgaacaagtgggagcgcatgtcccaggacagcagtttccgccaagcgtatgaagcgcgggagaaggccctcatggacgaggccgcaaagttcgcgcacgcccgcaatgagggcatccaagagggcaagatccagatgattaaggggatgtacgaactgggcgtacctatcgagaccatcgcaaaggcaagtaagttgtccattgaggaggtcgagcttatcctcaaggggaactcctga

SEQ ID NO: 2518 - DNA, 996 bp, Bacillus thuringiensis
atgtacggctcgaagcaagcgcttatgagcaccgacatccgcgcctgcctgcacatggaccactccttcatgtacaacgagcggaagaccagctacgagatgggacgcggcaagccgatgtccaaccagcagctcgtcaacctccgcatcgacttcgccttcaagcaattgttcggcaccagcggcaacgaggacatcctgatcgccttcctgaacgcgatgctccaggacagcctggagagtccgattgcctcccttcagttggaagatccgcacctccacagggagcacgaggaggacaagctcagcatcctggacatatccgccaccctcgacacaggcacaaaagtgaatgtcgagatccaactcaacaacaaccacgacatgattaagcggtccctgtactactggggccgcctatacacgagccagcttcagaaggggatgccctactcgtcgttgcacaagacaatcaccatcaacctcctgaacttcgtcatcttcccggagtacgaggcgttccacacgaccggcatcctgtggaaccagcagcagcagacgatcctgtccagcgacatcgaggtgcacatcgtggagataccaaagttgatgcagcagtggcgaaacgaacaagtcaacccgtgggaggactccttcgtccggtggctcctcttgcttccggccaacgaggacgagcagctcacgcagaccctggaagatattgcgatgaaccaagatccaatcttgcagaaggccatgaacaaatgggagcgcatgtcacaggactccagcttccggcaagcgtacgaggctagggaaaaggccctgatggacgaggccgcgaagttcgcccacgcccgcaacgagggcatacaggagggcaagatccagatgattaaggggatgtacgaacttggcgtgccaatcgagaccatagccaaagcctccaagctgagcatcgaggaggtcgagctgatcctcaaggggaacagctag

SEQ ID NO: 2519 - DNA, 996 bp, Bacillus thuringiensis
atgtacggctccaaacaagctctcatgtccacggacatccgcgcgtgcctccacatggaccactccttcatgtacaacgagcggaagacgtcgtacgagatggggcggggcaagcccatgtccaaccagcagctcgtcaacctccggatcgactttgccttcaagcagctcttcggcacgagcggcaacgaggacatcctcatcgccttcctgaacgccatgctccaggactccctggagtcgcccatcgcctctctacaactggaagaccctcatctccaccgcgagcacgaggaggacaagctctcgatcttagacatctcggctacgctggacaccggcacgaaggttaatgtcgagatccagctcaacaataaccacgacatgattaagcggtccctctactactggggccgcctctacacgagccagttgcagaaggggatgccttactcctccctccacaagaccattacgatcaacctcctgaacttcgtcatcttccccgagtacgaggcgttccacaccacgggcatcctgtggaaccagcagcagcagacgatcctcagctccgacatcgaagtccacatcgtcgaaatcccgaagctaatgcagcagtggcgcaacgagcaagtcaatccctgggaggacagcttcgtccgctggctcctcctgctcccggcgaacgaggacgagcagctcacgcaaacgctcgaagacattgcgatgaaccaagaccccatcttgcaaaaggcgatgaacaagtgggagcgcatgagccaggacagcagcttcagacaagcgtatgaggcccgcgagaaggcgctgatggacgaggccgccaagttcgcgcacgcccgcaacgagggcatccaggaggggaaaatccagatgattaaggggatgtacgagttgggcgtaccaattgagacgattgccaaagccagcaagctgtctatcgaggaggtggagctgatcttgaaagggaactcgtga

SEQ ID NO: 2520 - DNA, 1521 bp, Bacillus megaterium
atgagcacgccgctccagcagccccaccagaagtccaagaaaacttcgcagatgattaccacgcgcaagttcaagctggcgatagtctccgacaaccggaacgaggcgtactccttcatccggaacgagatccgcaaccagaacaaggcgctgaacgccgcctacaaccacctgtacttcgagcacatcgccaccgagaagctaaagcactccgacgaggagtaccagaagcacctcaccaagtaccgcgaggtcagcacgaacaagtaccaggactacctcaaggtgaaggagaaggtgaacgcctcgaaggacgacgagaagctacagaagcgcgtggacaaggcgcgggaggcgtacaacaaggcccaggagaaggtgtacaagatcgagaaggagttcaacaaaaaatctatggagacgtaccagaaggtcgtcggcctctcgaagcagacccgcatcggcaagctgctcaagtcccagttcacgctccactacgacaccgaggaccggatcacctccaccgtcctgagccacttcaacaacgacatgaagaccggcgtgctccggggcgaccgcagcctccggacctacaagaactcgcacccgctgctggtcagggcccgcagcatgaaggtgtacgaggagaacggcgactacttcatcaagtgggtcaagggcatcgtgttcaagatcgtcatctcagccgggtcgaagcagaaggcgaacatcggcgagcttaaatccgtcctcatcaatatcctcaacggccactacaaggtgtgcgacagcagcatcagcctgaacaaggatctaatcctgaacctctccctgaacatcccggtgagcaaggagaacgtcttcgtgccgggccgggtcgtgggcgtggacctcggcctcaagatccccgcgtacgtctcgctcaacgacacgccgtacatcaagaaaggaattgggaacatcgacgacttcctgaacgtccgcacgcagctccagaaccagcggaagcgcctccagaaaaccctggagtgcacgtccggcggcaagggccggagcaaaaaactcaagggcctggaccgcctcaaggcgaaggagaagaatttcgtcaacacctacaaccacttcctctccaaaaagatcatacagttcgcggtcaagaacaacgccggggtcatccacctggaggaactacagtttgacaagctcaagaacaagagcctcctccgcaactggtcgtactaccagctccagacgatgatcgagtacaaggccgagcgcgagggcatcgaggtcaagtacgtggatgcctcctacacgagccagacgtgctcgaagtgcgggcactacgagaagggtcagcgcgtgctccaggacaccttcacttgcaagaacaaggagtgcaaggggtacgcccacaaggtcaacgcggacttcaacgcctcccagaacatcgccaagtccaccgacatcattcgctgcaccgagatggccaagaacaacgacatcgagaagaatgcctag

SEQ ID NO: 2521 - DNA, 1521 bp, Bacillus megaterium
atgtccacgccgctccagcagccgcaccagaagtccaagaaaacgagccagatgattaccacccggaagttcaagctggccatcgtgagcgacaaccggaacgaggcgtacagcttcatccgcaacgagatccggaaccagaacaaggcgctgaacgcggcctacaaccacctctacttcgagcacatcgccacggagaagctcaagcactccgacgaggagtaccagaagcacctgaccaagtaccgggaggtgagcaccaacaagtaccaggactacctcaaggtgaaggagaaggtcaacgcgagcaaggacgacgagaagttacagaagcgggtggacaaggcgcgggaggcgtacaacaaggcccaggagaaggtgtacaagatcgagaaggagttcaacaagaaatctatggagacgtaccagaaggtcgtcggcctcagcaagcagacccgcatcggcaagctcctcaagtcccagttcacgctccactacgacaccgaggaccgcatcacgtccaccgtcctctcgcacttcaacaacgacatgaagaccggcgtgctgcggggcgaccgctccctgcggacctacaagaacagccacccgttgctcgtccgggcccgctcgatgaaggtgtacgaggagaacggcgactacttcatcaagtgggtgaagggcatcgtgttcaagatcgtgatctcggcgggctcgaagcagaaggccaacatcggcgaacttaaatcggtgctcatcaacatcctcaacggccactacaaggtgtgcgacagcagcatctcgctgaacaaggacttgatcctcaacctgtccctgaacatcccggtgagcaaggagaacgtcttcgtccccggccgcgtggtcggcgtcgatctgggcctaaagatccccgcctacgtctccctgaacgacactccctacattaagaaggggatcggcaacatcgacgacttcctcaacgtgcggacccagctccagaaccagcgcaagcgcctccaaaaaaccctggagtgcacgtcgggcggcaagggccgctccaagaagctcaagggcctcgaccgcctcaaggcgaaggaaaaaaatttcgtgaatacttacaaccacttcctgagcaagaagatcatacagttcgccgtcaagaacaacgcgggcgtaatccacctggaggaactccaatttgacaagctcaagaacaagtccctgctgcggaactggtcctactaccagctccagaccatgatcgagtacaaggccgagcgcgaggggatcgaggtgaagtacgtggacgccagctatacctcccagacgtgctcgaagtgcgggcactacgagaagggccagcgcgtgctccaggataccttcacgtgcaagaacaaggagtgcaaggggtacgcccacaaggtgaacgcggacttcaacgcgagccagaacatcgccaagagcacggacatcatccgctgcaccgagatggccaagaacaacgacatcgagaagaatgcctga

SEQ ID NO: 2522 - DNA, 1521 bp, Bacillus megaterium
atgtccacgccgttgcaacagccgcaccagaagtccaaaaagacgtcccagatgataacgacccgcaagttcaagctggccatcgtcagcgacaaccggaacgaggcgtactccttcatccggaacgagatccgcaaccagaacaaggcgctcaacgcggcgtacaaccacctctacttcgagcacatcgccaccgagaagctcaagcacagcgacgaggagtaccagaagcacctcacgaagtaccgcgaggtgtccaccaacaagtaccaggactacctcaaggtgaaggagaaggtcaacgcctcgaaggacgacgagaagctccagaagcgcgtggacaaggcgcgcgaggcgtacaacaaggcccaggagaaggtgtacaagatcgagaaggagttcaacaagaaatctatggagacgtaccagaaggtcgtcggcctgagcaagcagacccggatcggcaagctgctcaagtcgcagttcacgctccactacgacacggaggaccgcatcacgtccacggtgctgtcccacttcaacaacgacatgaagaccggcgtgctgcgcggagaccgctcgctgcggacctacaagaacagccacccgctgctggtccgcgcccggtcgatgaaggtgtacgaggagaacggcgactacttcatcaagtgggtcaagggcatcgtcttcaagatcgtaatcagtgctgggtcgaagcagaaggccaacatcggcgagcttaagtcagtcctgattaacatcctgaacggccactacaaggtgtgcgactccagcatctccctgaacaaggacttgatccttaacctctcgctgaacatccccgtgagcaaggagaacgtcttcgtgccgggccgggtggtcggcgtggacctggggctcaagatcccggcctacgtctcgctgaacgacacgccgtacatcaaaaaagggattggcaacatcgacgacttcctcaacgtccgcacccagctccagaaccagcggaagcggctccagaaaactcttgagtgcacgtccggcggcaaggggcggtccaagaaactcaagggcctcgaccgcctcaaggcgaaggagaagaatttcgtaaacacctacaaccacttcctgagcaagaaaatcattcagttcgcggtcaaaaacaatgccggggtgatccacctggaggagctgcaattcgacaagctcaagaacaagagcctcctccgcaattggagttactaccagctccagacgatgatcgagtacaaggccgagcgggagggcatcgaggtgaagtacgtggacgcctcctacacctcccagacgtgctcgaagtgcgggcactacgagaaggggcagcgcgtgctccaggacaccttcacgtgcaagaacaaggagtgcaaggggtacgcgcacaaggtcaacgccgacttcaacgccagccagaacatcgccaagagcaccgacatcatccggtgtaccgagatggccaagaacaacgacatcgagaagaacgcctga

SEQ ID NO: 2523 - DNA, 1521 bp, Bacillus megaterium
atgagcacgccgctccagcagccccaccagaagtccaagaagaccagccagatgataaccacccgcaagttcaagctggccatcgtgagcgacaaccgcaacgaagcctactccttcatccgcaacgagatccgcaaccagaacaaggccctgaacgcggcctacaaccacctgtacttcgagcacatcgccaccgagaagctcaagcactccgacgaggagtaccagaagcacctcaccaagtaccgggaggtgtccacgaacaagtaccaggactacctcaaggtgaaggagaaggtgaacgccagcaaggacgacgagaagctccagaaacgcgttgacaaggcccgcgaggcgtacaacaaggcccaggagaaggtgtacaagatcgagaaggagttcaacaagaaatctatggagacgtaccagaaggtcgtgggcctctcgaagcagacgcggatcgggaagctcctcaagtcgcagttcaccctccactacgacaccgaggaccgcatcacgtccaccgtcctgagccacttcaacaacgacatgaagacgggcgtccttcgaggagaccgcagccttcgcacgtacaagaacagccatcctctgttggtgcgggcgcggtccatgaaggtctatgaggagaacggcgactacttcatcaagtgggtgaaggggatcgtcttcaagatcgtcatctcggctgggtccaagcagaaggccaacatcggcgagctgaagtcggtgctgataaacatcctgaacgggcactacaaggtctgcgactctagcatctccctcaacaaagacctaattctgaacctcagcctgaacatcccggtgtcgaaggagaatgtgttcgtgccggggcgggtcgtcggggtggacctcgggttgaaaatccccgcctacgtcagcctcaacgacaccccgtacatcaaaaagggaattgggaacatcgacgacttcctgaacgtccgcacccagctccagaaccagcgcaagcgcctccagaagactctggagtgcacctccggcggcaaggggcggtccaaaaagctcaaggggctggaccggctcaaggcgaaggagaagaactttgtgaacacctacaaccacttcctcagcaagaaaattatccagttcgccgtcaagaacaacgccggagtcatccacctggaggaacttcagttcgacaagctcaagaacaagtcgctcctgcggaactggtcgtactaccagcttcagaccatgatcgagtacaaggccgagcgggagggcatcgaggtgaagtacgtggacgcctcctacacgagccagacgtgcagcaagtgcgggcactacgagaaggggcagcgcgtgctccaggacaccttcacgtgcaagaacaaggagtgcaaggggtacgcgcacaaggtgaacgccgacttcaacgccagccagaacatcgccaagtcaaccgacatcatccgatgcacggagatggccaagaacaacgacatcgagaagaacgcctga

SEQ ID NO: 2524 - DNA, 1521 bp, Bacillus megaterium
atgtccacgccgctccagcagccgcaccagaagtccaagaagaccagccagatgattacaacgcgcaagttcaagctcgccatcgtctcggacaaccggaacgaggcgtacagcttcatccggaacgagatccggaaccagaacaaggccctcaacgcggcgtacaaccacctctacttcgagcacatcgccaccgagaagctcaagcacagcgacgaggagtaccagaagcacctcaccaagtaccgcgaggtcagcaccaacaagtaccaggactacctcaaggtcaaggagaaggtgaacgcctcgaaggacgacgagaagctccagaagcgcgtggacaaggcgcgcgaggcgtacaacaaggcccaggagaaggtgtacaagatcgagaaggagttcaacaagaaatctatggaaacgtaccagaaggtcgtggggctctcgaagcagacccgcatcggcaagctgctcaagtcccagttcaccctccactacgacaccgaggaccgcatcacgagcaccgtcctcagccacttcaacaacgacatgaagaccggcgtcctgcgcggcgaccgctccctccggacgtacaagaacagccacccgctgctggtgcgcgcccggtccatgaaggtgtacgaggagaacggcgactacttcatcaagtgggtgaaggggatcgtgttcaagatcgtcatcagcgccggttcgaagcagaaggccaacatcggggagttgaaatcagtgctcatcaacatcctcaacgggcactacaaggtctgcgactcctccatcagcctgaacaaagacctcatactcaacctctccctcaacatcccggtgtctaaggagaacgtcttcgtccccggccgtgtggtcggggtggacctgggcctcaagatccccgcgtacgtctccctcaacgacaccccgtacattaagaaaggcatcggcaacattgacgacttcctgaacgtgcggacccagctccagaaccagcgtaagcggctccagaaaacactggagtgcacgtccggcggcaaggggcgcagcaagaagctcaagggcctggaccggctcaaggcgaaggagaagaatttcgtgaacacctacaaccacttcctgagcaagaaaattatccaattcgccgtcaagaacaacgcgggcgtgatccacctggaggagctacagtttgacaagctcaagaacaagtccctgctccgcaactggtcctactaccagctccagacgatgatcgagtacaaggcggagcgcgaggggatcgaggtcaagtacgtggacgcctcctacacctcgcagacgtgctcgaagtgcgggcactacgagaaggggcagcgcgtgctgcaagatacctttacgtgcaagaataaggaatgcaagggctacgcgcacaaggtgaacgcggacttcaacgcctcgcagaacatcgccaagagcacggacatcatccgctgcacggagatggccaagaacaacgacatcgaaaaaaacgcctag

SEQ ID NO: 2525 - DNA, 1491 bp, Unknown
  Bacillus sp. multi
gtgatcctcacccggaaggtcaagctcgtgatcgtctccgacaaccgcgacgagggctacaagctcatccgcaacgagatccgggagcagcacaaggcgctcaacctggcctacaaccacctctacttcgagcacaacgccatccagatcctcaagcagaacgacgaggactacaagcagaagcgcaacaagctccaggaacttattaacaagaaatatgaagaacaccagaaggccaagaacctggagcgcaaggaggccctccgcgaggcgtacaacaacaagaagcaagagctgtacaagttcgagcgcgagtgcaacgaggaggcccgcaaggcgtatcagcaagtagtgggcttcacccagcagacgcgggtgcggaacctcatcaaccgggagtacaacctcatgtccgacacgaaggacgggatcacctcgaaggtgacccaggactacaagaacgactgcaaggcgggcctgctcatcggcaagcggtcgctgcgtaactacaagaaggataaccccttactggtacgcggccggtccctcaagttctacaaggaggacggcgactacttcatcaagtggaacaagggcaccgtgttcaagtgcatcctgcacatccgcaaaaagaacgtggcggagcttcagtccgtgctggaaaacgtgctgctcggagcttacaagatatgcgactcctccattggcttcaacaacaaggacatgatcctcaacctctcgctcaacatccccgacaaggagacctacgactacatccctggtcgtgtggtgggcgtggacctggggctgaagattccggcgtacgtctccctctccgacaaggtgtacgtgcggaaggggatcggcggcatcgacgacttcctgcgggtgcggacgcagatgcagaagcggagacggcaactccaagagtccctcgcggcggtcaagggcggcaaggggcgggagaagaaactcaaggcgctggaccacctcaagggcaaggaggccaacttcgccaagacgtacaaccacttcctcagcacccagatcgtcacgttcgccgtcaagaaccaggcgggccagatcaacatggagttcctagagttcgacaagatgaagaataagtcgctcctccggaactggtcctactaccagttgcaaatgatggtggagtacaaggcgaagcgggagggcatcatcatcaagtacgtggacgcctacctgaccagccagacgtgctcgaagtgcgactactacgaggagggccagcgcgagaagcaggagaaattcatctgcaagagctgcgcgttcgaggtgaacgcggactacaacgcctcgcagaacatcgctaagagcgcccggtacatctcggactcgaccgagcgggagtaccacaagaagaaacaagaagacttgaaggaaattctgggcgagaacgacatcatcaacgagcagctctccctgttcgacaaccacgacgacatcgcgtga

SEQ ID NO: 2526 - DNA, 1491 bp, Unknown
  Bacillus sp. multi
gtcatcctcacgcggaaggtgaagctggtgatcgtgtccgacaaccgggacgaggggtacaagctgatccggaacgagatccgggagcagcacaaggcgctgaacctcgcgtacaaccacctctacttcgagcacaacgcgatccagatcctcaagcagaacgacgaggactacaagcagaagcggaacaagctccaggaactcatcaacaaaaagtacgaggagcaccagaaggccaagaacctggagcggaaggaggcgctccgcgaggcgtacaacaacaaaaagcaagaactatacaagttcgagcgggagtgcaacgaggaagcacgaaaagcctatcaacaagttgtgggcttcacccagcagacgcgagtccgcaacctgattaaccgggagtacaacctcatgagcgacacgaaggacgggatcacgagcaaggtcacccaggactacaagaacgactgcaaggccgggctgctgatcggcaagcgcagcctccgcaactacaagaaagacaatccgctgctcgtgcggggccggtccctcaagttctacaaggaggacggggactacttcatcaagtggaacaagggcaccgtgttcaagtgcatcctgcacatccgcaagaaaaatgtggcggagctacaaagcgtcctggagaacgtcctgctcggcgcgtacaagatatgcgactccagcatcggcttcaacaacaaggacatgatcctcaacctgtccctgaacatcccggacaaggagacgtacgactacatacctggccgggtcgtgggcgtggacctcggcctcaagatccccgcctacgtcagcctctccgacaaggtgtacgtccgcaaggggatcggcgggatcgacgacttcctccgcgtccgcacgcagatgcagaagcggaggcggcagctccaagagtccctcgccgccgtgaagggcgggaagggccgcgaaaaaaagctcaaggcgctcgaccacctcaaggggaaggaggccaacttcgccaagacgtacaaccacttcctctcgacccagatcgtgaccttcgccgtcaagaaccaggccgggcagatcaacatggagttcctggagttcgacaagatgaagaacaaatccctcctccgcaactggagctactaccaacttcagatgatggtggagtacaaggccaagcgcgaggggatcatcatcaagtacgtggacgcctacctgacgtcccagacctgctccaagtgcgactactacgaggagggccagcgcgagaaacaggagaaattcatctgcaagtcctgcgccttcgaggtcaacgcggactacaacgcctcgcagaacatcgccaagtcggcccgctacatctcggactccaccgagcgcgagtaccacaagaagaaacaagaagacctcaaggagattctgggcgagaacgacatcatcaacgagcaactgtcgctgttcgacaaccacgacgacatcgcgtag

SEQ ID NO: 2527 - DNA, 1491 bp, Unknown
  Bacillus sp. multi
gtgatcctgacccgcaaggtcaagctggtcatcgtgagcgacaaccgggacgagggctacaagctgatccggaacgagatccgggagcagcacaaggccctgaacctcgcctacaaccacctctacttcgagcacaacgcgatccagatcctcaagcagaacgacgaggactacaagcagaagcgcaacaagctccaggaacttattaacaagaagtacgaggaacaccagaaggccaagaacctggagcgcaaggaggcgctgcgcgaggcgtacaacaacaagaaacaagaactatacaagttcgagcgcgagtgcaacgaggaggcgcgcaaggcgtaccagcaagtcgtcggcttcacccagcagacgcgcgtgcggaacctcatcaaccgggagtacaacctgatgtccgacacgaaggacgggatcacgtcgaaggtcacccaggactacaagaacgactgcaaggcgggcctcctgattggcaagcggagcctgcggaactacaaaaaagacaatccactgcttgtcaggggtcggtcgctcaagttctacaaggaggacggcgactacttcatcaagtggaacaagggcacggtgttcaagtgcatcctccacatccgcaaaaagaatgtcgcggagcttcagagcgtgctggagaacgtgctcctgggcgcatacaagatatgtgactcctccatcgggttcaacaacaaggacatgatcctcaacctcagcctgaacatcccggacaaggagacttacgactacatccctgggcgggtggtgggcgtggacctgggcctcaagatcccggcctacgtctccctctccgacaaggtgtacgtgaggaaggggatcggcgggatcgacgacttcctgcgggtccgcacgcagatgcagaagcgccgccgccagctccaggagagcctcgcggcagtgaagggcggcaagggccgggagaagaagctcaaagccctcgaccacctcaaggggaaggaggccaacttcgccaagacctacaaccacttcctgtccacgcagatcgtgaccttcgccgtcaagaaccaggcgggccagatcaacatggagttcctggagttcgacaagatgaaaaacaagtctctgctccggaactggtcgtactaccagcttcagatgatggtggagtacaaggccaagcgggaggggatcatcatcaagtacgtggacgcctacctcaccagccagacgtgctccaagtgcgactactacgaggaggggcagcgcgagaaacaggagaaattcatctgcaagtcgtgcgccttcgaggtcaacgcggactacaacgccagccagaacatcgccaagagcgcccggtacatcagcgacagcaccgagcgggagtaccacaaaaagaaacaagaggatctcaaggaaatactgggcgagaacgacatcatcaacgagcagctctcgctgttcgacaaccacgacgacatcgcctag

SEQ ID NO: 2528 - DNA, 1491 bp, Unknown
  Bacillus sp. multi
gtgatcctgacccggaaggtcaagctcgtgatcgtctccgacaaccgcgacgaggggtacaagctgatccggaacgagatccgcgagcagcacaaggccctgaacctggcgtacaatcatctatacttcgagcacaacgccatccagatcctcaagcagaacgacgaggactacaagcagaagcggaacaagctccaggagctgattaacaagaaatacgaggagcaccagaaggccaagaacctggagcgcaaggaggcgctccgggaggcgtacaacaacaaaaagcaagagctgtacaagttcgagcgggagtgcaacgaggaggcgcggaaggcgtaccagcaagtcgtgggcttcacccagcagaccagggtgaggaacctcatcaaccgcgagtacaacctgatgtcggacacgaaggatggcattaccagcaaggtgacccaggactacaagaacgactgcaaagcggggctcctcatcgggaagcgcagcctgcggaactacaaaaaggataacccgctcctagtccgtgggaggagcctcaagttctacaaggaggacggggactacttcattaagtggaacaagggcaccgtgttcaagtgcatcctgcacatccgcaagaagaatgtggcggaattgcagagcgtcctggagaacgtcctgctcggggcctacaagatttgcgactccagcatcggcttcaacaacaaggacatgatcctcaacctgagcctgaacatccccgacaaggaaacctacgactacatccccggtagagtggtgggcgtggacctcggcctcaagatccccgcctacgtctccctgtccgacaaggtgtacgtgcggaaggggatcggcggcatcgacgacttcctccgcgtgcggacccagatgcagaagcggcggcggcagttgcaagagtccctcgcggccgtgaagggcgggaagggccgggagaagaaactcaaggcgctcgaccacctcaaggggaaggaggccaacttcgccaagacctacaaccacttcctctccacgcagatcgtcacgttcgccgtcaagaaccaggcgggccagatcaacatggagttcctggagttcgacaagatgaaaaataagtcgctgctgcggaactggagctactaccaactacaaatgatggtcgagtacaaggccaagcgcgagggcatcatcatcaagtacgtggacgcctacctcacgagccagacgtgctcgaagtgcgactactacgaggaggggcagcgggagaaacaggagaagttcatctgcaaatcctgcgcgttcgaggtcaacgccgactacaacgcctcccagaacatcgccaagtccgcccgctacatctccgacagcacggagcgcgagtaccacaagaagaagcaagaggacttgaaggagatcctgggcgagaacgacatcatcaacgagcagctcagcctcttcgacaaccacgacgacatcgcctga

SEQ ID NO: 2529 - DNA, 1491 bp, Unknown
  Bacillus sp. multi
gtcatcctgacgcggaaggtcaagctggtgatcgtgagcgacaaccgcgacgagggctacaagctcatccggaacgagatccgcgagcagcacaaggccctgaacctggcgtacaaccacctgtacttcgagcacaacgcgatccagatcctcaagcagaacgacgaggactacaagcagaagcggaacaaactccaggaactcatcaacaaaaagtacgaggagcaccagaaggccaagaacctggagcgcaaggaggcgctccgcgaggcgtacaacaacaagaaacaagagctgtacaagttcgagcgggagtgcaacgaggaggcgcgcaaggcgtaccagcaagttgtggggttcacccagcagacgcgggtccggaacctcatcaaccgcgagtacaacctcatgagcgacacgaaggacggcatcacctcgaaggtcacccaggactacaagaacgactgcaaggcgggcctcctgatcggcaagcggtccctccggaactacaagaaggataacccgctgctcgtgcgaggccgaagcctcaagttctacaaggaggacggggactacttcatcaagtggaacaagggcacggtcttcaagtgcatcctgcacatccgcaagaaaaatgtggccgagttgcaaagcgtcctggagaacgtgctactcggggcatacaagatttgcgacagttccatcgggttcaacaacaaggacatgatcctgaacctgagcctcaacatcccggacaaggagacctacgactacatccctgggagggtggtcggcgttgatctcgggctcaagatccccgcctacgtgagcctgtccgacaaggtgtacgtccggaaggggatcggcgggatcgacgacttcctgcgcgtccggacccagatgcagaagcggcgtcgccagctccaggagtcgctggcggccgtgaagggcggcaaggggcgggagaagaagctcaaggcgctcgaccacctcaagggcaaggaggccaacttcgccaagacctacaaccacttcctcagcacccagatcgtgacgttcgccgtcaagaaccaggcgggccagatcaacatggagttcctggagttcgacaagatgaaaaataagagcctgctccggaactggtcctactaccagttacaaatgatggtggagtacaaggccaagcgggagggcatcatcatcaagtacgtggacgcctacctgacgtcccagacctgctccaagtgcgactactacgaggaggggcagcgcgagaaacaggagaaattcatctgtaagagctgcgcgttcgaggtcaacgcggactacaacgcctcgcagaacatcgccaagagcgcccgctacatcagcgactccacggagcgggagtaccacaagaaaaaacaagaagacctaaaggaaattctgggagaaaacgacatcatcaacgagcagttgtccctgttcgacaaccacgacgacatcgcctag

SEQ ID NO: 2530 - DNA, 1491 bp, Unknown
  Bacillus sp. multi
gtgatcctgacccgcaaggtcaagctcgtcatcgtgagcgacaaccgggacgagggctacaagctcatccggaacgagatccgcgagcagcacaaggccctcaacctcgcctacacgcggctgtacttcgagcacaacgccatccagatcctcaagcagaacgacgaggactacaagcagaagcgcaacaagctccagcagctcatcaataaaaagtacgaggagcaccagaaggccaagaaccttgagaagaaggaggcgctccgggaagcctacaacaagaaaaagcaggagctgtacaacttcgagaaggagtacaacgagaaggcccgccaggcctaccagcaggtggtcggcttcacgcagcagacgcgcgtgcgtaacctaatctcacgcgaatgcaacctgatgagcgacacgaaggacgggatcaccagcaaggtgactcaggactacaagaacgactgcaaggcgggcctcctcgcgggcaagcgcagcctccgcaactacaagaaggacaaccctctactggtgcgcggccgcagcctcaagttctacaaagaagacggagactacttcatcaagtggaacaagggcaccatcttcaagtgcattctccacatcagaaagaagaacgtcgcggagctgcagagcgtgctggagaacgtgttactggacatctacaaggtctgcgacagcagcatcgcgttcaacaacagggacatgatcctgaacctcaccctgaacatccccaacaaggagacccaggactacatccccgggcgcgtggtcggggtggacctgggcctcaagataccggcgtacgtctcgctgtccgacaaggtgtacgtccgcaaggggatcggcagtatcgacgacttcctccgtgttcggacgcagatgcagaagcgaaggcgccggttccaggagtcgctcgccgccgtgaagggcgggaagggccgggagaagaagctcaaggcgcttgaccaccttaagggcaaggaggcgaacttcgccaagacttacaaccacttcctcagcacgcagatcgtgaccttcgccgtcaagaatcaggcgggccagataaacatggagttcctggaattcgacaagatgaagaacaagtccctgctccgcaactggagctactaccagctgcagatgatggtggagtacaaggccaagcgcgaggggatcatcatcaagtacgtggacgcctacctgacctcccagacatgctccaagtgcgaccactacgaggagggccagcgcgagacccaggagcgcttcatgtgcaagagctgcggcttcgaagtgaacgcggactacaacgcctcacagaacatcgccaaaagtactaagcacatctccgactcagtcgagtccgaatattacaaaaagaaacaggaggccttgaaggagatcctccgggagaacgacacgatcaacgagcagttgtccctcctggacaactgcgacgacatcgcctga

SEQ ID NO: 2531 - DNA, 1491 bp, Unknown
  Bacillus sp. multi
gtgatcctgacgcgcaaggtcaagctggtgatcgtgagcgacaaccgcgacgagggctacaagctgatccgcaacgagatccgggagcagcacaaggccctgaacctcgcctacacccgcctctacttcgagcacaacgccatccagatcctcaagcagaacgacgaggactacaagcagaagcgcaacaagctccagcagctcatcaacaaaaagtacgaggagcaccagaaggccaagaacctggagaagaaggaggcactgcgggaggcgtacaacaagaaaaaacaagagctgtacaacttcgagaaggagtacaacgagaaggctcgccaagcctaccagcaagtagtgggcttcacccagcagacccgcgtccgcaacctcatctcccgcgagtgcaacctaatgtccgacacgaaggacggcatcaccagcaaggttacccaggactacaagaacgactgcaaggctgggctcctggcggggaagcgcagcctgcggaactacaagaaagacaatccacttctcgtccggggccgctccctcaaattctacaaggaggacggtgactacttcatcaagtggaacaagggcacgatcttcaagtgcatcctgcacatccgcaaaaagaacgtggcggaactgcaatcggtcctggagaacgtgctcctcgacatctacaaggtctgcgactcgtccatcgctttcaacaaccgggacatgatcctgaacttgacgctgaacatcccgaacaaggagacccaggactacataccagggagggtggtcggcgtggacctggggctcaagatcccggcgtacgtctccctctccgacaaggtgtacgtccggaagggcatcgggagcatcgacgacttcctgcgagtccggacccagatgcagaagcgccgccgccgcttccaggagagcctggccgccgtgaagggcggcaagggccgggagaagaagctcaaggccctcgaccacctcaagggcaaggaggcgaacttcgccaagacgtacaaccacttcctgtccacgcagatcgtgacgttcgccgtcaagaaccaggcggggcagatcaacatggagttcctggagttcgacaagatgaaaaataagtctctcctccggaactggtcgtactaccaactacagatgatggtggagtacaaggcgaagcgcgaggggatcatcatcaagtacgtggacgcctacctgacgagccagacctgctcgaagtgcgaccactacgaggagggccagcgcgagacccaggaaaggttcatgtgcaagtcgtgcggcttcgaggtgaacgccgactacaacgcctcccagaacatcgccaagtccaccaagcacatcagcgactccgtggagtccgagtattacaaaaagaaacaagaagcgctcaaggaaattctccgcgagaacgacaccatcaacgagcagctctcgttactggacaactgcgacgacatcgcgtga

SEQ ID NO: 2532 - DNA, 1491 bp, Unknown
  Bacillus sp. multi
gtgatccttacccggaaggtgaagctcgtgatcgtgtcggacaaccgcgacgagggctacaagctgatccgtaacgagatccgcgagcagcacaaggcgctcaacctggcctacacgcgcctgtacttcgagcacaacgccatccagatcctcaagcagaacgacgaggactacaagcagaagcgcaacaagctccagcagctcattaacaagaaatacgaggagcaccagaaggccaagaacctcgagaagaaggaagcgctgcgggaggcgtacaacaagaagaagcaggagctgtacaacttcgagaaggagtacaacgagaaggcccggcaggcctaccaacaggtggtgggcttcacccagcagacgcgggtgcggaacctaattagccgtgagtgcaacctgatgagcgacacgaaggacggcatcacgtcgaaggttacgcaggactacaagaacgactgcaaggccgggttactggcgggcaagcgcagcctacggaactacaagaaagacaacccgctcctggtgcgggggcggagcctaaagttctacaaggaggacggggactacttcatcaagtggaacaaggggaccatcttcaagtgcattctgcacatccgcaagaaaaacgtggccgagctgcagagtgtcctggagaacgtgcttctggacatctacaaggtctgcgactccagcatcgccttcaacaaccgcgacatgatcctgaacctgaccctgaacatcccgaacaaggagacgcaggactacatacctggtagggtggtgggcgtggacctcggcctcaagatccccgcctacgtctccctcagcgacaaggtgtacgtccgcaagggcatcggcagcatcgacgacttcctgcgggtccggacgcagatgcagaaacgccgccgccgcttccaggagtccctcgcggccgtgaagggcggcaaggggcgcgagaaaaagctcaaggccctggaccacctcaaggggaaggaggcgaacttcgccaagacctacaaccacttcctatcgacgcagatcgtcacgttcgcggtgaagaatcaggccgggcagatcaacatggagttcctcgaattcgacaagatgaagaacaaatccttgctccggaactggagctactaccaactacaaatgatggtcgagtacaaggcgaagcgcgagggcataatcattaagtacgtggacgcctatctcacctcccagacctgctcgaagtgcgaccactacgaggagggccagagagagacccaggagcggttcatgtgcaagtcatgcggcttcgaagtgaacgcggactacaacgccagccagaacatcgccaagagcacgaagcacatctccgacagcgtggagtccgagtattataagaagaaacaagaagcgctaaaggagatcctccgcgagaacgacaccatcaacgagcagctctcgctgctcgacaactgcgacgacatcgcctga

SEQ ID NO: 2533 - DNA, 1491 bp, Unknown
  Bacillus sp. multi
gtgatcctgacgcgcaaggtgaagctggtgatcgtcagcgacaaccgggacgagggctacaagctgatccggaacgagatccgggagcagcacaaggccctgaacctcgcctacacgcggctgtacttcgagcacaacgcgatccagatcctcaagcagaacgacgaggactacaagcagaagcgcaacaagctccagcaactcatcaacaaaaagtacgaggagcaccagaaggctaagaacctggagaaaaaggaggctctgcgcgaggcgtacaacaagaagaagcaggagctgtacaacttcgagaaggagtacaacgagaaggcccgtcaagcatatcagcaagtcgtggggttcacgcagcagactcgggtgcggaacctgatctcgcgggagtgcaacctgatgtcggacacgaaggacggcatcacgagcaaggtcacccaggactacaagaacgactgcaaggcggggctgctcgccgggaagcgcagcctccggaactacaagaaggataacccgctcctggtgcgcgggcgctccctcaagttctacaaggaggacggcgactacttcatcaagtggaacaaggggacgatattcaagtgcatcctccacatccgcaaaaagaatgtggcggagttgcagtccgtccttgagaacgtgctgctggacatatacaaggtgtgcgacagctccatcgcgttcaacaaccgggacatgatcctcaacctcaccctgaacatccccaacaaggagacacaggactacatccctggtcgcgtggtgggcgtggacctggggctcaagatcccggcgtacgtctcgctctccgacaaggtgtacgtccggaaggggatcgggagcatcgacgacttccttcgggtgcgaacccagatgcagaagcggagacgaaggttccaggaatctctggcggccgtcaagggcggcaagggccgcgagaagaagctgaaagctcttgaccacctcaagggcaaggaggcgaatttcgccaagacctacaaccacttcctgtccacgcagatcgtgaccttcgccgtcaagaaccaggccgggcagatcaacatggagttcctggagttcgacaagatgaagaacaaatccctgctcaggaactggtcctactaccagcttcaaatgatggtcgagtacaaggcgaagcgggagggcatcatcatcaagtacgtggacgcctacctgacctcgcagacgtgcagcaagtgcgaccactacgaggagggccagcgggagacccaggagcggttcatgtgcaagagctgcggcttcgaggtcaacgccgactacaacgcctcgcagaacatcgccaagagcaccaagcacatcagcgactcggtggagtctgaatattataaaaagaagcaggaggcactcaaggagatcctccgcgagaacgacacgatcaacgaacagctctcgctgctcgacaactgcgacgacatcgcgtga

SEQ ID NO: 2534 - DNA, 1491 bp, Unknown
  Bacillus sp. multi
gtgatcctcacgcggaaggtcaagctcgtgatcgtgtccgacaaccgcgacgaggggtacaagctcatccgcaacgagatccgcgagcagcacaaggcgctgaacctggcctacacccgcctctacttcgagcacaacgcgatccagatcctcaagcagaatgacgaggactacaagcagaagcgcaacaagctccagcagctcatcaacaagaagtatgaggaacatcagaaggccaagaacctggagaagaaggaagcgctccgcgaggcgtacaacaagaagaagcaagagttgtacaacttcgagaaggagtacaacgagaaggcccgccaggcgtatcagcaggtagtggggttcacccagcagactcgcgtgcggaacctgatctcccgcgagtgcaacctgatgagcgacacgaaggatggcatcacgtcgaaggtcacccaggactacaagaacgactgcaaggccgggctgctggccgggaagaggtcacttcggaactacaaaaaggataacccactgctggtaagagggaggagcctcaagttctacaaggaggacggggactactttatcaagtggaacaaggggaccatcttcaagtgcatcctccacatccgcaaaaagaatgtggcggagcttcaatcggtcctggagaacgtgctgctggacatctacaaggtgtgcgactcgtccatcgccttcaacaaccgggacatgatcctcaacctgacgctgaacatcccgaacaaggagacacaggactacatccccggccgcgtcgtgggcgtggacctcggcctcaagattccggcctacgtctccctcagcgacaaggtgtacgttcgcaaggggatcggctcgatcgacgacttcctccgggtccgcacgcagatgcaaaagcggaggagacggttccaggagtccctcgcggccgtgaagggcggcaagggccgggagaagaaactcaaggccctggaccatctcaaagggaaggaggcgaacttcgccaagacgtacaaccacttcctgagcacgcagatcgtgaccttcgcggtcaagaaccaggcgggccagatcaacatggagttcctggagttcgacaagatgaagaacaaatccctcctgcggaactggtcgtactaccagctgcaaatgatggtggagtacaaggccaagcgcgaggggatcatcatcaagtacgtggatgcttacctgaccagccagacgtgcagcaagtgtgaccactacgaggagggccagcgtgagacccaggagcggttcatgtgcaagtcctgcgggttcgaggtgaacgccgactacaacgcctctcagaacatcgccaaaagcacgaagcacatctcggacagcgtggagtccgagtactacaagaagaagcaagaggcgctcaaggagatcctccgcgagaacgacacgatcaacgagcagctctcactgctggacaactgcgacgacatcgcgtag

SEQ ID NO: 2535 - DNA, 1491 bp, Unknown
  Bacillus sp. multi
gtcatcctcacgcggaaggtcaagctggtcatcgtctccgacaaccgggacgaggggtacaagctgatccgcaacgagatccgggagcagcacaaggccctcaacctcgcctacacgcgcctctacttcgagcacaacgccatccagatcctcaagcagaacgacgaggactacaagcagaagcgcaacaagctccagcagctcatcaacaagaagtatgaggagcaccagaaggccaagaacctggagaagaaggaggccctgcgggaggcctacaacaagaaaaagcaggagctttacaacttcgagaaggagtacgacgagaaagccaggcaagcgtaccaacaagttgtgggcttcacgcagcagacgcgcgtgcggaacctcatctcccgcgagtgcaacctgatgtcggacacgaaggacgggatcacgtccaaggtcacccaagattacaagaacgactgcaaggcgggcctgctggcgggaaagcgctccctccgcaactacaagaaggataacccgttgctcgtgcgcggccggtccctcaagttctacaaggaggacggcgactacttcatcaagtggaacaagggaacgatcttcaagtgcatactgcacatccgcaaaaagaacgtggccgagttgcaatcggtgctggagaacgtgctgctcgacatctacaaggtgtgcgacagcagcatagccttcaacaacagggacatgatcctgaacctcaccctgaacatccccaacaaggagacccaagactacattccagggcgcgtggtcggggtggacctgggcctcaagatcccggcgtacgtcagcctcagcgacaaggtctacgtgcgcaagggcatcgggtccatcgacgacttcctccgtgtacggacccaaatgcagaagcgccgccgccgcttccaggagtcgctggcggccgtgaagggcgggaaggggcgggaaaagaaactcaaggcgctcgaccacctcaagggcaaggaggcgaacttcgccaagacctacaaccactttctgagcacccagatcgtgaccttcgccgtcaagaaccaggccggacagatcaacatggagttcctggagttcgacaagatgaaaaacaaatcattgctgcggaactggtcttactaccagcttcaaatgatggtggagtacaaggccaagagggagggcatcatcatcaagtacgtggatgcctacctgacgagccagacctgctcaaagtgcgaccactacgaggagggccagcgcgagacccaagagcgcttcatgtgcaagtcgtgcggcttcgaggtgaacgccgactacaacgcatcacagaacatcgccaagagcaccaagcacatctccgactcggtggagtccgagtattacaagaagaagcaggaagcgctcaaagagatcctgcgggagaacgacacgatcaacgagcagctctcgctcctcgacaactgcgacgacatcgcctag

SEQ ID NO: 2536 - DNA, 1491 bp, Unknown
  Bacillus sp. multi
gtgatcctgacccgcaaggtgaagctcgtcatcgtctcggacaaccgggacgaggggtacaagctgatccggaacgagatccgggaacagcacaaggcgctcaacctcgcctacacgcggctctacttcgagcacaacgcgatccagatcctcaagcagaacgacgaggactacaagcagaagcgcaataagctccaacaacttatcaacaagaaatacgaggagcaccagaaggccaagaacctggagaagaaggaagccctgcgcgaggcgtacaacaagaagaaacaagaactgtataatttcgagaaggagtacgatgaaaaagctcgccaggcgtaccaacaagtggtggggttcacgcagcagacgcgcgtgcggaacctcatctcccgtgagtgcaacctgatgagcgacaccaaggatggcatcaccagcaaggtgacgcaagattacaagaacgactgcaaggcggggctgctcgcggggaagcgcagcctccgcaactacaagaaggacaaccccttgttagtccggggccgctccctcaagttctacaaggaggacggcgactacttcatcaagtggaacaagggcaccatcttcaagtgcatcctgcacatccgcaaaaagaacgtggccgaattgcagtccgtgctggagaacgtgctgttggacatctacaaagtgtgcgacagtagcatcgcgttcaacaacagggacatgattctgaacctcaccctgaacatccccaacaaggagactcaggactacatccccggccgcgtcgtgggcgtggacctcgggttgaagatccccgcgtacgtcagcctgagcgacaaggtgtacgtccgtaaggggatcggcagcatcgacgacttcctgcgcgtcaggacgcagatgcagaagcgccgacgccggttccaggagtccctggccgccgtgaagggcgggaaggggcgcgagaagaagctaaaggcgctcgaccacctcaaggggaaggaggccaacttcgccaagacgtacaaccacttcctgtccacccagatcgtgaccttcgctgtcaagaaccaggcgggccagatcaacatggagttcctggagttcgacaagatgaagaataagtccctgctccgcaactggtcctactaccagctccagatgatggtggagtacaaggccaagcgcgagggcatcatcatcaagtacgtggacgcctacctgacctcgcagacctgctcgaagtgcgaccactacgaggagggccagcgggagacgcaggagcgcttcatgtgcaagtcgtgcgggttcgaggtgaacgccgactacaacgcctcccagaacatcgccaagagcaccaagcacatcagcgacagcgttgagtccgagtattacaagaaaaaacaagaagcgctcaaggagatcctgcgcgagaacgacacgatcaacgagcagctctcgctcctcgacaactgcgacgacatcgcgtag

SEQ ID NO: 2537 - DNA, 1491 bp, Unknown
  Bacillus sp. multi
gtcatcctcacgcgcaaggtgaagctcgtcatcgtgtccgacaaccgcgacgagggctacaagctcattcgcaacgagatccgcgagcagcacaaggcgctcaacctggcctacacgcggctctacttcgagcacaacgcgatccagatcctcaagcagaacgacgaggactacaagcagaagcggaacaagctccagcaactcatcaacaagaagtatgaggagcaccagaaggccaagaacctggagaagaaagaggccctccgggaggcgtacaacaaaaagaaacaagagctgtacaacttcgagaaggagtacgacgagaaggcgcgacaagcataccaacaagttgtcggcttcacgcagcagactcgtgttcggaacctgatctcccgcgagtgcaacctcatgtccgacactaaggacggcatcaccagcaaggtgacccaggactacaagaatgactgcaaggccgggctcctggcggggaagcgcagcctccgcaactacaagaaagacaacccgctcctggtgcgcggccggagcctcaagttctacaaggaggacggcgactacttcatcaagtggaacaagggcaccatcttcaagtgcatcctccacatccgtaaaaagaacgtagccgaattgcaatcggtcctggagaacgtgctcctggacatctacaaggtctgcgactccagcatcgcgttcaacaacagggatatgatcctcaacctgaccctcaacatccccaacaaggagacccaggactacatcccggggcgcgtggtgggcgtggacctcgggctcaagatccccgcctacgtctccctgtccgacaaggtgtacgtgcggaagggcatcggcagcattgatgacttcctccgtgtccggacgcagatgcagaagcgccgaagacgcttccaggagagtctggcggccgtcaagggcggcaagggccgggagaagaagctcaaggccctcgaccaccttaaggggaaggaggcgaacttcgccaagacctacaaccacttcctgagcacccagatcgtgaccttcgccgtcaagaaccaggctgggcagatcaacatggagttcctggagttcgacaagatgaaaaataaaagcctgctgaggaactggtcctactaccaattgcaaatgatggtggagtacaaggccaaacgcgagggcatcatcatcaagtacgtggacgcctacctgacctcccagacgtgctccaagtgcgaccactacgaggaggggcagcgcgagacccaagagcggttcatgtgcaagagctgcggcttcgaggtcaacgccgactacaacgcctcgcagaacatcgccaagtccaccaagcacatcagcgactccgtggagagcgagtactacaagaagaagcaggaagcgctcaaggagattctgcgggagaacgacaccatcaacgagcagctctccctcctggacaactgcgacgacatcgcctga

SEQ ID NO: 2538 - DNA, 1491 bp, Unknown
  Bacillus sp. multi
gtgatcctcacccggaaggtgaagctcgtcatcgtgtcggacaaccgggacgaggggtacaagctgatccggaacgagatccgcgagcagcacaaggccctgaacctcgcctacacgcggctgtacttcgagcacaacgccatccagatcctcaagcagaacgacgaggactacaagcagaagcgcaacaagctccagcagctcatcaacaagaagtacgaggagcaccagaaggccaagaacttggaaaaaaaggaagcgctccgcgaggcgtacaacaagaaaaaacaagagctgtacaacttcgagaaggagtacgacgagaaggcccgacaagcctatcagcaagtcgtcgggttcacgcagcagacgcgcgtgcggaacctcatcagccgggagtgcaacctgatgagcgacactaaggatgggatcacctcaaaggtgacccaggactacaagaacgactgcaaggccgggctcctggcggggaagcgctccctacggaactacaaaaaggataacccgctgctcgtccggggccgcagcctcaagttctacaaggaggacggcgactacttcatcaagtggaacaagggcacaatcttcaagtgcatcctgcacatccgcaagaagaatgtggccgagctgcaatctgtgcttgagaacgtgctgctggacatctacaaggtctgcgactccagcatcgcgttcaacaaccgcgacatgatcctcaacctcaccctgaacatcccgaacaaggagacccaggactacattccaggccgcgtcgtcggtgtggacctgggcctcaagatccccgcctacgtcagcctgtcggacaaggtgtacgtgaggaaggggatcggctccatcgacgacttcctgcgggtccgcactcagatgcagaagcgtcgccgccggttccaggagtcgctggccgccgtgaagggcggcaagggccgcgagaagaagctcaaggccctcgaccacctcaagggcaaggaggcgaacttcgccaagacctacaaccacttcctcagcacgcagatcgtgaccttcgccgtcaagaaccaggccgggcagatcaacatggagttcttggagttcgacaagatgaaaaacaaatccctgcttcgcaactggtcctactaccaactgcaaatgatggtcgagtacaaggccaagcgggagggcatcatcatcaagtacgtggacgcctacctgacctcgcagacctgctccaagtgcgaccactacgaggagggccagcgcgagacccaggagcggttcatgtgcaagtcgtgcgggttcgaggtgaacgcggactacaacgcgagccagaatatcgccaaatccactaagcacatcagcgacagcgtggagagcgaatattataagaagaaacaagaggctctcaaggagatcctccgcgagaacgacacgatcaacgagcagctctcgctgctcgacaactgcgacgacatcgcctga

SEQ ID NO: 2539 - DNA, 1491 bp, Unknown
  Bacillus sp. multi
gtcatcctgacgcggaaggtgaagctcgtgatcgtgtcggacaaccgggacgagggctacaagctgatccgcaacgagatccgcgagcagcacaaggccctgaacctggcctacacgcgcctctacttcgagcacaacgccatccagatccttaagcagaacgacgaggactacaagcagaagcgcaacaagctccagcagctcatcaacaagaaatacgaggagcaccaaaaggccaagaacctggagaagaaggaagcactccgggaggcgtacaacaaaaagaaacaagaactgtacaacttcgagaaggagtacgacgagaaggcccgccaggcttatcaacaagtagtcgggttcacccagcagacgagggtccggaacctgatctcacgcgagtgcaacctgatgtcggacacgaaggacgggatcacctcgaaggtgacccaggactacaagaacgactgcaaggccgggctgctcgcggggaagcgctccctccgaaactacaaaaaggataacccgctgctcgtcaggggccgctccctcaagttctacaaggaggacggggactacttcatcaagtggaacaagggcaccatcttcaagtgcatcctccacatccgcaagaaaaacgtggccgagttacaatcggtcctggagaacgtgctgctcgacatctacaaggtctgcgacagcagcatcgcgttcaacaacagggacatgatcctgaacctcaccctgaacatccccaacaaggagacccaggactacatccccggccgtgtcgtgggcgtggatctcggcctcaagatcccggcgtacgtctcgctctccgacaaggtgtacgtccgcaagggcatcggctccatcgacgacttcctgcgggtacgcacccagatgcagaagcgccgcagacgcttccaagagtccctggcggccgtgaagggcgggaagggccgggaaaaaaagctcaaggcgctggaccaccttaagggcaaggaggccaacttcgccaagacctacaaccacttcctgtccacccagatcgtcacgttcgcggtcaagaaccaggcgggccagatcaacatggagttcctggagttcgacaagatgaaaaacaagtctctgcttcgcaactggagctactaccagcttcagatgatggttgagtacaaggcgaagcgcgaggggatcatcatcaagtacgtggacgcctacctcaccagccagacgtgcagcaagtgcgaccactacgaggagggccagcgggagacccaggagcgattcatgtgcaagtcgtgcggcttcgaggtgaacgccgactacaacgcgagccagaacatcgccaagtccacgaagcacatcagcgactccgtggagagcgagtactacaagaaaaaacaagaagcgctcaaggagatcctccgggagaacgacacgatcaacgagcagctcagcctgctggacaactgcgacgacatcgcctga

SEQ ID NO: 2540 - DNA, 1056 bp, Unknown
  Paenibacillus thiaminolyticus (multi)
atggggacggagaccgacgagcaccacacggtgcaccacaggcacgacacctcctaccgcttcctgttatcaagcaagaagctgttcgtagagttactccggtcgttcgtgcagaaggagtgggtcgagcgcattgacgagacgaatgtccaggagatcccgcacagcttcgtgctacaggacttcaagcgaaaggaggcggatctcgtctatcgggtcaagctgaatggtcaagatgtggtattctatctgctgctggagatgcagtcaaaagtggacttcctgatgccctaccggctactcctataccaagtcgagatttggcgctatctgatgaaggaccaggagaaggcgaaagggaagccgaagacgttccggctcccaccgatagtgcctatcgtcttgtacaacggcaagcgtaggtggacagcctcacgccagttccgccagctcctagcgaacgagaccatgttcggctccgaactgctcaactttgagtacgtgctcatcgacgtcgctcgctacacggaggaggagctgctcgccctgagcaacaccatcggctccgtgttcctactcgaccagacggccgaccagactgagctactgaaccggctgggcaagctgatgcacaccatccagcaactcccggaggactcccagcagcaattggtggcctggatggcgaacatcctgtcccagaagttaccggagaatgagccccagctacgagaattgatacagaacgtcaaaggcggcgtgtcagttatgggccttgaaaaaaccctcgacgccatcaagcgggagggcagacgcgaagggaggagggaggggcttcgagaagggctgcgcgaaggcttgcgcgagggcatccttgaggggaaacaagagggaaagcgcgagggcatcctggaggggaaacaagagggcaagcgcgaggcgaaagaggaggtggtcaagcagatgatcgcggagaacttggacccagacctcatcgcgcgggtgaccgggttcccgctggacattatcacacaattgagggagaagtcacactga

SEQ ID NO: 2541 - DNA, 1056 bp, Unknown
  Paenibacillus thiaminolyticus (multi)
atggggacggagacggacgagcaccacaccgtgcaccacaggcacgatacctcttatcgtttcctcctgtcctccaagaagctcttcgtggaactcctgcgctcgttcgtacaaaaggaatgggtggagcggattgacgagactaacgtccaggagataccacacagtttcgtcctccaggacttcaagcggaaggaggctgacctcgtttaccgggtcaagctgaacggtcaagacgtcgtgttctatctgctccttgagatgcagagcaaggtggactttctcatgccgtaccgcctgctgctctatcaagtggagatttggcgctatctgatgaaggaccaggaaaaggcgaaagggaagccgaaaacgttccggctcccgccgattgtccccatcgtcctctacaacggcaagcggcgctggaccgcaagccgccagttcagacagcttctcgccaacgagaccatgttcgggtctgagcttctcaacttcgaatacgtcctcattgacgtggcccgttacacggaggaggaactcctcgccttgtcaaacacaataggctcggtcttcctactcgaccagacggcggaccagacggaattactgaatcgcctcgggaagctcatgcacactatccaacagctccccgaggactcccagcaacagttggtggcgtggatggccaacatcctcagtcagaagctgcccgagaacgagccgcagctcagggagcttatccaaaacgtgaaaggtggcgttagtgtcatgggcctggagaagacgctggatgcgatcaagcgtgaggggcggagggagggccgccgggaggggttaagggagggcctgcgtgaaggtctgagggagggcatcttggaaggcaaacaggagggcaagcgggagggcatcctggagggcaaacaggaaggcaaacgcgaggcgaaggaggaagtggtcaagcagatgattgcggagaacctggaccctgacctcattgccagagtgaccgggttccctctcgacattatcacccaattgcgcgagaagtcccactag

SEQ ID NO: 2542 - DNA, 1056 bp, Unknown
  Paenibacillus thiaminolyticus (multi)
atgggcaccgagactgacgagcaccacaccgtccatcaccggcatgacacctcctaccgcttcctcctttcgtccaagaaactgttcgtggagctgctcagatcgttcgtgcagaaggaatgggtggagcgcatcgacgagacaaacgtccaggagattccgcactctttcgtactgcaagactttaagcgcaaggaggccgacttagtttaccgcgtgaagctgaacggacaggacgtcgtgttctaccttctgctcgaaatgcaaagcaaggtggatttccttatgccataccgacttctgctctatcaagtcgagatatggcgttaccttatgaaggaccaggagaaggcgaagggcaagcccaagacgttccggctgccgcctattgttccaatcgtcctgtacaacgggaagcgccggtggacagcatcccggcaattcagacaacttctcgcaaacgagacgatgttcggctccgagttattgaacttcgaatatgttcttatcgacgttgcgcgctacacggaggaggaattgctggccttgtccaataccatcggctcggttttcctgttggaccagacggccgatcagacggaactccttaaccgcctggggaagctcatgcacaccatacaacagcttccggaggactcccaacagcagttggtggcgtggatggccaacatcctgtcccagaagctgcccgagaacgagccgcagctccgcgagctgattcagaacgtgaagggcggggtgtccgtgatggggctggagaaaaccctagacgccatcaagcgggagggccgtcgggagggaaggcgcgagggactccgcgaggggctccgggagggcctccgcgagggcatcctggagggcaaacaagagggcaagcgcgagggcatcctggaaggcaaacaggagggcaaacgcgaagctaaggaggaagtggtgaaacaaatgatcgccgagaacttggaccccgacctaatcgctcgcgtcaccggctttcctctcgacataatcacccagctcagggaaaagtctcactga

SEQ ID NO: 2543 - DNA, 1056 bp, Unknown
  Paenibacillus thiaminolyticus (multi)
atggggaccgagaccgacgagcaccacaccgtacatcaccgtcacgacaccagctaccggttcctcttgagtagcaagaagctgttcgtggaactgttgaggagcttcgtccagaaggagtgggtggaacgaatcgacgagacgaacgtccaggaaattccgcactctttcgtcctgcaagatttcaagcggaaggaggcagacctcgtttacagggtcaagctcaacggtcaagatgtggtgttctatttgctcctcgaaatgcagtcgaaagtggacttcctcatgccgtaccggctgctcctgtaccaagtcgagatatggcgctatctcatgaaggaccaggagaaggcaaaggggaagcctaagaccttccggctgccacctatcgtgcccatcgtcctgtacaacgggaagcggcgttggacggcctcccgccagtttcgccagttgctcgccaacgagacgatgttcgggtcggaactacttaacttcgagtacgtcctcatcgacgtggcgcgatacactgaggaggagttgctggccttgtcaaataccatcggtagcgtgttcctgctggaccagaccgccgaccagacggaactcctgaataggctcggaaagctgatgcacacaattcaacaattgcccgaggactctcagcagcagttggtggcgtggatggcaaacattctgagccagaagctccccgagaacgagccgcaactgagggagctgatccagaacgtcaaaggaggcgttagcgtgatgggcctggaaaaaacactggacgccattaagcgcgagggacgccgggaggggagacgggagggcctccgcgagggtctgcgcgagggcctccgtgagggcatcctggaagggaaacaggagggcaaacgcgagggcatccttgagggcaaacaggagggcaaacgggaagccaaagaggaggtggtgaagcagatgatcgctgagaacttagaccctgatctgatcgcgcgagtcaccgggtttccactggacataatcacgcagctccgggagaaatcgcactag

SEQ ID NO: 2544 - DNA, 1056 bp, Unknown
  Paenibacillus thiaminolyticus (multi)
atgggcaccgagacggacgaacaccacaccgtgcaccaccgccacgacaccagctaccgcttccttctaagctccaagaagctcttcgtggagctgctccgctccttcgtccaaaaggagtgggtggaacgcatcgacgagacgaatgtccaggagatccctcactccttcgtgctccaggacttcaagcgcaaggaggcggacctcgtttaccgcgtcaagctcaacggacaagatgtcgtgttctacctgctcctggagatgcagtctaaagtggatttccttatgccgtaccgcctcttgctgtaccaagtggaaatctggcgctacctcatgaaggaccaggagaaggcaaaggggaagccaaagaccttccggctcccgcccatcgtccccatcgtcctctacaatggcaaacgccgttggacggcctctcgccagttccggcagttgcttgcaaatgagaccatgttcgggtccgaactgttaaacttcgagtacgtgctgatcgacgtggcccgctacaccgaggaggagctgcttgccctcagtaacacaatcggcagcgtgttccttctcgaccagacagccgatcagactgaactactgaacaggctcggcaaactcatgcacaccatccaacagctaccggaggactcccagcagcaactcgtcgcgtggatggcgaacattctgagccagaagctgcccgaaaacgagccacaactccgagagctgatccagaacgtcaaaggtggagtcagcgttatggggctggaaaaaacactcgatgcgatcaagagggagggacgccgtgagggccgccgggagggcctccgcgagggcctccgcgaggggttgcgtgaggggattcttgaaggcaaacaggagggaaaacgggaggggatacttgagggaaaacaggagggcaagcgcgaggcgaaggaggaagtggtgaagcagatgatcgcggagaacttggaccccgacctaatagcccgtgtgacgggtttcccgctagacatcatcacgcagttgcgtgagaagtcccactaa

SEQ ID NO: 2545 - DNA, 1044 bp, Unknown
  Paenibacillus thiaminolyticus (multi)
atggggacggagacggacgagcaccacaccgtccaccaccgccacgatacctcgtaccgcttcctcctgtcgtccaagaagctcttcgtcgaactgcttcgctccttcgttcagaaggagtgggtggagcgtatcgacgagacgaacgtccaggaaataccccacagtttcgtgctccaagatttcaagcgtaaggaggccgacctagtatatcgcgtgaagctaaacggacaagatgtcgtgttctacctcctgcttgagatgcagagcaaggtggacttcctcatgccctaccgcctgctcctctaccaagtcgagatatggcgttacctgatgaaggaccaggagaaggctaaggggaagccgaaaaccttcagactgccgccgatagtgccaatcgtcctgtacaatggcaagcgccggtggacggcctcgcgccagttccgccagcttttagcaaacgagacaatgttcggctctgagttattgaacttcgaatacgtgctcattgacgtggcgcgctacaccgaggaggagctgttggctctcagtaacactattggcagcgttttcctgttggaccagacggccgaccagactgaactgctcaaccggctcggcaagctcatgcacacaatccagcaacttcctgaggactcccagcagcagttggtggcgtggatggcgaacatcctgagccagaagctccccgagaacgagccccagttgcgtgttctgatacaaaacgttaagggcggagtctccgttatgggcctggagaagacgcttgacgccatcaagcgcgagggccgccgggagggacggagggaggggcttcggcaaggactacaggagggaatacgggaggggaagcgggaaggaatccgcgagggtgtgcttgagggcaagcaagaggggaagcgggaggcgaaggaggaggtcgccaagcagatgataagtgaaaatctcgacccagagctgatcgcgcgcgtgacgggcttcagcctggacatcatcgcccagttgcgcgaaaagtcgaagtag

SEQ ID NO: 2546 - DNA, 1044 bp, Unknown
  Paenibacillus thiaminolyticus (multi)
atggggacggagacggacgagcaccacactgtgcaccacaggcacgacacgagctaccgcttcctcctttcctccaagaaactcttcgtggagctgctgcgctcattcgtccaaaaggaatgggttgaacgtatcgacgagaccaacgtccaggaaatcccgcactcattcgtgttgcaagatttcaagcgcaaggaggccgatctcgtttatcgtgtgaagctcaacggtcaggatgtggtgttctatctccttctggagatgcagtcgaaagtggacttcctgatgccctaccggctactgctttaccaagtggagatatggcgctatctcatgaaggatcaggagaaggcgaagggaaagccgaagaccttccgtttacctcccatcgtgcccatagtgctctacaatgggaaaaggcgatggaccgcaagccgccagttccgtcagcttctcgctaacgagaccatgttcggcagcgagctactgaacttcgagtatgtcttaattgatgtggcgcgctacacggaggaggagttgctggccctctcgaacactatcggctccgttttcctcctagaccagacggcggaccagacggagttgctcaacagactcggcaagctcatgcacaccatccaacaacttcccgaggactcccagcagcagttggtcgcctggatggccaacatcctttcccagaagctccccgagaatgagccacaactccgcgtgctcatccagaatgtcaagggcggcgtctcggtcatgggactggagaagaccctcgatgccattaagcgcgaggggaggcgggaggggcggagggagggtctgcgccagggactccaggagggcatacgcgaaggcaagcgcgagggcatccgggagggcgtcctggaggggaaacaggaggggaaacgggaggcaaaggaggaggtggctaagcagatgatctccgagaaccttgaccccgagctgatcgcgcgtgtgaccggtttcagcctggacatcattgcccagctccgggagaaatctaagtag

SEQ ID NO: 2547 - DNA, 1044 bp, Unknown
  Paenibacillus thiaminolyticus (multi)
atgggcacggagacagacgagcaccacacggtgcaccaccgccacgataccagctaccgcttcctgctgagcagcaagaagctgttcgtggaactgctgaggtcgttcgtgcaaaaggaatgggtggagcgtatcgacgagaccaacgtccaggaaataccgcactcgttcgtcctccaagactttaagcgcaaggaggctgatctcgtatatcgtgtgaagctgaacggccaagatgtcgtgttctacctgctgcttgagatgcagagcaaggtggactttctcatgccgtaccgcttgctcctttatcaagtggagatttggcgctacctgatgaaggaccaggaaaaggcgaaggggaaacccaagacgttcagactgccgcctatcgtccctatcgtcctctacaacggaaaacgtcgctggacggcttcccgccagttccgtcagctacttgccaacgagaccatgttcgggtcagaactcttaaacttcgagtatgtgctgatcgacgtcgcccgctacacggaggaggagctgcttgccctgtcgaataccattggctctgtgttccttctcgaccagactgccgaccagactgagctgctgaaccgcctcggcaagctcatgcacacgatccaacaactgccggaagattcgcaacaacagctcgtggcgtggatggccaacattctctcccagaaacttcccgaaaacgagccccaactacgggtgctcatccagaatgtgaagggcggggtgagcgtgatgggacttgagaagaccctggacgccatcaagcgcgagggccgccgggagggccgaagggagggcctccgccaggggcttcaagagggaatccgcgaggggaagcgcgagggcattcgggagggcgtacttgaaggcaaacaggagggcaagcgtgaggcgaaggaggaggtggcgaagcagatgatctcggagaacttggacccggagcttatcgcgcgcgtaaccggcttttcactggacatcatcgcccagctccgcgagaagtccaaatag

SEQ ID NO: 2548 - DNA, 1044 bp, Unknown
  Paenibacillus thiaminolyticus (multi)
atggggacagaaaccgacgagcaccacaccgtgcaccaccggcacgacacatcgtaccgcttcctcctgtcgtccaagaagctgttcgtggaactgctgcggtctttcgtgcaaaaggagtgggtggagcgcatcgacgagacgaacgtccaggagatcccgcacagcttcgtcctgcaagacttcaagcgaaaggaggccgacttggtgtacagggtcaagctcaacggacaggatgtcgtattctatctgctgctggaaatgcagagcaaggtggactttctaatgccctaccgcctgctcctctaccaagttgagatttggcgttacctgatgaaggaccaggagaaggctaaggggaaacctaagactttccgcctgccgcccattgtccccattgtgctttacaacggcaagcgccggtggaccgcttcccgacagttccgccaattactcgccaacgagaccatgttcgggagtgaactgttgaacttcgagtacgtgctcatcgacgttgcaagatatacagaggaggaattgctggccctctcgaacaccatcggtagcgtgttcctcctggaccagactgcggaccagaccgagctgctaaatcgcctcggcaagctgatgcacacgatacaacagctccccgaggactcccagcaacaacttgtcgcctggatggcgaacatcctgtcccagaaactacccgagaacgagccacagcttcgcgtgctcatacagaacgtcaagggtggcgtctccgtgatggggctggagaaaacgctggacgcgattaagcgcgaaggccgaagggagggccgccgggagggattgcggcaagggctgcaagagggtattcgggagggaaagcgcgaggggatacgcgagggcgttctggaggggaaacaggaaggcaagcgcgaggcgaaggaggaggtcgccaagcagatgatctccgagaacttggacccggagcttattgcccgtgtcacgggcttcagcttggacatcatcgcccaattgagggagaagtcaaaatga

SEQ ID NO: 2549 - DNA, 1044 bp, Unknown
  Paenibacillus thiaminolyticus (multi)
atgggcacggagacggacgagcaccacacagtccaccaccgccacgacacctcttaccgcttcctccttagttccaagaagctattcgtggaactccttcggtcgttcgtccagaaggagtgggtcgaacgaatcgacgagaccaacgtccaggagataccacacagcttcgttctacaggactttaaacggaaagaggctgatctcgtttaccgcgtaaagctgaacggccaagatgtagtgttctacctgctgctggagatgcaatcgaaagtggacttcctcatgccctaccgcctcctgctctatcaagtagagatttggcgttacctcatgaaggaccaggagaaggcgaaagggaagcccaagaccttccgcctcccgcccatcgtaccaatcgttctgtacaacgggaagcggcgctggaccgcctcgcgccagtttcgtcaattactggccaacgagaccatgttcggctccgagctactgaacttcgaatacgtcctcattgacgtggcccgctatacggaggaggagttactcgctctcagcaacaccatcggctccgtattcctgctcgaccagacggccgaccagaccgagctgctcaaccgcctgggcaagctgatgcacacgattcagcaacttccggaggacagccaacagcaattggtcgcgtggatggcgaacatcctctcccagaagttgcccgaaaacgagccccaactcagggtgctcatacaaaacgtgaaaggcggagtgtcggtgatggggctggagaaaactctggacgccatcaagagggagggcagacgggagggccgccgcgaggggttgcgtcaaggactacaggagggcatccgcgaggggaaacgcgagggaatccgcgaaggcgtgttggagggcaaacaggagggcaagagggaggcgaaggaggaagtcgccaagcagatgatctccgaaaacttggacccggagctgatcgcgcgcgtaaccggcttctcgcttgacattatcgcacaactccgcgagaagtccaagtga

SEQ ID NO: 2550 - DNA, 1020 bp, Unknown
  Paenibacillus sp. multi
atgggcaccgagaccgacgagcaccacaccgtccaccaccggcacgacaccagctacagattcttgctctcctccaaaaagctgttcgtggagctgctccggtccttcgtgcagaaggaatgggtcgagcgcatcgacgagactaacgtccaggagattccgcactcattcgttctgcaagacttcaagcgtaaggaggccgatctcgtctatcgcgttaagctcaacggccaggacatcgtattctacttgctcttggagatgcagtctaaggtggacttcctgatgccgtaccgcctgctcctgtaccaagtggagatatggcgctacctgatgaaggaccaggagaaggctaagggcaaaccgaagaccttccggctgccgcccatcgtccctatcgtgctgtacaacgggaagcgtcgatggaccgcctctcgccagttccggcaactactcgccaatgagaccatgttcgggagcgaactactgaacttcgagtacgtgctgatcgacgtggcgcgatataccgaggaggagctgcttgccctgtccaacaccatcgggtcagtcttcctgctcgaccagacggccgaccaaaccgagctgcttaaccggctggggcagctcatgcacactatccagcaattgcccgaggacagccagcagcaactcattgcctggatggccaacatactgtcccagaagctgcctgaaaacgagccgcaacttagagagttgatccaaaacgtgaagggaggcgtctcggtgatgggcttggagaagacgctggacgcgatcaagcgcgaaggccgccgggaggggaggcgggagggcctcagggaggggatacgcgaggggaaacaggaggggataagggaaggcaaacaggaggggaagcgcgaggctaaggaggaggtggtgaagcacatgatctcagaaaatctcgatcctgaactaatcgcccgcgtgacgggcttctcgctggacatcatagcacagctaagggagaagacgaagtga

SEQ ID NO: 2551 - DNA, 1020 bp, Unknown
  Paenibacillus sp. multi
atgggcaccgagacggacgagcaccacactgtccaccaccgccacgacacctcataccgcttcctcctctcctccaagaagctgttcgtcgagctactccggtccttcgtgcagaaggagtgggtggaacgcattgacgagaccaacgtccaggagatcccgcactcgttcgtcctccaagacttcaagcgtaaagaggcggacctcgtgtaccgcgtgaagctcaatggccaggacatcgtgttctacctcctcctggagatgcagagcaaggtggacttcctgatgccctaccggctgttactgtaccaagtggagatttggcgctacctcatgaaggaccaggagaaggccaaaggcaaaccgaagaccttcagactgcctccaattgtgcctatcgtactctacaacgggaagcggcgctggacggcctcgcgccagtttcggcaacttctggcgaacgaaaccatgttcgggtcggagttgctcaactttgaatacgtgctcatcgacgtggcgcgttacaccgaggaggagctactcgcgctctccaacaccatcggctcagtgttcctgctcgaccagaccgccgaccagaccgaactgttgaatagactcggccaactcatgcacaccatccagcaactacccgaggactcgcaacaacaactgatcgcatggatggcaaacatactgtcgcaaaagctcccggagaacgagccacagctcagggaactgatccagaacgtaaaaggtggcgtcagcgtcatgggccttgagaagacgctggacgcgatcaagagggaggggcggcgtgagggccgccgggaggggctgcgggagggcatccgtgaggggaaacaggagggaatccgggaggggaagcaagagggcaagcgcgaggcaaaggaggaagtcgtgaagcacatgataagtgagaacctcgaccccgagttgatcgccagagtcaccgggttctcgctcgacataatcgcccaactccgtgaaaaaacaaaatga

SEQ ID NO: 2552 - DNA, 1020 bp, Unknown
  Paenibacillus sp. multi
atggggacggagacggatgagcaccacacggtgcaccaccggcacgacaccagctaccgattcctcctgtcctccaagaaactcttcgtggaactgctccgctcgttcgtccaaaaggaatgggtggagcgtatcgacgagaccaacgtccaggagattcctcactcgttcgtcctccaagactttaagcgcaaggaggccgacctggtgtaccgcgtcaagctgaacggacaggacatcgtgttctacctcctccttgagatgcagagcaaggtggacttcctaatgccttaccgcctcctcctgtaccaagtggagatttggcgctacctgatgaaggaccaggagaaggcgaaggggaagccgaagaccttccgcctcccgcccattgtgcccattgttctctacaacgggaagcggcgctggaccgcctccaggcagttcagacagttattggcgaacgaaacaatgttcggctcagagctgctcaacttcgagtacgtcctcatcgacgtggcccgctacacagaggaggaactcttagccctcagcaacacgattggctcagtcttcctgctcgaccagacagcggaccagacagaattactgaaccggctgggacagttgatgcacaccattcaacaactccccgaggactcacagcagcaactaatcgcttggatggccaacatcctctctcagaagctccccgagaacgaaccccagctccgggaactgattcagaacgtgaagggtggtgtgagtgtgatgggcctggaaaaaacacttgacgctattaagagggaggggcggcgtgagggtcggcgcgagggcttgcgcgagggcatccgggaggggaaacaggagggcattcgtgagggcaaacaggaggggaagcgcgaggcgaaggaggaggtggttaagcacatgatctccgagaacctagacccagagctgatcgcgcgcgtgacaggcttctccctagacatcatcgctcaactccgtgagaagacgaagtga

SEQ ID NO: 2553 - DNA, 1020 bp, Unknown
  Paenibacillus sp. multi
atgggcacggagacggacgagcaccacaccgtgcaccaccgccacgacaccagctatcggttccttctgtcctccaagaaattgttcgtggaacttctgcgctcgttcgtgcagaaggagtgggtggaacgcatcgacgagacgaacgtacaggaaataccgcactcgttcgtcctccaggacttcaagcggaaggaggccgatctcgtttatcgtgtgaagctgaacggccaagatatagtgttctatctactgcttgaaatgcagtcaaaagtcgatttcctcatgccgtacagactgctgctctaccaagtcgagatatggcgttacttgatgaaggaccaggagaaggcgaaggggaagcccaagaccttccgcctgccgcccatcgtgcccatcgtgctgtacaacggcaagcgccgctggaccgccagccgccagttccgccaattgctcgccaacgaaacaatgttcgggtcggagctgctgaacttcgagtatgtcctcatcgacgtcgccagatacacagaggaggagttactcgcactatccaataccatcggctccgtgttcctcttggaccagactgccgatcagaccgaactgctcaaccgtctggggcagctcatgcacaccattcagcaactgccggaggactcccagcaacaactaatcgcctggatggccaacatcctaagccagaagctgcccgagaacgagccacagctccgcgagctgatccagaatgtgaagggcggggtcagcgtcatggggttggaaaaaaccttagacgccatcaagcgcgaaggacgccgtgaggggcggcgcgaggggctgcgcgagggcatccgtgagggcaaacaggagggcatacgtgaaggaaaacaggaggggaagcgtgaggcgaaggaggaggtcgtcaagcacatgatctcggagaacctcgaccctgagctgatcgctcgcgtaaccggcttctccctggacataatcgcccagctacgcgagaagacgaagtga

SEQ ID NO: 2554 - DNA, 1020 bp, Unknown
  Paenibacillus sp. multi
atgggcacggaaaccgacgagcaccacacagtccaccaccgccacgacacctcctaccgtttcctgctttccagcaagaagctcttcgtggagctgctgcggtcgttcgtgcaaaaggagtgggttgagcgaatagacgagaccaacgtccaggaaatcccacactcgttcgtgctccaggacttcaagcgcaaggaagcagacctggtgtacagggtgaagctaaacggccaggacatcgtgttctatctgctcctggagatgcagtcgaaggtggacttcctcatgccgtatcggcttctgctgtaccaagtcgagatttggcgctacctcatgaaggaccaggagaaggcgaagggcaagccgaagaccttccgactcccgcccatcgtcccgattgtcctgtacaacgggaagcgccgctggactgcgagccgccagttccgccagctcctagccaacgagaccatgttcgggagcgaactcctgaactttgagtacgtcctcattgatgtggcgcgttacacggaggaggaattacttgccctgtccaacacaatcggtagtgtgttcctgctggaccagacggccgaccaaaccgagcttctgaacaggctgggccaacttatgcacacgatacaacaactccccgaggatagccagcagcagcttatcgcctggatggcgaacatcctctcgcagaagctgccggagaacgagccgcagctaagggaattgatacagaacgtcaagggtggggtgtcagtcatggggctggagaagacactcgacgccatcaagagggaggggaggagggagggtcgaagggagggcctgcgtgagggaatccgggagggcaaacaggaggggatcagggagggcaaacaggaaggcaagcgggaggcgaaggaggaagtcgtcaagcacatgatctccgagaacctcgacccagagttgatcgcgcgggtcaccggcttctccctagacatcatagcacaactccgggaaaaaacgaagtga

SEQ ID NO: 2555 - DNA, 1056 bp, Unknown
  Paenibacillus lentimorbus (multi)
atggggactgagacggacgagcaccacacggtgcaccaccgccatgacacctcgtaccggttcctcctttcgtccaagaagctattcgtcgagctgctgcgctacttcgtccagaaggagtgggtcgagcggatcgacgagactaacgtccaggagattccgcattcgtttgtcctacaagatttcaagaggaaggaggccgacctcgtgtaccgcgtgaagctcaacggtcaagatgtcgtgttctatctcctcttagagatgcagagcaaggtggatttcctcatgccctaccgcctcctgctctaccaagtcgagatttggcgctacttgatgaaggaccaggaacaagctaagggcaaaccgaaaaccttccgcttgccgcccatcgtgcccatcgtgctctacaacggcaaacggcggtggacggcgaaccgccagttccggcaattgctcgctaacgagaccatgttcggcagtgagctgcttaacttcgagtacgtcctcatcgacgtagcgagatataccgaggaggagctactggccctcagcaacaccatcggaagcgtgttcctcctggaccagacggcggatcaggcggagctgttgaaccgcctgggcaagctgatgcacactattcaacaactccccgaagactcacagcaacagctagtggcctggatggccaatatcctctcgcagaagttgcctgaaaatgagccccagctacgcgagcttatccagaacgtcaagggcggcgtatccgtgatgggcctggagaagactctggacgcgattaagcgcgaagggcggcgggaaggacgccgtgagggtctgcgtgagggtctgcgcgagggtttgcgcgagggcatcctggaggggaagcaagagggcaagcgggagggcctcttggaaggcaaacaggaggggaaacgggaagcgaaggaggaggtcgtgaagcagatgatcgcggaaaacttagaccctgacctgatcgcgcgggtcaccggattcccgctggacatcatcacccagctccgggagaagtcccactga

SEQ ID NO: 2556 - DNA, 1056 bp, Unknown
  Paenibacillus lentimorbus (multi)
atgggaactgagaccgacgaacaccacacagtccaccaccggcacgacacctcgtaccgcttccttctctcctccaagaaattgttcgtggagctgctgcggtacttcgtgcagaaggagtgggtcgagcgcattgacgagacgaacgtccaggaaataccgcactcattcgttctccaagacttcaagcggaaggaggccgatctcgtatatcgcgtgaagctgaacgggcaagatgtcgtgttctacctgctgctggaaatgcagagcaaggtggatttcctgatgccgtaccgcctcctgctctaccaagtcgaaatctggcggtatctgatgaaggaccaggaacaggcgaagggaaagcctaagacgttccggctcccacctatcgtgccaatcgtcctgtacaatgggaagcggcgctggacggccaatcgccagttccgacaactgctcgctaatgagaccatgttcgggtcggagctgctcaacttcgagtacgtccttatcgacgttgcgcgttacaccgaggaggaactactcgccctgtccaacaccatcggcagcgtcttcctgctcgaccagaccgccgaccaggcagagcttctcaacagacttgggaagttgatgcacacgatccaacagttgccggaggacagccagcagcaactcgtcgcttggatggccaacatcctttcgcagaaactgcctgagaacgagccccagctcagggaactgatccaaaacgtgaagggaggagtgagcgtgatgggccttgagaaaacgttagacgcgatcaagcgtgagggacggcgcgagggacggcgggaggggcttcgggagggacttcgggaggggttgagggagggaatcctggagggcaagcaagagggcaagcgggagggactgcttgaggggaagcaagagggcaaacgggaggcgaaggaggaggtggtgaagcagatgattgcggagaacctcgacccggacctaattgctcgcgtcactgggtttcctctggacatcattacacaactacgagaaaagtcccattga

SEQ ID NO: 2557 - DNA, 1056 bp, Unknown
  Paenibacillus lentimorbus (multi)
atgggaacggagacggacgagcatcatacagtccaccaccgccacgatacctcgtaccgcttccttctctcctccaagaagctcttcgtcgagctgctccgatacttcgtgcagaaggagtgggtcgaacgcatcgacgagacgaacgtacaggagatcccgcacagcttcgttttacaggacttcaagcgcaaggaggcggatctcgtatatcgcgtgaagctcaacggtcaagatgtggtgttctatctgctcttggagatgcagtcaaaggtggacttcctgatgccctaccgactcctgctataccaagtcgagatttggcgctacctcatgaaggatcaggaacaagcgaaaggaaagccgaaaacgttccgactgccgccaattgtgcctatcgtcctctacaatggaaagcgccgctggacggccaaccgccagttccggcaattgctggccaacgagacaatgttcggcagtgagctgctgaacttcgagtatgtcctcattgacgtggcgcgctacactgaggaggagctgctcgcgctcagcaacaccatcggctccgttttcctcctggaccagacggccgaccaggccgaactgctcaatcggctggggaagctgatgcacaccatccaacagctccccgaagactcgcagcagcagttggtggcatggatggccaacatcctgtcgcagaagctcccggagaacgagccacaattgcgcgagctaatccagaacgtgaagggcggagtgtctgtaatggggctggagaaaacgctcgacgcgattaagcgcgaaggacggcgtgagggccgccgcgagggcttgcgggagggcctgcgtgagggactgcgggagggtattctggaagggaaacaagaggggaagcgggagggactcctggagggcaaacaggagggcaagcgggaggctaaagaggaagtggtgaagcagatgatcgcggagaacctagacccagacctgattgcccgagtcaccgggtttccattggacatcatcactcagttacgcgaaaagtcacactag

SEQ ID NO: 2558 - DNA, 1056 bp, Unknown
  Paenibacillus lentimorbus (multi)
atgggcaccgagaccgacgagcatcacaccgtccaccacagacacgacacgagctaccgtttcctcctgtccagcaagaaactgttcgtggagttgctccggtacttcgtccagaaggagtgggtcgagcggatcgacgaaacaaatgtccaggagattccacactcgttcgtgctccaagacttcaagcgcaaggaggccgatctcgtttatcgcgtcaagctcaacggacaagacgtggtgttctacctgctcctggagatgcagagcaaagtggacttcctgatgccgtaccgcctactgctctaccaagtcgagatatggcgctacctcatgaaggaccaagaacaggctaaaggcaaaccgaagaccttccgcctgccgcccatcgtcccgatagtgctgtacaacggcaaacggagatggaccgcgaacaggcagtttcgacaactcctcgcaaacgagacaatgttcggttcggagttgctcaacttcgagtacgtgctgatcgacgtcgccagatatacggaggaggagcttctggccttgtcgaacacgattggctcggtctttctgctggaccagacggccgaccaagccgagctgcttaaccggctgggcaagctcatgcacacgatccagcaattgcccgaggactctcagcagcagctagtcgcgtggatggccaacatcctcagtcagaagctgccagaaaacgagccccaactgcgcgagctgatccagaacgtgaagggcggcgtcagtgtgatgggtctggagaaaaccctggacgcgatcaagagggaaggtcgtagggaaggccgtagggagggcctgcgggaaggactgagggagggcctccgtgagggcatactggaggggaaacaggagggcaaaagggagggtctgttggagggcaaacaagagggaaagcgggaggcgaaggaggaagtggtcaagcagatgatcgcggaaaatcttgaccctgacctcatcgcacgggttacgggcttcccactagacataattacgcagttacgcgagaagtcgcactga

SEQ ID NO: 2559 - DNA, 1056 bp, Unknown
  Paenibacillus lentimorbus (multi)
atggggacagagaccgacgagcaccacaccgtacatcaccgccacgacacctcgtaccgctttctgctgagttccaaaaaactgttcgtcgagctgctccggtacttcgtccagaaggagtgggtggagcgcattgacgagacaaacgtccaggagataccgcacagcttcgtccttcaagacttcaagcggaaggaggcggatctcgtttaccgcgtcaagctaaacggccaggacgtcgtgttctacttgctgctggagatgcagagcaaggtggacttcctgatgccgtaccggttgctcctctaccaagtggagatatggcgctatctcatgaaggaccaggaacaagctaagggcaagccgaagactttccggctcccgcccatagtccccatcgtcctgtacaacgggaagcggcggtggaccgccaatcgccagttccgtcaattgttagctaatgagaccatgttcggctcggagttattgaacttcgagtacgtgctgattgatgtggcgcgttacaccgaggaggaactgttggcgctgtccaacaccattggctcagtcttcctactggaccagacggctgaccaggccgagcttctcaaccgcttgggcaaattgatgcacacgatccagcaactgccggaagactctcagcagcaacttgtcgcctggatggccaatatcctgtcgcagaagctgccggagaacgagccccagttgcgcgagttgatccagaacgtcaagggcggggtgtccgtgatgggccttgagaagacactggacgcgatcaagagggagggtcgccgcgaaggtcggcgggagggcctgagggagggccttcgggaaggtctgagggagggcatcttggaggggaaacaggaggggaaacgtgagggcctacttgaaggcaaacaggagggcaaacgtgaggcgaaggaggaggtggtcaagcagatgatcgcggagaacctggacccggacctgatcgcacgagtgaccggcttcccgctggacataattactcagctccgggagaaatcacactag

SEQ ID NO: 2560 - DNA, 978 bp, Unknown
  Paenibacillus thiaminolyticus (multi)
atgggcaccgagacggaggagcacaacacagtccaccaccggcacgacacgagctaccgcttcctcctctcctccaaaaaactgttcgtcgagctgctccggtcgttcgtgcaaaaggagtgggtcaagcggatagacgagacgaacgtacaggagatccctcattccttcgttctccaggacttcaagcggaaggaggccgatctcgtatatcgcgtgaagctgaacggtcaggacgtggtgttctacctgctgctcgaaatgcagagcaccgtggacttcctgatgccctaccggctgttgctctaccaagttgagatatggcgctacctgatgaaggaccaggagaaaactaagggcaaaccgaaagcgttccgcttaccaccaatcgtccccatcgtgctctacaacggcaagcggcgctggactgcaaaccgccagttcagacagttgctggctaacgagaccatgttcgggtcggagctgctcaacttcgaatacgtgctcattgacgtcgcgcgctacaccgaggaggaactcttggccctgtccaacaccatcggttcagtgttcctgctggaccagaccgaagaccagacggagctgctgaatcgcctcggcaagctcatgcacacgatccagcagatgcccgaggactcccaacaacagcttgtggcgtggatggccaacatcctgtcgcagaagctccctgaaaatgagccccatctccgcgaactgatccagaacgagaagggcggcgtgagcgtgatggggttggagaagacccttgacgcgatcaagcgcgagggaaggcgtgagggccgccgcgaggggaaacaggaaggcaagcgggaggcgaaggaggaggtcgtgcagcagatgatcgcggaaaaccttgaccccgaactgatcgcgcgcatcacaggctttagcctcgacataatcgcccaactccgcgagaagtctaaaagcaagtaa

SEQ ID NO: 2561 - DNA, 978 bp, Unknown
  Paenibacillus thiaminolyticus (multi)
atggggaccgagacggaggagcacaacacggtgcaccaccgccacgacaccagctaccggttcctcctcagctccaagaagctcttcgtcgaactgctccgctcgttcgtccagaaggaatgggtgaagcgcatcgacgagaccaacgtccaggaaatcccacacagcttcgtactccaagactttaagcgcaaggaggcggacctcgtgtaccgcgtcaaactcaacggacaagacgtcgtgttctacctgctcctggagatgcagtccaccgtggactttctcatgccctatcggttgctactctaccaagtcgagatttggcgatacctcatgaaggaccaggagaaaacaaaagggaaaccgaaagcgttcagactaccacccatcgttcccatcgttctctacaacggcaagcggcgttggaccgccaatcgccagttccggcagttactcgcaaatgagacgatgttcggctccgaactgctcaacttcgagtacgtgctcatcgacgtggctcgctacaccgaggaggagctgctcgccctaagcaacacaatcgggtcagtgttcctcctggaccagacagaggaccagaccgagctgctgaaccggttggggaagctcatgcacaccatccagcagatgcctgaggactcccagcaacagctagtggcttggatggcgaacatcctgagccagaagctgccggagaacgagccgcacctccgagaactcatccagaacgagaagggcggtgtgtccgtgatggggctggagaaaaccctcgacgccatcaagcgcgaggggaggcgcgaaggccgccgtgagggaaaacaggagggaaagcgcgaggctaaggaggaggtcgtccagcagatgatcgccgaaaacctcgacccagagctaattgcccgcatcaccggtttcagcctagacatcatcgcccagctcagggaaaagtctaagtcgaagtga

SEQ ID NO: 2562 - DNA, 978 bp, Unknown
  Paenibacillus thiaminolyticus (multi)
atgggcacggaaaccgaggagcacaacacagtgcaccaccgccacgacactagctaccggttcctgctctcctccaagaagctgttcgtggaactgctccggtccttcgtccagaaggagtgggtgaagcgcatcgacgagacaaatgtccaggagatacctcactcgttcgtccttcaagacttcaagcgcaaagaggcggacctcgtttaccgggtcaagctgaatggccaggatgtcgtgttctacctcctgctggagatgcagtccaccgttgactttctcatgccctaccgcctgctcctctaccaagtggagatatggcgttacctcatgaaggatcaggagaagacaaaaggcaaaccgaaagcgtttcggctgcctccaatcgtccctatcgtgctctacaatgggaagcggcgttggacggcgaaccgccagttccggcaactgctcgccaacgagacgatgttcgggtctgagctgctcaacttcgagtatgtcctcatcgacgttgcccgctatactgaggaggaacttctggccttgtcgaacaccattggctccgtcttcctcttagaccagaccgaggaccagacggaactgctcaaccgcctggggaagctcatgcacacgatacagcagatgccggaggacagccagcagcagcttgtggcctggatggcgaacatcttgtcccagaagctgccggagaacgagccacacctccgggagctgatccagaacgaaaagggaggcgtgagcgttatgggcctggagaaaacactcgacgcgatcaagagggagggtaggagggaaggccgacgcgagggcaagcaagagggcaagagggaggcgaaggaggaggttgtgcagcagatgatcgcggagaacctggacccagaactaatcgcgcggatcaccggcttctccctggacatcatcgcgcagttgcgggagaagtccaagtccaagtga

SEQ ID NO: 2563 - DNA, 978 bp, Unknown
  Paenibacillus thiaminolyticus (multi)
atgggcacggagacggaggagcacaacacggtgcaccaccgacacgacacaagctaccgcttcctgttaagcagcaaaaaactcttcgtggagctgctgcgctccttcgtccagaaggagtgggtgaagcgcatcgacgagaccaacgtccaggaaatcccgcacagcttcgtcctacaagacttcaagcggaaggaggcggatctagtgtaccgcgtgaagctcaacggacaagatgtcgtgttctacctcctcctggagatgcagagtacggtggactttctcatgccctatagactgctgctataccaagtcgagatatggcgataccttatgaaggaccaggagaaaacgaagggaaagccgaaggcgttccggctccctcccatagtccccatcgtgctctacaacggcaaacgccggtggaccgcgaaccggcagttccgtcaactcctggccaacgagacgatgttcgggtcggagctgctgaacttcgagtacgtgctcatcgacgtggcacgttacacggaggaggagctgctggcgctctcgaacaccatagggagcgtgttcctgctcgaccagaccgaggaccagaccgagcttctgaaccggctgggaaagctgatgcacacgatccagcagatgcccgaggactcgcagcagcagctagtggcgtggatggcgaacatcctgagccagaagctaccggagaacgagccccacctccgtgagctgatccagaacgagaagggcggtgtgtccgtcatgggattggagaagaccctcgacgcgattaagcgcgagggaagacgtgagggccgaagggagggcaaacaggagggcaagcgcgaagctaaggaggaggttgtgcaacagatgattgcggagaacctcgacccggagttgatcgcccgcatcaccgggttcagtctggacattatcgcacagttgcgtgagaaatccaagtccaagtag

SEQ ID NO: 2564 - DNA, 978 bp, Unknown
  Paenibacillus thiaminolyticus (multi)
atggggacagagaccgaggagcacaacacggtacatcaccggcacgatacctcgtaccgcttcctgctctccagcaaaaaactattcgtcgaactcctccggagtttcgtgcaaaaggagtgggtgaagcggatcgacgagacgaacgtccaggaaatcccgcactccttcgtgttgcaagactttaaacggaaggaggcggacctcgtttatcgcgtcaagctgaacggtcaagatgtagtattctatttgctactggagatgcagtccacagtggacttcctcatgccgtaccgcctgctcttgtaccaagtcgagatatggcgctacctcatgaaggaccaggagaaaacgaaggggaagccgaaagcctttcgcctgccgcccatcgtccccatagtgctgtacaacgggaaacggcggtggaccgccaaccggcagttccggcagctcttggccaacgagaccatgttcggctccgagcttctgaacttcgagtatgtactgatcgacgtggcccgctacacggaggaggagttactggcactcagcaacaccatcggcagcgtgttcctcctcgaccagacggaggaccagactgaacttctaaatcggctggggaagctgatgcacaccatccagcagatgccggaggactcacagcagcaactggtcgcctggatggccaacatactgtcgcagaagctgcccgagaatgagccgcacctccgggagctgatccagaacgagaagggaggcgtctcggttatgggcttggagaagaccctggacgcgatcaagcgtgagggccggagggagggaaggcgcgaagggaaacaggaaggcaagcgggaggcgaaggaggaggtggtccagcagatgatcgcggagaacctggaccctgaactgatcgcccgcatcacggggttcagtctggacatcattgctcagcttcgggagaagtccaagtccaagtag

SEQ ID NO: 2565 - DNA, 1020 bp, Unknown
  Paenibacillus thiaminolyticus (multi)
atggggacggagacggacgagcactgcacggtgcaccacaggcacgacacgagctaccggttcctgctctcgtccaagaaactcttcgtcgagctgctgcgctctttcgtacaaaaggaatgggtggaacggatcgacgagacgaatgtccaggaaataccgcacagtttcgtcctccaggacttccgtcgcaaggaggctgatctcgtctatcgcgtcaagctcaacggtcaggatgtggtgttctacctgctgctggagatgcaaagcaaggtggacttcctgatgccgtatcgactactgctataccaagtggaaatctggcgctacctcatgaaggatcaggagaaggctaacggcaagccgaagacgttccgccttcctcctattgtgcccatcgtgctgtacaacggcaagcgccggtggaccgcctctcggcagttccgacaattgcttgcaaacgagactatgttcgggtccgaactgctgaacttcgagtacgtgctgattgacgtggcccgctacacggaggaggagctactcgccctctccaacaccattggctctgtctttctgctcgaccagaccgccgaccaggccgagctgctcgacagactggggaaactgatgcacacgatccaacaactcccggaggatagccagcagcagttggtggcttggatggccaacatcctctcccagaagctcccggagaacgagccccagctccgagagctgattcagaatgtcaaaggtggagtgtctgtcatgggcctggagaaaacgctcgacgccatcaagcgcgagggcagacgtgaggggagacgcgaggggctgagacagggactccaggagggtatcagggagggcaagcgcgagggcctgctcgaaggcaagcgtgaggctatcgaggaggttgcaaaacaaatgattagcgaaaatctcgacccggagttgatcgcccgcgtgacgggcttcagtctggagataattactcagttaagggagaagtcccattag

SEQ ID NO: 2566 - DNA, 1020 bp, Unknown
  Paenibacillus thiaminolyticus (multi)
atgggcacggagactgacgagcactgcaccgtgcaccaccgccacgacacctcttaccgtttcctcctcagcagcaaaaagctcttcgtcgaactgttgcggtcgttcgtccaaaaggagtgggtcgagcgcatcgacgagacgaatgtccaggagataccgcactcgttcgtgctgcaagacttccgacgcaaggaggccgatctcgtgtaccgagttaagctcaatggccaagatgtcgtattctatctgttacttgagatgcagtcgaaggtggacttcctcatgccatacagactgttactctaccaagtggagatatggcgctatctgatgaaggaccaggaaaaggctaacgggaagccgaagacattccggctgccgcccatcgtgccaattgtgctgtacaacgggaagcgccgctggacggccagccgccaattcagacagctacttgccaacgagacgatgttcggttccgagttgctgaacttcgagtacgtcctcatcgacgtggcgagatatactgaggaggagctgttagctctgtcgaacaccatcgggtcggttttcctgttggaccagactgccgaccaggctgaactgctggaccgcctggggaagctgatgcacacgatccagcaactgccggaggactcgcagcaacaattggtagcctggatggccaacattctgagccagaagctacctgagaacgagccccaattgcgcgagctgattcagaacgtcaagggcggggtgtccgtgatgggcctggagaagactctcgacgccatcaagcgggagggacggagggagggacgccgcgagggactgcgccagggcctccaagaggggatcagggagggcaagagggagggcctgcttgagggcaagcgtgaggccatcgaggaggtggccaagcaaatgataagtgagaatctggacccggaactaatcgccagggtcactggcttctcgctggaaatcatcacgcagctaagggagaagtcgcactga

SEQ ID NO: 2567 - DNA, 1020 bp, Unknown
  Paenibacillus thiaminolyticus (multi)
atgggcaccgagaccgatgagcattgcacggtgcaccaccggcacgatacctcctaccgcttcctcctctcctccaaaaagttgttcgtcgagctactccgctccttcgttcagaaggagtgggtcgaacggatcgacgagaccaacgtccaggaaataccacattcgttcgttctccaggacttccggcggaaggaggccgatctggtctatcgcgtgaagctcaatggtcaggatgtcgtattctacctgctcttagagatgcagagcaaggtggacttcctgatgccgtaccgtctcctactgtaccaagtggagatatggcgctacctgatgaaggaccaggagaaggcgaacgggaagcccaagacgtttcgcctgccgcctatagtgcccatcgtactctacaacggcaaacgtcgctggaccgcctccagacagttcagacagttgctggcaaacgagacgatgttcggctctgaacttctcaacttcgagtacgtcctaatcgacgtggcgcgatataccgaggaggaactcttggcactaagcaataccatcggctccgtcttcctgctggaccagaccgccgaccaggctgagctgctcgacaggctcggcaaactcatgcacaccatccaacagctcccggaggacagccagcagcagcttgtcgcctggatggcgaacatactttcgcagaagctgcctgagaacgagccccagctccgggaattgatccagaatgtgaaaggcggagtgagcgtcatgggcctggagaagactctcgacgccatcaagagggagggacggagggaggggcggagggagggcctacgtcaaggactccaggaagggattcgggagggcaaacgtgagggattgctggaagggaagcgcgaggcaatcgaggaggtggccaagcagatgatctccgagaacctggaccccgaactgatcgcccgcgtgaccgggttctcgttggaaatcatcacccagttgcgcgagaagtcgcattag

SEQ ID NO: 2568 - DNA, 1020 bp, Unknown
  Paenibacillus thiaminolyticus (multi)
atggggacggaaaccgacgagcactgcacggtgcaccatcgccacgacaccagctaccgcttcctgctcagctccaaaaagctgttcgtggagcttctgcggagcttcgtgcagaaggagtgggtggagcggatcgacgagacaaacgtccaggagatcccgcacagcttcgtcctgcaagatttcagacgaaaggaggccgacctcgtatatcgcgtgaaactcaatggccaagacgtcgtattctatttgctccttgagatgcagtctaaggtggacttcctgatgccctaccggttgctcctgtaccaagtcgaaatctggcgctacctcatgaaggaccaggaaaaggcgaacgggaagcccaagaccttccgtctgccgccgattgtccctatcgtcctgtacaacgggaagcggcgatggaccgcctcccggcagttccggcaactactggcaaatgagacgatgttcggttcggaattgctgaactttgaatacgtcctgattgacgtggcccgttacacggaggaggagttacttgcactctcgaacaccattggcagtgtgttcctgcttgaccagacagccgatcaggcagaactcctcgaccgtctcgggaagctcatgcacacaatccagcagctaccggaggactcccagcaacaattggtcgcgtggatggccaacatcctttcgcagaagctgcccgagaacgagccccagctccgtgaactcatccagaacgttaagggtggggtgtccgtcatgggcctggagaagacgctggacgcgatcaagcgtgaggggcgtcgggagggccgtcgggagggcctgcgtcagggcttgcaagagggcatccgggaagggaagcgcgaagggctgcttgaaggcaagcgcgaagccattgaggaagtcgccaagcaaatgataagtgaaaaccttgatcccgagctgatcgcccgcgtgacaggcttctcactggagatcataacgcaactgcgcgagaagtcccactga

SEQ ID NO: 2569 - DNA, 1020 bp, Unknown
  Paenibacillus thiaminolyticus (multi)
atgggcacagagaccgatgagcactgcacggtgcaccaccgtcacgacacttcgtatcgctttctcctcagcagcaagaaactcttcgtggagctgctgcggtcgttcgtgcaaaaggagtgggttgagcggatcgacgagaccaacgtacaggaaatccctcattcgttcgttctccaagactttcggcggaaggaggccgacctcgtgtaccgagtcaaattgaatggccaggacgtcgtgttctacctcctgctggagatgcagagcaaggtggacttccttatgccgtatcggctcttactgtaccaagtggaaatctggcgctacctgatgaaggaccaggagaaggcaaacgggaagcccaaaacctttcgactgccacccatcgtgcccatagtcctctacaacggcaagcggcgctggactgcctcccgtcagttccgtcagctcttggccaatgagacgatgttcgggtcggagctactgaacttcgagtatgtgctgatcgacgtcgcgcgctacaccgaggaggaactcctcgccctgtcaaataccattgggtccgtctttctgctggatcagaccgccgaccaggcggaactgcttgaccgtctcggcaagctcatgcacacaatccaacagctcccagaggactcccagcaacaactggtggcctggatggccaacatcctgtcccagaagctccccgagaacgagccccaactccgagagctgatacagaacgtcaaaggcggggtgagcgtcatgggcctggagaaaactctcgacgccattaagcgcgagggccgtagggaaggtcggagggagggcctccgtcagggccttcaagagggtatcagggagggcaagcgcgagggcctccttgagggcaagcgggaggcaattgaggaagtggctaagcaaatgatctcagaaaacctcgatcccgagctgattgcccgtgtgactgggttctcgctggagataatcacccaactgcgtgaaaagtcccactag

SEQ ID NO: 2570 - DNA, 1044 bp, Unknown
  Paenibacillus thiaminolyticus (multi)
atgggcacagagaccgacgagcaccatactgtccaccaccgccacgacaccagctacagattcctcctctcctccaaaaagctcttcgtcgaactgctgcgctccttcgtgcagaaggagtgggtcgagcgcattgatgagaccaacgtccaggagatcccgcacagcttcgttctccaagatttcaagcggaaggaggccgatctcgtgtaccgcgtgaaggtcaacggccaggatgtcgtgttctatctcctccttgagatgcagagcaaggtggacttcctcatgccgtaccggctcctgctctaccaagtggaaatctggcgttacctcatgaaggaccaggagaaggcaaagggaaagccgaagaccttccgactgccgccaatagtgccgatagtcctctacaacgggaagcggaggtggacggcctcccggcaatttcggcagctactggcaaacgagaccatgttcggctccgaactactgaatttcgagtacgtcctcattgacgtcgcacgatatacagaggaggaactactagcgctctcgaataccatcggcagcgtgttcctgctcgaccagaccgccgaccaggcagaactccttgaccgcttgggcaagctcatgcacaccatccagcagttgccggaggactcccaacaacaactgatcgcttggatggcgaacatcctctctcagaagctgcccgaaaacgagccacaactgcgggaactgatccagaacgtgaagggcggtgtctcggtcatgggcctggagaagacgctggacgcgattaagcgtgagggccgtcgggagggtaggcgtgaagggctgagacagggcctccaggagggtatccgggaaggaatccgggagggcatccgtgagggactgcttgagggcaaacaggagggaaaacgggaggcaaaggaggaggtggcgaagcagatgataagtgaaaatctcgacccagaactgatcgcccgcgtaaccggcttctccctagacattatcgcccagctccgggaaaagtcgaactag

SEQ ID NO: 2571 - DNA, 1044 bp, Unknown
  Paenibacillus thiaminolyticus (multi)
atggggaccgagaccgacgagcaccacacggtgcaccaccgtcacgacacctcgtaccgcttcctgctctccagcaagaagctcttcgtggagcttctgcggtcgttcgtgcagaaggagtgggtggagcggattgacgagacgaacgtccaggagatcccgcacagcttcgtgctccaggacttcaagcggaaggaggccgacctcgtttaccgtgtcaaggtcaacggccaagacgtcgtgttctacctcctcttggaaatgcagtctaaggtggatttcctgatgccgtaccgcctactcctgtaccaagtcgagatttggcgctacctcatgaaggaccaggagaaggcgaagggcaagcccaagaccttccggttgccacctattgtaccaatcgtgctgtacaacggcaagcggcgatggaccgcctcaagacaattcagacagctcttggcaaatgagaccatgttcgggtccgagctgctcaacttcgagtatgtcctcatcgacgtcgcccgctacaccgaggaggagttgcttgctctcagcaacacaattggcagcgtgttcctactggaccaaacggccgaccaggccgaactgttggacaggctcggcaaactcatgcacactatccaacaactgccagaggactcccagcaacaacttatcgcgtggatggccaacattctgtcccagaagctgccggagaacgagccacagcttcgagagctgatccagaacgtgaagggtggcgtctcggtcatgggcctggagaaaacgctggacgccatcaagcgcgaggggcggcgcgagggaagacgggaaggcttgcgccagggccttcaagagggaatcagggagggaatacgggaggggatacgggagggcctcttggaggggaagcaagagggcaagcgggaggcgaaggaggaagtcgctaagcaaatgatctccgaaaacctagatcccgaactcatagcgcgtgtgactggcttcagcctggacatcattgcccagctaagggaaaagtcgaactga

SEQ ID NO: 2572 - DNA, 1044 bp, Unknown
  Paenibacillus thiaminolyticus (multi)
atggggacggagaccgacgagcaccacaccgttcaccaccgccacgacacgagctaccggttcttgctgtcgtccaaaaagctgttcgtggagctgctgaggtcattcgtccagaaggagtgggtggagcggattgacgagaccaacgtccaggaaattccccattcgttcgtcctccaagacttcaagcgaaaggaggccgacctcgtttaccgtgtcaaggtcaacggccaggacgtcgtgttctacctactcctggaaatgcagtcgaaggtggacttcctcatgccttaccgcttgctgctgtaccaagttgagatatggcgttatctcatgaaggaccaggagaaggcgaaagggaagcccaagactttccgcttgccgccaatcgtccccatcgtcctttacaacgggaagcgtcgctggaccgccagtcgccagttccggcaactgctggcaaacgagactatgttcggctcggaactactcaacttcgagtacgtcctgatcgacgtcgcccgctacacggaggaggaacttctggccctctccaacaccatcgggtccgtcttcctgctagatcagacagcggaccaggcggaactactagacaggctggggaagctgatgcacactattcaacagctccccgaggatagtcagcagcaactgatcgcctggatggccaacatcctctctcagaagctgccggaaaacgagccccagctacgggagctaatccagaacgtgaagggcggcgtctccgtgatgggccttgagaagacgttagatgctatcaagcgggagggtcgtagggagggccgccgcgaggggctcagacaggggctacaggaggggatacgggagggcatcagggagggaatacgcgaaggtctgttagagggcaagcaagagggcaagcgtgaggcgaaggaggaggtggctaaacagatgatctctgaaaacttagaccctgagctgatcgcgcgggtcaccgggttctccctggacatcattgcccagctccgggagaagtcgaactga

SEQ ID NO: 2573 - DNA, 1044 bp, Unknown
  Paenibacillus thiaminolyticus (multi)
atgggcactgagactgacgagcaccacaccgtgcaccaccgccacgacacttcataccggttcctcctctcatccaagaagctcttcgtggagctgctgcggagcttcgtccagaaggagtgggtcgagcgcatcgacgagacaaacgtccaggaaatcccgcacagcttcgtcctccaggacttcaagcggaaagaggcggacctcgtttaccgcgttaaggtgaacggtcaggacgtggtgttctatctgctccttgaaatgcagtcgaaggtggacttcctcatgccgtacaggctgctactttaccaagtggagatatggcgatacctcatgaaggatcaggaaaaggcgaagggcaaaccgaaaaccttccggcttcctcctatagtgcccatagtcctctacaatgggaagcggcggtggaccgcgagccgccagttccggcagctcctcgcaaacgaaacgatgttcggcagcgaactcttgaacttcgagtacgtcctcatcgacgtggctcgctacaccgaggaggaattgctcgcgctgtccaacactatcggctccgtgttcctgctggaccagacggcagaccaagccgagctgctcgaccgactcggcaaactcatgcacacgatacaacaattacccgaagactcccaacaacaattgatcgcctggatggcgaacattctctcgcagaagctccctgaaaacgagccccagctccgcgagcttatccagaacgtcaaaggtggggtgtcggtgatgggcctggagaagactctcgacgccatcaagcgggaggggaggcgggagggccggagggaaggcttgcgacagggcctccaggagggcatccgggagggaatcagggagggcatacgggaggggctcttagagggcaaacaggaaggaaagcgtgaggcgaaggaggaggttgccaagcagatgattagcgagaacctcgacccggagttgatcgcgcgcgttacggggttctcactggacatcatcgctcagctcagggagaaatccaactga

SEQ ID NO: 2574 - DNA, 1044 bp, Unknown
  Paenibacillus thiaminolyticus (multi)
atgggaaccgaaacggacgagcaccacacggtgcaccaccgccatgacacgagctacagattcctgctctcctccaaaaagctgttcgtcgagttactgcgctccttcgtgcagaaggagtgggtggagcggatcgacgagacgaacgtccaggaaataccgcattcgttcgttctccaggacttcaagcgcaaagaggcagacttggtgtaccgggttaaggtgaacggtcaagacgtcgtgttctacttgctcctcgaaatgcagtcaaaggtggatttcctcatgccgtaccggttgctgctctatcaagtagagatttggcgttacctgatgaaggatcaggagaaggctaagggaaagccgaaaacgttccgcctccctccaatcgtccccatagtgctctacaacggcaagcgccggtggaccgcctcgcgtcagttcagacagcttctcgctaatgagaccatgttcggcagtgaactcctcaacttcgagtacgtcctcatcgacgtggcgcgatatacggaggaggagcttctcgctctgagcaacaccatcggctcagtcttccttctggaccagaccgccgaccaggcagagcttctcgaccgtctgggcaagctcatgcacacgatacaacaactgcccgaggacagccagcagcagctcatagcgtggatggcgaacatcctcagccagaagttgcccgaaaacgagccccagctccgtgaacttatccagaatgtcaagggaggggtgagcgtgatgggactggagaagactctggacgccatcaagcgcgaagggaggcgtgagggccggagggaggggctcagacaggggctccaggagggcatcagggagggcatccgcgagggcatccgtgaggggctgctggagggcaaacaggaggggaagcgcgaggcgaaggaggaggtggctaagcagatgatctccgaaaacctcgacccggaacttattgccagagtgacgggcttctccctggacatcatcgcccagctccgtgagaagtcaaactag

SEQ ID NO: 2575 - DNA, 1056 bp, Paenibacillus terrae
atggggacggagacagacgaacaccacaccgtgcaccaccggcatgacacatcgtaccgcttcctgctgtcgtccaagaagctcttcgtggagctgttgcggtctttcgttcagaaggagtgggtggagcggattgatgagaccaatgtccaggagatcccgcacagcttcgtgctccaggacttcaagaggaaggaagccgatctcgtttaccgcgtgaagctcaacggccaggatgtcgtgttctacctcctactggaaatgcagtcgaaagtggacttccttatgccataccggctgctcttgtaccaagtcgagatatggcgctacctcatgaaggaccaggagaaggcgaagggcaagcctaaaacgttccggctgccaccaatcgtgccgattgtgctctacaacggcaagaggcgctggaccgcatctcggcagttccggcagcttctagcaaatgagaccatgttcggcagcgaactgctgaacttcgagtacgtgctcatcgacgttgcccgttacaccgaggaggagttgctggcgctctccaacactattgggagcgtgttcttgcttgaccagacggccgatcaggcggagctgctcgaccggctcggcaaactcatgcacaccattcagcaactgcccgaggactcgcaacagcagttggtcgcctggatggccaacatcctctcacaaaagctgcccgaaaacgagccgcagctccacgaactcattcagaacgtgaaaggcggagtcagcgtcatggggttggagaagaccctcgacgcgatcaagcgcgaggggcggcgggagggaaggagggagggcctgcgccagggcctacaggagggaatacgggaggggataagggaggggataagggaggggaaacgggagggtctgctggaggggaaacaggagggaaaacgtgaggcgaaggaggaagtcgcaaagcagatgatctccgaaaatctcgacccagaactgattgcccgcgtcacaggcttctccctagacatcatcgcccaactgcgggagaagtcgaagtga

SEQ ID NO: 2576 - DNA, 1056 bp, Paenibacillus terrae
atgggcaccgagactgacgagcaccacaccgtccaccatcgccacgacacctcctaccgcttcctactgtcgtccaagaaactattcgtggagcttctccgcagcttcgtgcaaaaggagtgggtggagcgcatcgacgagacgaacgtccaggaaatcccgcactccttcgtgctccaggactttaagcgcaaggaggctgacctcgtttaccgggtcaagctcaacggtcaagatgtcgtgttctatctcctgctggagatgcagagcaaggtggacttccttatgccctaccgcctgctcctgtaccaagtggagatatggcggtatctcatgaaggatcaggagaaggctaagggcaagccgaaaacgttccgcctgccgcctatcgtgccaatagtgctctacaacggcaaacgtcgctggaccgcctcccggcagttccggcagctcttggccaacgagacgatgttcggcagtgagctattgaacttcgagtacgtgctcattgacgtggcacgctacacagaggaggaattgttagccctgtccaacaccataggctccgtcttcctcttggaccagaccgccgatcaagcagagcttctcgaccggctcggcaagctaatgcacaccatccagcagctcccagaggactctcagcagcaactggtcgcgtggatggccaacatcctcagccagaaactccctgaaaatgagccacagcttcacgagttgatccagaacgttaaaggcggggtttcggtcatggggcttgagaaaaccctcgacgcgatcaagcgtgagggtcggcgtgagggacggagggaggggctccgacagggattacaggagggcatacgcgaagggattcgggagggtatccgcgaggggaagcgcgagggccttctggaaggcaagcaagagggcaagagggaggcgaaggaggaagtggcgaagcagatgattagcgagaatcttgacccggaactcatcgcccgcgttaccgggttcagtctggacatcatagcccaactcagggagaagtccaagtga

SEQ ID NO: 2577 - DNA, 1056 bp, Paenibacillus terrae
atgggcaccgagaccgacgagcaccacacggtacatcaccggcacgatacctcctaccggttcctactctcgtccaaaaaactgttcgtggaactcctccgctcgttcgtccagaaggagtgggtggagcgaatcgacgagaccaacgtccaggagattccgcacagcttcgttctacaggacttcaaacgcaaagaggcggatctcgtttaccgggtcaagctcaacggtcaagacgtggtgttctacctccttctcgaaatgcagtccaaagtggacttcctcatgccgtaccgcctgctcctctaccaagttgagatttggcgctatctgatgaaggaccaggaaaaggcaaaagggaaacccaagactttccggctgccgcctattgtgcccattgtgctgtacaacggcaagaggcggtggacggcaagccgccaatttcggcagttactcgccaacgagacgatgttcgggtcggagttgcttaacttcgagtacgtcctgatcgacgtcgcacgctacacagaggaggagctactcgccctgagcaacaccatcggaagtgtgttcctgttggaccagacagcggaccaggcagagctactcgatagacttggcaaactcatgcacaccatccagcagctcccggaggacagccagcagcagctcgtcgcgtggatggccaatatcctcagccagaagctccctgagaacgagcctcaactgcacgagctgatccagaacgtgaagggcggcgtcagtgtcatggggttggagaagaccctggacgcgattaagcgcgagggacggcgggagggcagaagggagggactccgccaggggttacaggagggcattcgggagggtatccgcgaagggatacgggagggcaaacgggagggcctacttgagggcaaacaggaggggaagcgcgaggcaaaggaggaagttgctaagcagatgatctccgagaacctggacccagagctgatcgcgcgcgttacgggcttctccctagacataatcgcccagctccgggagaaatctaaatga

SEQ ID NO: 2578 - DNA, 1056 bp, Paenibacillus terrae
atgggcacagagacggacgagcaccacactgtgcaccaccggcatgacacatcttacagattccttctctcctccaagaagctgttcgttgagctgctgcgctccttcgtgcagaaggagtgggtcgagcgcattgacgagaccaacgtccaggagattccgcactcgttcgtccttcaagacttcaagaggaaggaggccgatctcgtttaccgcgtcaagctcaatggccaggacgtcgtgttctacctcctcctggagatgcagagtaaagtggacttcctcatgccgtaccgcctgttgctgtaccaagtcgagatatggcgctatcttatgaaggatcaggagaaggcgaagggcaagcctaagaccttccggcttcctcctatagtacccatcgtgctctacaacggcaagcgccggtggacagcctcccgccaattccgtcagctactggccaacgagaccatgttcgggtccgaactgctgaatttcgagtacgtcctcatcgacgtggcgcgctacaccgaggaggagttgctcgcgctgagtaacaccattggcagcgtctttctcctcgaccagacggctgaccaggcagaactgctggaccgtcttgggaagctgatgcacaccatccagcagctcccagaggactcccagcagcagttggtggcatggatggcgaacatcctctcgcagaagctgcccgagaacgagccgcaactacacgagctgattcagaacgtgaaaggcggcgtgtccgtgatgggacttgaaaaaacactcgacgccattaagcgcgagggacgtcgggagggaagacgggagggcctgcgtcagggactccaggagggcatccgcgagggcatccgcgagggaatccgggagggcaaacgcgagggactgcttgagggcaaacaggagggcaaacgcgaagcaaaggaggaagtggctaagcagatgatctcggagaacctggaccctgaactgatcgcacgagtaaccgggttcagcctggacatcatcgcccaacttcgggagaagtctaagtag

SEQ ID NO: 2579 - DNA, 1056 bp, Paenibacillus terrae
atgggcacggagacggacgaacaccacaccgtccaccatcggcacgacacgagctaccgtttcctcctgtcgtccaaaaaactcttcgtcgagctgctgcgctctttcgtccagaaggaatgggtcgaacggatagacgagaccaatgtccaggagatccctcactcgttcgtcctccaggacttcaagcgcaaggaggcggacctcgtttaccgggtcaagctcaacgggcaagatgtcgtgttctacctacttctggaaatgcagtcaaaagttgacttccttatgccctaccgcctgctgctctaccaagtggagatttggcgttacctcatgaaggatcaggagaaggctaagggcaagcccaagacgtttagactcccacctattgttcccatcgtgctgtacaacggcaagcggcggtggacggcctcgcgccaattcagacagttattggccaacgaaaccatgttcggctccgagctactgaacttcgaatatgtccttatcgacgtggcgcgctacaccgaggaggagttacttgcactgtccaacactatcggctccgtcttccttctggaccagaccgcagaccaggcggagctgctcgaccgtcttggcaaattgatgcacaccatccagcaactcccagaggactcccaacagcagttggtggcctggatggcgaacatcctctctcagaagctgccggagaacgagcctcagctccacgagctgatccagaacgtcaaaggcggtgtgagcgtcatgggcctggagaagacactcgacgccatcaagcgggaggggcgtagggaggggaggcgcgagggcctgcgacaggggttacaggaggggatcagggaggggatacgggagggcatcagggagggcaagagggaggggctcttggaggggaaacaggaggggaaacgggaggcgaaggaggaagtggccaaacagatgatctcagaaaacctggaccccgagctgatcgcccgcgtgacggggttcagcctcgacatcatcgcacagcttcgggagaagtccaagtga

SEQ ID NO: 2580 - DNA, 942 bp, Unknown
  Paenibacillus thiaminolyticus (multi)
atggggaaggagtcggacgagcacaacacgatacactaccggcacgacacctcctaccgtttcctgctcagcagcaagaagctcttcgtcgagctgctgcggagcttcgtccagaaggagtgggtcgaacgcatcgacgagactaacgtacaggaaataccccacagcttcgtgcttcaagatttcaagcggaaggaggcagacctagtgtaccgcgtcaagctcaacggccaggatgtcgtgttctacctcctccttgagatgcaatcgaaggtggacttccttatgccttaccggcttctcctctaccaagtggagatttggcgctacctcatgaaggaccaggagaccgtgaaggggaagccgaaaacctttcgccttccgcccatcgtgccgattgtactgtacaatgggaagcggcgatggaccgcctcgcgccagtttcgccagttgctcgccaacgagacaatgttcggcagcgaactcctcaacttcgagtacgtgctcatcgacgttgcccgctacactgaggaggagctgctcgccctttcgaacacgattggcagcgtgttcctgctggaccagacagcggaccagaccgaactgctcaaccgcctcggaaaactgatgcacaccatccaacaacttcccgaggactcgcagcagcagctcgtcgcctggatggccaacatcttgtcgcagaagctgcccgagaacgagccgcagctccgggagctgatccagaatgtcaagggaggcgtgagcgtgatgggcctggagaagacgctcgatgccatcaagagggagggccgtcgggagggcaaaagggaggcgaaggaggaggtcgtgaagcagatgctcgccgaggacttggagcctgaacttattgcgcgcgtgaccggcttcagcctggaaatgattacacaattgcgggagcagtag

SEQ ID NO: 2581 - DNA, 942 bp, Unknown
  Paenibacillus thiaminolyticus (multi)
atgggcaaggagtcggacgagcacaacacgatacactacaggcacgacacctcgtaccggttcctcctgtcgtccaagaagctgttcgtcgagctgctgcggtccttcgtgcagaaggaatgggtggagcgcatcgacgagacgaacgtccaggagattccacattcgttcgtcctccaagacttcaagcggaaggaggccgatctcgtttaccgcgtcaagttgaacgggcaagatgtcgtgttctacctgctcttggagatgcagagtaaagttgacttcctgatgccctaccgcctgctcctctaccaagtggagatatggcgttatctgatgaaggaccaggagacggtgaaggggaagccaaagacgttccgcctcccgccgatagtccccatagtgctctacaacggaaagcgtcgctggacggcctccagacagtttagacagttactcgccaacgagaccatgttcggctcggagctgctcaacttcgaatatgtgctaatcgacgtggcccgctacacggaggaggagcttctcgccctaagcaacaccatcgggagcgtgttcctcctggaccaaaccgccgatcagactgagcttctcaaccggctcgggaagctcatgcacaccatccaacagctccccgaagacagccagcagcagctcgtggcctggatggccaacatcctgtcccaaaagttgcccgagaacgagcctcagttacgggaactgatccagaacgttaagggcggggtgagcgtgatggggttggagaaaactctcgacgctattaagcgtgaggggcggcgtgaaggcaagcgcgaggctaaggaggaggtggtcaaacagatgctggccgaagacctcgaacccgagcttatcgcgcgggttacgggcttctcgcttgagatgataacccagctccgggagcagtga

SEQ ID NO: 2582 - DNA, 942 bp, Unknown
  Paenibacillus thiaminolyticus (multi)
atggggaaggagagcgacgagcacaacacgatccactaccgccacgatacctcctaccgattcctgctctcgtccaagaaactgttcgtcgaactgctgcggtcgttcgttcagaaggagtgggtcgaacggatcgacgagacgaacgtccaggaaattcctcactcgttcgtgctccaagactttaagcgcaaggaagcggatctcgtatatcgcgttaagctgaacggacaggacgtggtgttctacctgttactggagatgcagtcaaaggtggacttcctcatgccataccgactgctgctgtaccaagtggaaatctggcgctatctcatgaaggaccaggagaccgtgaagggcaagccgaagactttccggctcccgcccatcgtcccaatagtcctctacaacggcaaacgtagatggactgcttcccggcagtttcggcaactgttggcgaacgagacaatgttcggctctgagttactaaacttcgagtacgtcctgatcgacgtcgcgcgctataccgaggaggagttgctcgccctctccaacaccatcggcagcgtgttcctgctcgaccagacggcggaccagaccgagttgctgaaccgcctgggcaagctcatgcacacgatccagcagctcccggaggactcacaacagcagttggtcgcctggatggcgaacattctgagccagaagctccccgagaacgagccccagctccgcgagttgatccagaacgtaaagggcggggtgtcggtgatggggcttgagaaaacactggacgcgatcaagcgcgaggggcggcgggagggcaagcgggaagccaaagaggaggtcgtcaagcagatgctggccgaggacttagagcccgagctgatcgctcgtgtgaccggcttctcccttgagatgataacccagctcagagagcagtga

SEQ ID NO: 2583 - DNA, 942 bp, Unknown
  Paenibacillus thiaminolyticus (multi)
atgggcaaggagtccgacgagcacaacactatccactaccgccacgatacctcctaccgctttctccttagctccaagaaactcttcgtggaactgctgcggtcattcgtgcagaaggagtgggtggagcgcatcgacgagaccaacgtccaggagatccctcactcgttcgtcctccaggactttaaacgcaaggaagcggacctcgtgtaccgcgtgaagctgaacggccaggacgtcgtgttctatctcctgctggagatgcagagcaaggtggactttctcatgccgtaccgcttgctcctgtaccaagtcgaaatctggcgctaccttatgaaggaccaggaaactgtcaaaggcaagccaaagacgttccggctgcctcccatcgtccccatcgtcctctacaacggcaagaggcgttggacagcctcccgccagttccggcaattgttagcgaacgagaccatgttcggctcggagttactcaacttcgagtacgtcctgatcgacgtggcccgatacactgaggaggaattactcgccctttcgaacaccatcggttcggtcttccttttagaccagaccgccgaccagacggaactgctcaacagactgggcaagctcatgcacaccattcagcagcttcctgaggactcacagcaacagctagtagcatggatggccaacatcttaagtcagaagctccccgagaacgagccccagttgcgcgaactaatccagaacgtcaagggcggcgtgtctgtgatgggcctggagaaaacgctcgacgcgatcaagcgggagggacggcgcgaagggaagcgggaggctaaggaggaggtggtgaagcagatgctggccgaggatctggagccagagctgatcgcccgcgtgaccggcttcagcctggagatgataacacagctccgggagcagtga

SEQ ID NO: 2584 - DNA, 942 bp, Unknown
  Paenibacillus thiaminolyticus (multi)
atggggaaggagagcgacgagcacaacaccatccactaccgtcacgacaccagctaccgctttctcctgtcgtccaagaagctgttcgtggagctgctccgctccttcgtccaaaaggagtgggtggagcgcatcgacgagaccaacgtccaggagatcccgcactcattcgtactccaagacttcaagcggaaggaggccgacctcgtgtaccgggtcaagctgaacggccaagatgtcgtattctacctcctcctcgaaatgcagagcaaagtggacttcctgatgccctaccgcctcttgctctaccaagtggagatatggcgctacctcatgaaggaccaggagactgtgaaggggaagccgaagacgttccgcctgccgccgattgtccctattgtgctctacaacggcaagcggcgctggaccgcatcacggcagttccggcagctccttgctaacgagacgatgttcggctctgaactgctcaacttcgagtacgtgctaatcgacgtcgcgcgctatacggaggaggaactgctggcacttagcaacaccatcggttcagtgttcctgctcgaccagacggccgaccaaaccgaactactcaacaggctgggcaagctgatgcacaccatccagcaactccccgaggactcccagcagcagttggtcgcctggatggcgaacatcctgtcgcaaaagttgccggaaaatgagcctcaactaagggaactgatccagaacgtcaagggcggggtgtctgtcatgggccttgaaaaaacgctggacgctattaagcgcgaaggccgccgcgagggaaagcgggaggcgaaggaggaggtcgtgaagcaaatgctggccgaggatcttgagcccgagctaatcgcgcgggtgacggggttctcgctggaaatgattactcagctcagggaacaatga

SEQ ID NO: 2585 - DNA, 1299 bp, Unknown
  Paenibacillus thiaminolyticus (multi)
atgaagcacaagctaaagcagaagcagaaccagcgcatcacccgcattaccgactcgaccctggtcgttggggcggacattgccaagaagattcatgtcgctagggcggtggactttcgcggaatcgaactgggaaaggactgcgtgttcccgaacgaccaacaagggctgaccaagctgacaacctggatgaaggagcttgggcaagcacactccaagacggacatcgtgttcggcatcgagcccacgggtcactactggttcccgctggcggcgtacctccacgcacaggggattcaaatcgtcgtagtcaatccgcatcatgtcaacaagagcaaagagttggaggacaacagccaaacaaagagtgactacaaagacgccaaagtgatcgcggacctcatcaggaacggcaagtacagcgagccaaagttacccacgaaggaatacgcggacctacggatactcatgaacctgcgcgaaaaggtgtccgcctcgctcactcaagtaaagggccgtatcggccactggttcgaccgctttttccctgagtacagcaccgtctgcaaagactgggacggcaagaccagcctcatgaccatgaggagcttccctcttccttccgatatagtgtcgaagtcagcgcgcgaggtgctggcccattggaagaccgaggtcaagcgcggggtcgggatcaagcgggccgagaaactggtcgctgctgccgccgcatctatcggccttacagaggggtcggcagccgctcggatcgagctgagcaccctgctcggccagtttgagttattcagagagcaactggaagggatcatgaaggaggtcacacagatcctggagaacattcccggagcagaacacatgctctccgtgcctggagtgggcacggtgaccgtggcggggttcctcgcggaggtcggcgacctgtccaactacgatcacggccagcaaatcatccgcctcgctggcttgaacctcaaggaaaactcgtctggcaaaaggaaaggcaaaacgggcatcagcaagaggggtcgctctaggctaagggccctgctcttccgcgctgtgatgccaatggtggccaagaatgaggcgtttaaaaccctgcacaagcactacacaaaccgctcgcagaatccgctcaaaaagaagcaaagcctaatcgcgctgtgcggcaagctgatccgcgtcctgcacacgctcgggaccaagcaacgcgcctacaatgcagacgagatgctgggtccggtgcgccaatcccagatgcagctagaggcggcctag

SEQ ID NO: 2586 - DNA, 1299 bp, Unknown
  Paenibacillus thiaminolyticus (multi)
atgaagcacaagctcaaacagaagcagaaccagcgcatcacgcggatcaccgactccacgctcgtggtcggcgcggacattgccaaaaaaatccatgtggcaagagccgtggactttcgtgggatagagctggggaaagactgcgtgttccccaacgaccaacaggggctgacaaaactgactacctggatgaaggagcttggccaggcgcactcgaagacggatatagtgttcggcatcgagccgacaggccactactggttcccgcttgcggcatacttacacgctcagggtattcaaatagtcgtcgtgaacccgcatcacgtcaacaagtcgaaggagctggaggataactcccagactaaatccgattacaaagacgcaaaggtgatcgccgacctgatccgtaatggcaagtacagcgaacccaagctgccgactaaagagtacgctgacttgcggatactgatgaacctccgcgagaaggtgagcgccagcctgacccaagtcaagggcagaataggtcactggttcgaccgctttttcccggagtattcgacggtgtgcaaagactgggatggcaaaacctcgctcatgaccatgcggagcttccctctgccgagcgatatagtgtcaaagtctgcgcgtgaagtcctcgcccattggaagaccgaggtgaaacgcggcgtcgggatcaagagggcggagaagctcgtggccgccgccgccgcctccattggcctcaccgagggctccgccgccgcccgcattgaactcagcacactcctcggccagttcgagctgttccgcgagcagcttgagggcatcatgaaggaagtcacacagatcctggagaacattcctggagccgaacacatgcttagcgtgccaggcgtggggacggtgaccgtcgctgggttcctcgccgaggtgggagacttgtcaaactacgaccacggccagcagatcattcggcttgccgggctcaacctcaaggaaaacagcagtggcaaacggaaggggaaaactggcattagcaagcgcggcagaagccgcctgcgcgccttactgttccgcgctgtgatgccaatggtcgctaagaacgaagcgttcaagaccctacataagcactacacaaaccgctcccagaacccgctcaagaagaaacagtcgctaatcgcattgtgcgggaagttgatccgcgtcctccacacacttgggaccaagcagcgcgcctacaacgccgacgagatgctcggcccggtccggcagtcacagatgcagcttgaggccgcctga

SEQ ID NO: 2587 - DNA, 1299 bp, Unknown
  Paenibacillus thiaminolyticus (multi)
atgaagcacaagctcaagcagaagcagaaccagcggatcacccggattaccgactctacccttgtggtgggagctgatattgccaagaagatccacgtcgctcgcgctgtggactttcgcggaatcgaactggggaaggactgcgtgttcccgaacgaccaacaggggctgaccaaactgacaacctggatgaaggagctgggacaggcccattccaagaccgacatcgttttcggaatcgaacccaccggccactactggttcccgctcgcggcctacctgcacgcccagggcattcagattgtcgttgtcaacccgcatcacgtgaacaaatcgaaggaattggaggacaactctcaaacgaagtcagactacaaagacgcaaaggtcattgcggatctgattcgcaacggcaaatactccgagcctaaactcccgacgaaggaatacgcggacctgagaatccttatgaacttgcgcgagaaggtgtccgcctcactgacccaagtgaagggacgcatcgggcactggttcgacagattcttccccgagtacagcacggtgtgcaaagactgggacggaaagacctcactgatgacgatgcgttcgttcccgctcccctccgacatcgttagcaaatcagcgcgcgaggtgttagcccactggaagacagaggtcaagcgcggcgtcgggattaagcgagcggagaagctcgtggccgcagcggcggcctccatcggcctgaccgagggctcagccgcagctcggatcgagctttccacactcctcggccagtttgaactgttccgcgagcaattggaggggatcatgaaggaggtcacccagattcttgaaaacatccctggcgcagaacacatgctttcggtgcctggggtcggcactgttacagtggctggcttcctcgcagaggtcggcgacttgtccaactatgaccacggccagcagatcattcgcctcgccgggttgaatctcaaggagaactccagtggcaagaggaagggcaagaccggtatcagcaagcgcggccggtcccgcctgcgggcgctgctgttccgcgcggtgatgcctatggtggccaagaacgaggcgtttaagaccttgcataagcactacaccaaccggagccagaaccctctcaagaaaaagcagtcgctgatcgccttgtgcggcaagttgatccgtgtcctgcatacgctgggcacaaaacagcgagcctacaacgccgacgagatgctcggcccggtgcggcagtcgcagatgcaattggaggcggcctaa

SEQ ID NO: 2588 - DNA, 1299 bp, Unknown
  Paenibacillus thiaminolyticus (multi)
atgaagcacaagctcaagcagaaacagaaccagcgaattacgcggatcacggatagcacgctcgtggtcggggcggacatcgccaagaagatccatgtcgcacgcgccgttgacttcagagggatcgaattgggcaaagactgcgtgttcccgaacgaccaacagggtctgacgaagctgacaacctggatgaaggagctgggccaggcccactccaagacggacatcgtatttgggattgagcccactggccactactggttcccattggctgcctacctgcacgctcagggcattcaaatagtcgtggtcaaccctcatcatgtcaacaaatctaaggagctggaggacaacagtcaaacgaaatccgactacaaagacgcgaaggtcatcgccgatctgatccggaacggcaaatactctgagccgaagctgcccactaaggagtacgccgacctccgtatccttatgaacctccgggagaaggtcagcgccagcttgactcaagttaagggacgcatcggccactggttcgaccgctttttccccgagtattccacagtgtgcaaggactgggacgggaagacgagcctcatgaccatgcggtcattccctctgccgtccgacatcgtgtcaaagagtgcgcgtgaagttctggcccactggaagactgaggttaagcggggcgtcggcatcaagcgcgcggagaagttggtcgccgctgccgcagcgtctatcgggctcacggaggggagcgcggctgcccgcattgaactatccaccctgctcggccaatttgagttgttccgagaacagctagagggcattatgaaggaggtcactcagatcctggagaacatacccggcgcggagcacatgctgagcgtccctggagtgggcacagtgacggtggctggattcctggcagaggtcggtgacttgtcaaactacgaccacgggcagcagatcatacgacttgcgggactcaatctcaaggagaacagctcggggaagcggaagggcaagaccggaatctccaagcgcggacgctctcgcctgcgtgcgctgctcttccgggctgttatgccgatggtggccaagaacgaagcgtttaagaccctccacaagcactacacgaaccgctcccagaacccgctcaagaagaagcagtcacttatcgcactgtgcggcaagctgatccgcgtccttcacacactggggacaaaacagcgcgcgtacaacgctgacgaaatgttgggcccggtgcgccagtcccagatgcagttggaggccgcgtag

SEQ ID NO: 2589 - DNA, 1299 bp, Unknown
  Paenibacillus thiaminolyticus (multi)
atgaagcacaagctcaagcagaagcagaaccagcgcatcactagaatcacggacagcaccctggtcgtgggagcggacattgccaagaagatccatgttgcccgcgctgtggactttcggggaatcgaacttgggaaagactgcgtgttcccgaacgatcaacaggggctcactaaactcacgacctggatgaaggagctggggcaagcgcacagcaagacggacatcgttttcgggatcgagcccaccgggcactactggttcccgttagccgcttacctccacgcacagggcatccaaatcgtcgtggtcaacccgcatcacgtcaacaagtctaaggagctggaggacaactcccaaactaaatcagactacaaggacgcaaaggtgatcgcggaccttattcgcaacggcaagtacagcgagcccaagttgccgactaaggagtacgccgacctccgcatcctcatgaacctgcgcgagaaggtgtccgcgtcgctcacccaagtcaagggtcgtatcgggcactggttcgaccgctttttccctgagtacagcaccgtgtgcaaggactgggacgggaagacctcgttgatgaccatgagatcctttccgcttccttcagatattgttagcaagtctgcgagggaggtgctcgcacactggaagacagaggttaagcgcggcgtggggatcaagagggccgagaaactggttgcggcagcagcagcctcgattgggctcaccgagggatctgccgccgcccgaattgaactgagcacgctcctgggccaatttgaactgttccgggagcaactggaggggattatgaaggaggtgactcagatcctggagaatatccccggtgcagaacacatgctcagcgtgccgggcgtcggcaccgtaactgtggcggggttccttgcagaggttggcgacctgtcgaactacgatcacgggcagcagatcatcaggctcgcggggctcaacctcaaggagaactcctctgggaagcggaaaggcaagacgggaatctctaaaaggggccggagccgactgcgggcccttctgtttagagctgtcatgccgatggtggccaagaacgaggcgttcaaaaccctgcacaaacactacaccaatcggtcccagaacccgctcaagaagaaacagagcctcatcgcgctgtgcggcaagctcatccgggtattgcacacactggggaccaagcagagagcttacaacgccgacgaaatgttgggtccggtccgccagtcgcagatgcagttggaggccgcctaa

SEQ ID NO: 2590 - DNA, 1437 bp, Unknown
  Bacillus sp. multi
atgataattacacggaagatcaagctcatcatcgtgggcgaggagcgggacaaccagtacaagttcatccgcgaggagcgctacaagcagaacaaggcgctgaacgtcgccatcaaccacctctacttcctccacgtggcgaaggaaaagatacggctgctcgaccacaagttcgtccaggacgagcagaagctccaggagaccatcgacaagctctacgacgagaagcgcaagcagaaggacgagaagaagaaagataccatcgagcaaaagatcgagaagaagcgcaacaagctcaaggaactccgctcgaagggcaacaaggaggcggccaagacgctccaggacgcgatcaagatcaacttcaccaccaccacgcgcgagatcatcaacaagcagttcgacctgatgagcgacacaaaggaccgcatcacccagaaggtgacccaagacttcagcattgatctcaagaacggcctgctcagcggcgagcgcagccttcgcacctacaagaaaaacaacccgctcttcatacggggccggacgctctacttctaccaggagggcaagtcgatcctcatcaagtggtgcaagggcatcgttttcaagtgcatactggggaggcaccagaacaacagccacgagctgtggacgatcctcaagaaggtcttggaacagtcctacaaggtctgcgactcgtccatctcggtgggcaaggacttcatcctgaacctctcgctggacatcggcgagagcgacaaccgcacggccttcgtcgaggggcgcgtgctgggcgtggacctcggcatgaaggtgcccgcgtacatgagcatcaacgacaagccgtacatccgcaaggcgctggggagcctggaggacttcctaaaaatccgggtccagatgcagaagcgccgcaagaacctgcacaagacgctcgtgtcggtgaagggcgggaaggggcgcgagcgcaaggtcaaggcgctcgaccgcttcaaggagaaggagcagaacttcgccaccacgtacaaccacttcctgtcccacaacatcgtcaaattcgccaagaagcaccggtcgggccagatcaacatggagttcctggcactcgcgggcgaagataaggacaagatcctgcggaactggtcctactaccagctccaggagttcatcgagtacaaggcgaaccaggagggcatcaaggtgaagtacgtggacccgtaccggacgtcgcagacctgctcgaagtgcggcagctacgagcccggccagcgggagagtcaggagaagttcatctgcaaggtgtgcaagctggagatcaacgccgactacaacgccagccagaacatcgcgcacagcaccaagtacatgaccaacaagcagcagtccgagtacttcaagcgcctccagcagacgaccaagctggagaaatatagctag

SEQ ID NO: 2591 - DNA, 1437 bp, Unknown
  Bacillus sp. multi
atgatcatcacgcggaagatcaagctgatcatcgtgggcgaggagcgggacaaccagtacaagttcatccgcgaggagcggtacaagcagaacaaggcgctcaacgtggccatcaaccacctgtacttcctgcacgtggcgaaggagaaaatccggctcctcgaccacaagttcgtccaggacgagcagaagctccaagagaccatcgacaagctgtacgacgagaagcgcaagcagaaggacgagaagaagaaagacaccatcgagcagaagatagagaaaaagcgcaacaagctgaaggagttgcgctcgaagggcaacaaagaggcggccaagacgctccaggacgccatcaagatcaacttcaccacgacgactcgtgaaatcatcaacaagcagttcgacctgatgtcggacacgaaggaccgcatcacgcagaaggtgactcaagacttcagcatcgaccttaagaacgggctgctgtcgggcgagcgcagcctccggacgtacaagaagaacaacccgctcttcatccggggacggaccctctacttctaccaggagggcaagagcatcctcatcaagtggtgcaagggcatcgtgttcaagtgcatcctgggccgccaccagaacaactcacacgagctgtggaccatcttgaagaaggtgcttgagcagagctacaaggtgtgcgacagctccatctccgtggggaaggacttcatcctcaacctgtcgctcgacatcggcgagtcggacaaccgtacggctttcgtggagggccgcgtgctgggcgtggatctgggcatgaaggtaccggcgtacatgagcatcaacgacaagccgtacatccggaaggccctcgggtcgcttgaggacttcctcaagatccgcgtgcagatgcagaagcgccgcaagaacctgcacaagacgctcgtgtcggtcaagggggggaagggccgtgagcgcaaggtgaaggccctggaccgcttcaaggagaaggagcagaacttcgccacgacgtacaaccacttcctgagccacaacatcgtcaagttcgccaagaaacaccgctccgggcagatcaacatggagttcctggccctggctggcgaggacaaggacaagatccttcggaactggagctactaccagttgcaggagttcatcgagtacaaggcgaaccaggaggggatcaaggtcaagtacgtcgacccgtaccgcacctcgcagacgtgctccaagtgcggcagctacgagcccggccagcgggagtcccaggagaagttcatctgcaaggtctgcaagctcgagattaatgccgactacaacgcctcccagaacatcgcgcactcgaccaagtacatgaccaacaagcagcagtccgagtacttcaagcggctccagcagacgacgaagctggagaagtattcctag

SEQ ID NO: 2592 - DNA, 1437 bp, Unknown
  Bacillus sp. multi
atgataattacgcggaagatcaagctcatcatcgtgggcgaggagcgcgacaaccagtacaagttcatccgcgaggagcggtacaagcagaacaaggccctcaacgtggcgatcaaccacctgtacttcctccacgtggcgaaggagaagattcgcctgctcgaccacaagttcgtccaggacgagcagaagctccaggagaccatcgacaagctgtacgacgagaagcgcaagcagaaggacgagaagaaaaaggacaccatcgagcaaaaaatcgagaagaaacgcaacaagctcaaggagctacgaagcaaggggaacaaggaggccgccaagaccctccaggacgcgatcaagatcaacttcaccacgacgacgcgcgagatcatcaacaagcagttcgacctgatgtcggacacgaaggaccggatcacgcagaaggtcacacaggacttcagcatcgacctaaagaatgggctcctgtccggtgagcggtcgctccggacctacaaaaagaacaacccgctcttcatacggggccggacgctgtacttctaccaggagggcaagtccatcctcatcaagtggtgcaagggcatcgtgttcaagtgcatcctcgggcggcaccagaacaactcccacgagctgtggaccatcctcaagaaagtcctagaacagagctacaaggtgtgcgactccagcatctcagtgggcaaggacttcatcctgaacctgtccctggacatcggggagtccgacaaccgcaccgcgttcgtcgagggccgggtgctcggcgtggacctcgggatgaaggtgcctgcttacatgagcatcaacgacaagccctacatccgcaaggccctggggagcctggaggacttcctcaagatccgcgtccagatgcagaagcgccgcaagaatttgcacaagacgctggtgagcgtcaagggcggcaagggccgcgagcggaaggtgaaggcgctggaccgcttcaaggagaaggagcagaacttcgccaccacctacaaccacttcctgagccacaacatcgtgaagttcgccaagaaacaccgctccggccagatcaacatggagttcctggcactggctggggaagataaggacaagatcctccgcaactggtcctactaccagctccaggagttcatcgagtacaaggccaaccaggaggggatcaaggtgaagtacgtggacccctaccggaccagccagacctgttccaagtgcggcagctacgagccgggccagcgggagtcccaggagaagttcatctgcaaggtgtgcaagctggagatcaacgccgactacaacgccagccagaacatcgcgcacagcaccaagtacatgaccaacaagcagcagtccgagtactttaagcggctccagcagacgaccaagctggagaagtacagctag

SEQ ID NO: 2593 - DNA, 1437 bp, Unknown
  Bacillus sp. multi
atgataatcacgcgcaagatcaagctcatcatcgtcggcgaggagcgcgacaaccagtacaagttcatccgcgaggagcgctacaagcagaacaaggccctcaacgtggccatcaaccacctgtacttccttcacgtggcgaaagagaaaatccgcctcctcgaccacaagttcgtccaggacgagcagaagctccaggagactatcgataagctctacgacgagaagcgcaagcagaaggacgagaagaagaaggataccatcgagcagaaaatagagaagaagcgcaacaagttgaaggagctgcgctcgaaggggaacaaggaggccgccaagaccctccaggacgccattaagatcaacttcacgacgaccacccgcgagattatcaacaagcagttcgacctgatgtcggacacgaaggaccggatcacgcagaaggtcacccaggacttctccatcgacctcaagaacggcctgctgtccggggagcggagcctgcggacctacaagaaaaacaacccgctgttcatccggggccgcaccctctacttctaccaggagggcaagtccatcctcatcaagtggtgcaagggcatcgtgttcaagtgcatcctggggaggcaccagaacaactcccatgagctgtggacgatcctcaaaaaggtgctggagcagtcctacaaggtgtgcgacagctccatctcggtgggcaaggacttcatcctgaacctctcgctggacatcggggagagcgacaaccgcaccgccttcgtggaggggcgcgtgctcggcgtggacctcgggatgaaagtgcctgcttacatgagcatcaacgacaagccgtacatccgcaaggcgctcggctcgttggaggacttcctcaaaatccgcgtgcagatgcagaagcggcgcaagaacctccacaagaccctcgtgtcggtcaagggcgggaagggacgcgagcggaaggtgaaggcgctcgaccgcttcaaggagaaggagcagaacttcgccaccacgtacaaccacttcctgtcccacaacatcgtcaagttcgccaagaaacaccgcagcgggcagatcaacatggagttcctggccctggcgggcgaggacaaggacaagatcctgcgcaactggagctactaccaacttcaagagtttatcgagtacaaggcgaaccaggagggcatcaaggtgaagtacgtggacccgtaccgcacgtcgcagacgtgctcgaagtgcgggtcgtacgagccgggccagcgggagtcccaggagaagttcatctgcaaggtctgcaagctggagatcaacgcggactacaacgccagccagaacatcgcgcactccaccaagtacatgaccaacaagcagcagagcgagtacttcaagcgccttcagcagacgaccaagttagagaagtactcctag

SEQ ID NO: 2594 - DNA, 1437 bp, Unknown
  Bacillus sp. multi
atgataatcacccggaagatcaagctgataatcgtcggggaggagcgggacaaccagtacaagttcatccgcgaggagcgctacaagcagaacaaggccctcaacgtcgccatcaaccacctgtacttcctgcacgtggcgaaggagaagattcggctgctggaccacaagttcgtccaagacgagcagaagctccaggagaccatcgacaagctgtacgacgagaagcgcaagcagaaggacgaaaagaagaaggacaccatcgagcagaagatagagaagaagcggaacaagctcaaggagttgcgcagcaaggggaacaaggaggcggcgaagacattgcaagacgccatcaagatcaacttcaccaccaccacgcgcgagatcatcaacaagcagttcgacctgatgtccgacactaaagaccgcatcacccagaaggtcacccaggacttctccatcgacctcaagaacggcctgctgagcggcgagcgcagcctgcggacgtacaagaagaacaacccgctgttcatccggggtcggacgctctacttctaccaggagggcaagagcatcctcatcaagtggtgcaaggggatcgtgttcaagtgcatcctggggcggcaccagaacaacagccacgagctgtggacgatcctcaagaaagtgctggagcagagctacaaggtgtgcgacagctcgatctccgtggggaaggacttcatcctcaacctgtctctggacatcggcgagagcgacaaccgcaccgccttcgtcgagggccgggtgctgggcgtggacctcggcatgaaggttcctgcgtatatgtctatcaacgacaagccctacatccgcaaggccctgggctccctggaggacttcctcaagatccgcgtgcagatgcagaagcgccgcaagaacctccacaagacgctcgtctccgtgaagggcgggaaggggcgcgagcggaaggtgaaggccctggaccgcttcaaggagaaggagcagaacttcgccaccacctacaaccacttcctcagccacaacatcgtcaagttcgccaagaaacaccgctccgggcagatcaacatggagttccttgccctggctggagaggacaaggacaagatcctccgcaactggtcctactaccagctccaggagttcatcgagtacaaggccaaccaggagggcatcaaggtgaagtacgtggacccctaccgcacctcgcagacgtgctcgaagtgcgggagctacgagcccggccagcgtgagtcccaggaaaagttcatctgcaaggtctgcaagctggagatcaacgcggactacaacgcctcccagaacatcgcccactccacgaagtacatgaccaacaagcagcagtccgagtactttaaacgcctccagcagaccacgaagttagagaaatacagctag

SEQ ID NO: 2595 - DNA, 1425 bp, Unknown
  Bacillus sp. multi
atgattatcgcccggaagatcaagctcatcatcatcggcgagaaccgcgacacgcagtacaagttcatccgcgaggagcgctacaagcagaacaaggccctcaacgtcgccatgaaccacctctacttcctccacgtggcgaaggagaaaattcggctgctcgacaaaaagttcctccaggacgagaagaaactccaggagggcatcaacaagctgtacgcggagaagaagaaggtcatcaaggacgaaaagaagcggaacgaattggagaagaaaattcagaagcagaccaacgagctgaaaaagctgcggtcgaaggggaacaaggaggccgacaagatcctccaggaggcgatcaagatcaacctgtcgtccacgacccgcgaggtcatcagcaagcagttcgacctcatctccgacacgaaggaccggatcacccagaaggtgtaccaggacttcaagagcgacctcaagaacggcctgctgtcgggcgagcgcgtcctgcggacctacaagaagaataacccgctgctcatccggggccgggccctcaacttctaccgggaggggaaggacgtcatgataaagtggttcggcggcatcatcttcaagtgcatgttggggcagcacaagaacaacgcccaggaattgaaggccaccctgaacaaggtgctggagggctcctacaaggtctgcgactcgtcgatcagcgtggggaaggagctgatcctgaacatctccctcgacatcggcgaggtggactcgaacgtctcctgcaagaaaggacgggtgctgggcgtggacctgggcatgaaggtgcccgcctacatgagcatcaacgacaagccgtacatccgcaagtcgctcgggagcctggacgacttcctcaagatccgggtgcagatgcagaagcgccgccggaacctccacaagacgctggtgtccgtcaagggcggcaagggccgcgagaagaaactccaggcgctcgaccgcctcaaggagaaggaaaagaatttcgccacgacctacaaccacttcctgtcctacaacatcgtgaaattcgctaaggacaacctcgcggagcagatcaacatggagttcctggcgctggcgggcgaggacaagaacatcatcctccgcaactggtcctactaccagctccagcagttcgtcgagtacaaggcgaagcgggagggcatcgacgtcaagtacgtggacccgtaccgcacctcgcagatgtgcagcaagtgcgggaactacgagccggggcagcgggagtcccaggagaagttcatctgcaagtcgtgccacctggagatcaacgcggactacaacgcctcgcagaacatcgcccactccaccaagtacatcacgaacaagaaccagtcggaatactttaagaagctccagcacaccatcgagtga

SEQ ID NO: 2596 - DNA, 1425 bp, Unknown
  Bacillus sp. multi
atgataatcgcccggaagatcaagctcatcatcatcggcgagaaccgcgacacccagtacaagttcatccgcgaggagcggtacaagcagaacaaggcgctcaacgtggccatgaaccacctctacttcctccacgtggcgaaggagaaaatccggctgctggacaagaagtttctacaagatgagaagaaactccaggagggcatcaacaagctctacgcggagaagaagaaagttattaaggatgagaagaagcggaacgagctggagaagaagatccagaagcagaccaacgagctgaagaagctgcgctcgaaggggaacaaggaggccgacaagatcctccaggaggcgatcaagatcaacctgtcgagcacgacccgcgaggtcatcagcaagcagttcgacctgatctccgacacgaaggaccgcatcacgcagaaggtgtaccaggacttcaagagcgacctcaagaacgggctgctcagcggcgagcgcgtgctgcggacctacaaaaagaacaatccgctgctcatccggggccgggcgctcaacttctaccgggaggggaaggacgtcatgattaagtggttcggcgggatcatcttcaagtgtatgctaggccagcacaagaacaacgcccaggaactgaaagcgaccctcaacaaggtgctggagggcagctacaaggtctgcgactcctccatctcggtggggaaggagctgatcctcaacatctcgctcgacatcggcgaggtggactccaacgtgagctgcaagaagggtcgggtgctgggcgtggacctcggcatgaaggtgcccgcctacatgagcatcaacgacaagccgtacatccgcaagtccctcggctccctggacgacttcctcaagatccgcgtgcagatgcagaagcggcggcgcaacctgcacaagacgctcgtgtccgtgaagggcggcaaggggcgggagaagaaactccaggcgctcgaccggctcaaggagaaggagaagaatttcgccacgacctacaaccacttcctgagctacaacatcgtgaagttcgcgaaggataacctggccgagcagatcaacatggagttcctggccctggcgggcgaggacaagaacatcatcctccggaactggagctactaccagctccagcagttcgtcgagtacaaggccaagcgcgagggcatcgacgtgaagtacgtggacccctaccgcacgagccagatgtgcagcaagtgcgggaactacgagccgggccagcgcgagtcccaggagaagttcatctgcaagtcctgccacctggagatcaacgccgactacaacgccagccagaacatcgcgcactcgaccaagtacatcacgaacaagaaccagtcggaatattttaagaagctccagcacaccatcgagtga

SEQ ID NO: 2597 - DNA, 1425 bp, Unknown
  Bacillus sp. multi
atgataatagcccggaagatcaagctcatcatcatcggggagaaccgcgacacccagtacaagttcatccgggaggagcgctacaagcagaacaaggcgctgaacgtggcgatgaaccacctctacttcctgcacgtggcgaaggagaagatccggctcctggacaagaagttcctccaggacgagaagaaactccaggagggcatcaacaagctctacgcggagaagaagaaagtcatcaaggacgagaagaaacggaacgagctggagaaaaagatacaaaagcagaccaacgaattaaagaaactgcggagcaagggcaacaaggaggcggacaagatcctccaggaggccatcaagatcaacctcagctcgaccacgcgcgaggtgatctccaagcagttcgacctgatctccgacacgaaggaccgcatcacgcagaaggtgtaccaggacttcaagagcgacctcaagaacggcctgctgtcgggcgagcgcgtcctccgcacgtacaagaagaataatccgctgctcatccggggccgggcgctcaacttctaccgggagggcaaggacgtgatgattaaatggttcggcgggatcatcttcaagtgcatgttgggccagcacaagaacaacgcccaggagcttaaggccaccctcaacaaggtgctggaggggagctacaaggtgtgcgactcctccatctccgtcggcaaggagctgatcctcaacatcagcctggacatcggggaggtggactccaacgtgagctgcaagaaaggtcgggtgctgggcgtggacctcgggatgaaggtgcccgcgtacatgagcatcaacgacaagccctacatccgcaagagcctggggagcctcgacgacttcctcaagatccgggtccagatgcagaagcggcggcgcaacctgcacaagaccctggtgtccgtgaagggcggcaagggccgggagaaaaagctccaggcgctcgaccgcctcaaggagaaggagaagaactttgcaaccacctacaaccacttcctgagctacaacatcgtgaagttcgcaaaggacaacctcgccgagcagatcaacatggagttcctggccctggccggggaggacaagaacatcatcctgcggaactggagctactaccagctccagcagttcgtggagtacaaggcgaagcgcgagggcatcgacgtcaagtacgtggacccgtaccgcacgagccagatgtgctcgaagtgcgggaactacgagccgggccagcgcgagtcccaggagaagttcatctgcaagtcgtgccacctggagatcaacgccgactacaacgcctcgcagaacatcgcgcacagcaccaagtacatcaccaacaagaaccagtcggagtacttcaaaaagctccagcacaccatcgagtga

SEQ ID NO: 2598 - DNA, 1425 bp, Unknown
  Bacillus sp. multi
atgattatcgcgcggaagatcaagctcatcatcatcggggagaaccgcgacacccagtacaagttcatccgcgaggagcggtacaagcagaacaaggccctcaacgtcgccatgaaccacctgtacttcctccacgtggcgaaggagaaaatccggctgctcgacaagaaattcctacaagatgagaagaagctccaggaggggatcaacaagctctacgccgagaagaagaaagtcattaaggacgagaaaaagcgcaacgagctggagaagaagatacaaaagcagaccaacgagctcaaaaagctccggtcgaagggcaacaaggaggccgacaagatcctccaggaggccatcaagatcaacctcagcagcaccacgcgcgaggtgatctcgaagcagttcgacctcatcagcgacacgaaggaccggatcacgcagaaggtgtaccaggacttcaagagcgacctcaagaacgggctcctgtccggcgagcgggtgctgcggacgtacaaaaagaacaatccgctcctgatccggggccgggcgctcaacttctaccgcgaggggaaggacgtgatgatcaaatggttcggcggcatcatcttcaagtgtatgttggggcagcacaagaacaacgcccaggagcttaaagcgaccctgaacaaggtgctggagggctcctacaaggtgtgcgacagctccatctcggtgggcaaggagctgatcctcaacatcagcctcgacatcggcgaggtggacagcaacgtctcctgcaagaagggccgggtgctcggcgtggacctggggatgaaggtgcccgcgtacatgagcatcaacgacaagccctacatccgcaagtccctcggctcgctcgacgacttcctcaagatccgggtccagatgcagaagcgccgccgcaacctgcacaagacgctggtgtccgtcaagggcgggaaggggcgcgagaaaaagctccaggcgctcgaccggctcaaggagaaggagaagaactttgcgaccacctacaaccacttcctctcgtacaacatcgtgaagtttgctaaggataacctggccgagcagatcaacatggagttcctggcgctcgccggggaggacaagaacatcatcctccggaactggtcgtactaccagctccagcagttcgtggagtacaaggccaagcgggagggcatcgacgtcaagtacgtggacccgtaccgcacctcccagatgtgcagcaagtgcgggaactacgagccggggcagcgcgagtcccaggagaagttcatctgcaagtcctgccacctggagatcaacgcggactacaacgcctcccagaacatcgcccactccaccaagtacatcaccaacaagaaccagagcgagtacttcaaaaagctccagcacaccatcgagtag

SEQ ID NO: 2599 - DNA, 1425 bp, Unknown
  Bacillus sp. multi
atgataatcgcccggaagatcaagctcatcatcatcggggagaaccgggacacgcagtacaagttcatccgcgaggagcgctacaagcagaacaaggccctgaacgtggccatgaaccacctctacttcctccacgtggcgaaggagaagatacgcctgctggacaagaagttcctccaggacgaaaagaaactccaggaggggatcaacaagctctacgccgagaagaaaaaggtcattaaggacgaaaagaagcgcaacgagctggagaagaaaatacagaagcagaccaacgaactaaagaaactgcgctcgaagggcaacaaggaggccgacaagatcctccaggaggccatcaagatcaacctgtcctccaccacccgcgaggtcatctcgaagcagttcgacctcatctccgacacgaaggaccggatcacccagaaggtgtaccaggacttcaagtccgacctcaagaacgggctcctgagcggcgagcgcgtcctccggacgtacaagaagaataacccgctgctcatccggggccgggcgctcaacttctaccgggaggggaaggacgtcatgattaagtggttcggcggcatcatcttcaagtgtatgcttgggcagcacaagaacaacgcccaggagctaaaggcgaccctgaacaaggtgctggagggcagctacaaggtctgcgactcgtccatctccgtgggcaaggagctgatcctcaacatctccctggacatcggggaggtggactccaacgtgagctgcaagaagggccgggtgctcggcgtggacctgggcatgaaggtgcccgcctacatgagcatcaacgacaagccgtacatccgcaagtccctcggctcgctggacgacttcctcaagatccgcgtgcagatgcagaagcggcggcgcaacctccacaagaccctcgtgtcggtcaagggcggcaagggccgggagaagaaactccaggcgctcgaccgcctcaaggagaaggagaagaatttcgcaaccacctacaaccacttcctctcctacaacatcgtcaagttcgctaaggataacctcgcggagcagatcaacatggagttcctggcgctcgccggggaggacaagaacatcatcctccggaactggtcgtactaccagctccagcagttcgtggagtacaaggccaagcgggaggggatcgacgtcaagtacgtggacccgtaccggacgtcgcagatgtgcagcaagtgcggcaactacgagccggggcagcgcgagtcccaggagaagttcatctgcaagtcgtgccacctggagatcaacgccgactacaacgccagccagaacatcgcgcactccaccaagtacatcaccaacaagaaccagtcggaatatttcaagaaactccagcacaccatcgagtga

SEQ ID NO: 2600 - DNA, 1191 bp, Unknown
  Streptomyces sp. multi
atggcggcaatctgggcggggattgatgcgggcaagacccaccaccattgcgttgcaattgacgagtccggacgcagattgctctcacggagggtggcaaacgatgaacctgagctgttagaactactgaccgacgttctcgcacttggtgatgaggttacctggggaatcgaccttgccgacggaggagcagccctcgctatagctatcctgttgaaccacgatcagcccgttaattacatctccggaagggcaattcacagggcttctgagtcctaccgaggcgaaggcaaaacggatgctaaggatgccgccgtcatcgccgatcaagtgaggatacgccgcgatctcaacccgctgaggacgggagacgaaactgtgacggacctcaagatcctgaccggaagacgcatggatctggtggctgacaggactcgcacgataaaccgtctcagggctcaactaagtggcatcttccccggacttgaacgggcgcttgacctgaccaacaaagggccgctcactctgctcacgggttaccagacgtcagccgcgatcagaaggcttggaacgaaacgtcttgagacttggcttcgcaacaggaaggtgcttcgcgcagaccaattggctgagacagcggtggctgctgctgagcgtcagcacaccagtttaccgggcgagaagctcactgctcaaatggttcacacattagcgaaagaggtcatggtcctgaccgagcaagtggccgaggttgacaagctgatcgaggctcggttccgagaccatcggcacttcgacgttattacctctatgcctggtctgggcatcattctgggtgctgaattcctggcagcaaccggtggagatatgacaatcttcgacactcccgaccgccttgccgcattcggcggtgtcgcgcctgttcctcgggatagtggcaagatcagcggcaacctcaggcggccccagcggtacaatcggaggctccaacgggtgttctatacaagcgctctgtttagcattcggaaatgtgaggaatctcggcgcttctatgaccgtaaacgcgccgagggcaaacgccacactcaggcagtgttggccctagccagacggcgtgttaatgtactgtgggccctactgcgagacgggcgggcatacgaactgacgcctccgacggccctagcagcatag

SEQ ID NO: 2601 - DNA, 1191 bp, Unknown
  Streptomyces sp. multi
atggcggctatctgggcgggtattgacgctggaaagacgcaccatcactgcgtggcgattgacgagtcagggcggcggctattgagccgtcgcgttgcaaatgatgagcctgagctgctggaactgctaactgatgtcctcgccttaggtgacgaagtgacttggggcattgatctcgcggacggcggagccgcgcttgctatagcgatcctcctcaatcacgaccagccggttaattacatctctggacgagcgatccaccgggccagcgagtcctatcgtggggaaggcaaaaccgatgctaaggacgcagcagtcattgcagatcaagtccggataaggcgtgatctaaaccctctccgaacaggggacgaaacggtgacggatctcaaaatcctcaccggccgtcgcatggatctcgtggctgatcgcactagaacgatcaaccgactcagggcccagctctctggcatattccctgggcttgagcgcgcattggacctaacgaacaaaggcccactcacgttgctcaccggctaccaaacgtcagcggcgataagacggctggggacaaaacgcctggagacatggctgcggaaccgtaaagtcctgagggcggaccaacttgcggaaacggcggtcgctgcggctgagcgccaacacacatccctccccggcgagaagctcacggcgcagatggtgcatacacttgcgaaggaggtcatggttctgacagaacaagtcgctgaggttgacaagctcatcgaggcacgatttcgggaccatcgtcacttcgatgttattacttctatgcctggcctcggtatcatcctgggagcagagttcctcgcagcaacgggcggagacatgacgatattcgacactcctgaccgtctcgctgccttcggcggagtcgctcccgttccccgtgattctgggaagataagcggcaacttgcgtcgtccccagagatacaacaggaggctccaacgggtattctacaccagcgccttgttcagcatcaggaaatgcgaggagtccagacgcttttacgaccgcaaaagggccgagggaaagcgtcatacccaagccgttctggctctcgcccgccgcagagtgaacgttctgtgggccttgctgcgtgatgggagggcctacgaactcactcctcccaccgcactagccgcataa

SEQ ID NO: 2602 - DNA, 1191 bp, Unknown
  Streptomyces sp. multi
atggccgcaatctgggcggggattgacgctggcaaaacccaccatcactgcgttgctattgacgagagcggccgacgtctattgtctcggagagttgcaaatgatgaaccggaactattggagctacttacggatgtcctagcgttgggcgacgaagtgacttggggtattgatctcgctgacggtggggccgccctcgccatcgctatcctactgaatcacgatcagcctgtgaactatatcagcggacgggcgatccatcgtgccagcgaaagctacaggggtgagggcaaaacagacgcgaaggatgctgctgtgatcgcggatcaagtacgcattcgccgggatttgaacccacttcgcacaggcgacgagactgtgaccgatctcaagatacttacaggccgtagaatggatctggttgcagaccgtactcgcaccatcaacagactcagagcccagctctctgggatattccctggccttgaacgggctctggatcttaccaacaaagggccactcacactcttgacaggctaccaaaccagcgcggctatcagacggctgggcaccaagcgcctggaaacctggctaaggaatcggaaagttctcagagcagaccaactcgccgagacggcagttgctgcggccgagagacagcacaccagcctcccaggggagaaactcaccgcccagatggtgcatacactggctaaggaggtcatggtgttgaccgaacaagtggcagaagttgataagctcattgaggcgcggtttcgagaccacagacacttcgacgtcatcacttccatgcctggcctcggcataattcttggggctgagttcttagcggccaccggcggggatatgacaatcttcgatactccagataggctggctgctttcggaggagtcgcgcccgtaccacgtgacagcgggaagataagtggcaatctgcggcgtccacagcgctacaaccgccgtttacagcgcgtattctacacctccgcgctattctcaatccgcaagtgcgaggaatcccggcggttctacgaccgcaagagggcagagggcaagcgacacacccaagcagtccttgcactcgcccgtcggcgcgtcaacgtcctatgggcacttctcagggacggccgtgcctacgagctaactccgcctactgcgctcgccgcctga

SEQ ID NO: 2603 - DNA, 1191 bp, Unknown
  Streptomyces sp. multi
atggctgcaatctgggctgggatcgacgctggcaaaacccaccatcactgcgtcgctatcgacgagtccggacgccgcctcctgagccgccgagtggcgaatgatgaacccgagctgctggagctactcacagatgtcctcgccctcggtgatgaagttacatggggtatcgacttagcggatggcggggctgccctggccatcgccatcctgctaaaccacgatcaacccgtgaactatatctccggtagggctatacaccgggcatctgagtcgtaccgaggcgaaggcaagacagacgctaaagatgcagccgttatcgcagatcaagtgcgaatccgtagggatttgaatcctctgcgtactggagacgagactgtaacggacctcaagatactcaccgggcgtcgcatggatctcgtggcagaccgcacacggaccatcaaccggctccgcgcacaattgtccgggatcttccctggcctagagagagcactcgacctgaccaacaaaggaccacttacgctgctcaccggctaccagacctccgccgctatcagacgtcttggtactaagcgtctggagacgtggctccggaatcggaaggtgctgcgcgcggaccaattggcagaaaccgctgtcgccgcagccgagcgtcaacatacgagccttccaggggagaaactgacggcacagatggtgcacacactggcaaaggaagtgatggtgctcacagaacaagtcgccgaggttgataagctgatcgaggcgaggtttcgggaccaccggcacttcgacgttattacctcaatgccagggctcggcattatcctcggtgcggaattccttgccgctaccggcggggatatgaccatcttcgacaccccagaccgattggcggcattcggcggggtggctccagtgcccagggacagcgggaaaatcagcgggaatctccgtcgccctcagcgctacaataggcggcttcagagggtgttctatacttcggcactgtttagtatccgcaaatgtgaggaatcacgccgcttctacgaccggaaacgggctgaggggaaacgccatacccaagccgtcttagcgctggcacgtaggagagtcaacgtgctctgggcattgctgagagacggaagggcttacgaactcacgccgcccactgcgttggctgcctag

SEQ ID NO: 2604 - DNA, 1191 bp, Unknown
  Streptomyces sp. multi
atggcggccatctgggcgggcatcgacgcgggcaaaacacaccatcactgcgttgccatcgacgagtccggacgccgccttctctcacgccgcgtagctaacgatgagccggagctattggagcttctgaccgatgttcttgctctaggtgacgaggttacttggggcatcgacctggcggatggcggtgctgcattagccatcgccattctgctcaatcacgaccagcctgtaaactacatctctggcagagccatccaccgcgccagcgagagttacagaggtgagggaaagaccgacgcgaaagacgccgccgtgattgcggaccaagttcgaatccgtagagacctgaaccccttgaggacgggagacgagaccgtcacggacttgaagatcctgacaggacgacgcatggacctggtggcagatcggactaggacgattaaccgcctgagagcccaactcagcggcatcttccctggccttgaacgtgcgctggacctgacgaacaaaggaccactgacacttctcacaggataccaaacttcagcggcgatcaggcgacttggcaccaagcgcctagagacctggctcaggaaccgaaaagtgcttcgtgctgaccaactcgctgagactgctgtggctgctgccgagcgtcaacatacctcattgcctggtgaaaagctgactgcacagatggtgcatacacttgctaaggaggtgatggtactcactgaacaagtcgcagaggtggataagttaatcgaagctcggttcagagatcaccgccacttcgacgtgataacgtccatgccggggctgggcatcattctcggcgcggaattcttggcagctactggtggtgacatgacgatattcgacactccagatcgccttgcggccttcggaggagttgcccctgttccgcgcgacagtgggaagatcagtggcaacctccgtaggccacagcggtacaatagacggcttcagcgcgtattctacacttcagccctgttctcaatcaggaagtgcgaggagtccagacgcttttacgaccgcaagcgggccgaggggaaacgccacacacaggctgttctagctctggcgaggaggagagtcaacgtgctttgggctctcctgagggacggacgtgcgtacgaacttacccctccaactgctctggcggcgtga

SEQ ID NO: 2605 - DNA, 1131 bp, Unknown
  Bacillus sp. multi
atgcgcgtccaggaggttattctcgaaaatgggaagcgctacatcctggtggactccgacggcgtgccggtgatcccggtcgtcaagtacctcaaatacctcgacgtgaccggcaagtcgtccaacacgcagaaaacttactgctacgccctcaagcagtatttcctttacctacaggaaactgagaaggactacaagcacatccgactggaagacctcgtggagttcgtcggctggctccgcaacccttacgaaagcaccaaagtgatgagcctgcgcccggtgcagaccaagaagacggagcgcacagtcaacctgacggtcaccgccgtcacgaacttctacgactacctctaccgcaacgaggagctgcccctcgacatggaggagaagctgatacgccaagtgtttactggagggaggactcgatacaagagcttcctgcaccacgtgaacaaggacaagccgtccatgcggaacgtgctcaagatcaaggagccccggaagcgcgtgcagactctcaccattgagcaagtcgagcaagtgctcgcggccacgaccaacatccgcgacactttcctgatccgcctcctcttcgagaccgggctccgcatcggcgaggccctcagcctattcctggaggacttcaagttcagccaccagaaggggcaccgaatacggctcacagatcgtggcgagcttgagaactcggcgaagctgaaaaccggggagcgcgagatattcgtgagccaggagctgatggacctgtacgacgactatatgtacgacgtggtggatgagctggacttcgagacgaacttcgtcttcgtgaagctgcgcggcaagaaccggggcaagccgatgacctacggcgacgtggaagccctgtttaagaggctccggcaaaaaatcgggcttaacatccacccgcacctcttccgtcacacgcacgccaccatgtactaccaggagaccaaagacattaagcaagtccaggaacgcctcggtcattcccagatccaaaccacgatgaacctgtacctgcacccgtcggacgaggacacgcgcaaggtgtgggagaaggcccagggtgcgttccagattaagcagcagaacggtgggaaggagtga

SEQ ID NO: 2606 - DNA, 1131 bp, Unknown
  Bacillus sp. multi
atgcgcgtccaagaggtcatcttggaaaacggcaagcggtacatcctcgtggactcggacggcgtacccgtgatccccgtcgtcaagtacctcaagtacctggacgtaaccggcaagtcctcaaacacgcaaaaaacttactgctacgcgctcaagcaatacttcctgtacctccaggagactgagaaggattacaagcacatccgcttggaggacttagtggagttcgtcgggtggctcaggaacccgtacgagagcacgaaggtcatgagcctgcgcccggtccagaccaagaaaaccgagcggacagtgaacctcacagtcaccgccgtgacgaacttctacgactacctctaccggaacgaggagctgcccctggacatggaggagaagctgatccgccaagtattcaccggcggccggacccgctacaagtctttcctccaccacgtgaacaaggacaagccctcgatgcggaatgtcctcaagattaaggagccgaggaagcgcgtgcagaccctgaccatcgagcaagtggaacaagtcctagcggccaccacgaacatccgggacaccttcctgattcgcttgctgttcgagacggggctgcggatcggcgaggcactctccctgttcctggaggactttaagttctcccaccagaagggtcaccggattcggctgaccgataggggcgagctggagaacagcgcaaagctcaaaacgggcgagcgcgagatattcgtcagccaggagttgatggacctgtacgacgactatatgtacgatgtcgtggatgaactggacttcgagaccaacttcgtgttcgtgaagctccggggcaagaatcggggcaaaccgatgacgtacggcgacgtcgaggccctgtttaagcgactccgccagaagatagggctcaacatccacccgcacctgttccggcacacccacgcgaccatgtactaccaggagacgaaggacattaagcaagtccaagaacggctcggccactcccagatccagacgaccatgaacctgtacctccacccctcggacgaggacacccgcaaggtgtgggagaaggcacagggtgctttccagatcaagcagcagaacggcgggaaggagtag

SEQ ID NO: 2607 - DNA, 1131 bp, Unknown
  Bacillus sp. multi
atgagggtccaggaggtgatactggaaaatggcaagcgttacatactggtggactccgacggggtgcccgtgataccggtagtcaagtacctcaagtatcttgatgtgaccggcaagtcctccaacacgcagaagacgtactgctacgcgctcaagcaatattttctgtacctacaggagaccgagaaggactacaagcacatacgcttggaggatctcgtggagttcgtcgggtggctccgaaacccctacgagtccacgaaggtgatgagcctccggcccgtccagaccaagaagacggagcgtaccgtgaatctcacggtcaccgccgtgacgaacttctacgactacctctaccgcaacgaggaacttccgttggacatggaggagaagctcatccgccaagtgtttactggcggacggactcgttacaagagcttcctacaccacgtgaacaaggacaagccgtccatgcggaacgtcctcaagatcaaggagccccgcaagcgggtccagacgctgaccatcgagcaagttgaacaagtgctcgcagccacgacaaacatcagggacaccttcctgatccggttgctcttcgaaaccggcctccgaatcggggaggctctcagcctcttcctggaggacttcaagttcagccaccagaaggggcaccgtatccgcctcaccgaccggggcgagctggagaactccgcgaagctcaagacgggcgagcgggaaatcttcgtcagccaggagctgatggacctgtacgacgactatatgtacgatgtggtggacgagctggacttcgagacgaacttcgtgttcgtgaagctgcgcggcaagaacaggggaaagccgatgacctacggcgacgtggaggcgttgttcaagcggctccgccaaaaaatcgggctgaacatccatccgcacctcttccggcacacccacgccacgatgtactaccaggagacgaaggacattaagcaagtccaggagcgcctcggccactcacagatccagacgacgatgaacctatacctccacccgagcgacgaggacacccgcaaggtgtgggagaaggctcaaggggcgttccagatcaagcagcagaacggcggcaaggagtag

SEQ ID NO: 2608 - DNA, 1131 bp, Unknown
  Bacillus sp. multi
atgcgcgtacaggaggtgatccttgagaacggcaagcgctacatcctggtggactccgatggcgtgcctgtgatcccagtggtgaagtacctcaagtacctcgacgtgacggggaaaagcagcaatacccagaaaacatactgctacgcgctcaagcaatattttctctatctacaggaaaccgagaaggactacaagcacatccgcctggaagacctcgttgagttcgtcgggtggctccggaatccgtacgagtccacaaaggttatgtcgctgcggcccgtgcagaccaagaaaacagagcgcaccgtgaacctcaccgtcacggccgtcaccaacttctacgactacctctaccgcaacgaggaactgccgctcgacatggaggagaagctcatccgccaagtcttcactggcggccggacccggtacaagtccttcctgcaccacgtcaacaaggataagccctctatgaggaatgtgctcaagatcaaggagccccgcaagcgcgtccagacgctcaccatcgagcaagtggaacaagttctcgccgcgacgaccaacatccgggacaccttcctcatccgcctcctcttcgagacgggcctccggatcggcgaggccctgtcgctgttcctggaggacttcaagttcagccaccagaagggccaccgcatccggctcactgatcgcggggagctggaaaacagtgcgaagttgaagactggcgagcgcgagatattcgtgtctcaggagctgatggacctttacgacgactatatgtacgatgtcgtggacgaactggacttcgagacgaacttcgtcttcgtgaagctacgcggcaagaatcggggaaagccgatgacgtacggcgacgtggaggcccttttcaagcggttgcgccagaagatcggtcttaacatacacccgcacctgttccgccacactcacgcgaccatgtactaccaggagacgaaggacattaagcaagtgcaagagcgcctggggcactcacagatccagaccaccatgaacctctacctccacccctcagacgaggacacccgcaaggtgtgggagaaggctcagggcgctttccagatcaagcagcagaacggcgggaaggagtga

SEQ ID NO: 2609 - DNA, 1131 bp, Unknown
  Bacillus sp. multi
atgcgggtccaggaggtgattctcgaaaacggcaagcggtacatcctcgtggatagcgatggtgtgcccgtgattccggtggtgaagtacctcaagtacctcgacgtgacgggcaagtcgagcaatacccagaaaacgtactgctacgcgctcaagcaatattttctatacctacaggaaactgagaaggactacaagcacatccgcctggaagacttagtggagttcgtcggctggctccgcaacccctacgagtccacaaaggtcatgtcgctgcggccggtgcagaccaagaagactgagcgcaccgtgaacctgaccgtcacggccgtcacgaacttctacgactacctctaccggaacgaggagctgccgcttgacatggaggagaagctgatccgccaagtgttcactggcgggcgcacccgctacaagtccttcctgcaccacgtcaataaggacaagccgtccatgcggaacgtattgaagatcaaggagccgcgaaagcgggtccagaccctcaccatcgagcaagtcgaacaagttctggcggccacgacaaacatccgcgacaccttcctgatccgcctgctgttcgagaccgggctcagaattggcgaggctctctccctgttcctggaagactttaagttctcgcaccagaagggccaccgcatccgcctcacagacaggggagagctggagaacagcgccaagttgaagaccggcgagcgcgagatattcgtgtcccaggagctgatggacctctacgacgactatatgtacgacgtagtggacgagctggacttcgagaccaacttcgttttcgtgaagctgcgtggcaagaatcgagggaagcccatgacctacggggacgtggaggccctattcaagcgcctgcgccagaagatcggtctgaacatccacccgcacctgttccgccacacccacgcgaccatgtactaccaggagacgaaggacattaagcaagtgcaagagcgtcttggccacagccagatccagaccacgatgaacctttacctgcacccgtcggacgaggacacgcggaaggtctgggagaaggcacagggtgcgttccagatcaagcagcagaacggcgggaaggagtag

SEQ ID NO: 2610 - DNA, 3018 bp, Unknown
  Bacillus sp. multi
atgccgagcattgaggacacggcctacccgcgcctcaagtccaacccgagccagaaggagctgcaagagctgtactcgcccaccatcgaggagatccattggatgaagccgcacgtgaaaggtgacgtcgccaagctcggggtgttcgtcctcctcaagaccttccagcgcctcggctacttcctgcccgtgacggagatcccggaggacatcgtgatccacatcgcccagaagatgaatctcacgctcgtgtcgcgcaacgacctccagaagtaccacaactccggcacccagaagcggcaccacgcgctcatccgcgagtaccggaacatccacttcttcaatgaccaggcacggaagataatgatcgacaccatgaaccaagtctcatccacgaaagatgactcggcggacttcatcaacgcggccatcgacgagctgatccgccagcgcttcgagctgccgaccttctccaccctcaacgagaccgccaagcggctccggtcgcagagctaccacgtcgtgtacgaacaagtatatcagtccatcaacgagaacgacaagaacaagatcgactcactcttccagacgaacgacggcactgtctatacaccctggcaccacttgaagcaagacgctaagaacccgaccatcaagcacttccgggagttggtgacccagatggagtggctcatggcccagaaggtgaacaccaccatcctcaagagcatccccagcgtgaagatccgccagatgactagcgaggccaagaccctcgacgcggcccgcatgaagaaaatggagcccaagaaacgctacgcgctggcactcagcttcatccagagccagctcgcgcatgtcctggacaacattggcgagatgatggtcaagcgaatgatgtccgcccgcaacaagtcccgtgaccagctccagcactaccagatgaaaaaccagaagcgcacggacctgctgattaccacactctacgacgtcatcctcgcctaccggtcaggcaacgagtcccaggacaagatggaggccatcgaacaagtagtcggaaaccgccacgaggagatccttcacgactgcgagtcccacctggcgtactccggagacaactacttcgtcttcgtgtgggactactacaagtcgtccagatccacactattcaaaatcctcaacacggtgagcctgcggagcaccaaccaggatcaggggctggaggacgctatcgccttcctcaagactcaccagaacagccgcaaggagtcgctgtctattgtgagcattgagaagaaaggatattggaaaaaggaaatcaagccattgctggacctgagttggattcccgacgcctggtggaggtggatcgcgccaaaccgtaagtccggttgctacccggaggaggtgaaccggcggcacttcgaagcctgcgtgttcacccagatcatgtggggcttgaagtcgggcgacctgtacatcgagggcagcgagaagtacgcggactaccgacagcaactcattagctggaacgagtacgagcagaagctgctcgacttctgccacaagtccaatctgccctctacaggcaaggagtacgtcaagcagctccgtaagcggttcatgaagatcgccaaaaaaaccgacgcctccttcccctacaacaagcaagtcaggatcgagaacggggagatcgtcattgggaagtccaaaaaacggaagcccagccccaagctaaagagcctggagaagtacatgacacaaaatcttgttcctatcaacgtgctcgacatgctcggcgacaccgagcactggctgaactggaccagattctttaagcccatcagcaagcacgaggcccgtctggaagaccctatcgagcgctacctcaccaccgtgttctgctacggctgcaacctcggcccggtgcagacggcgcgtagcctcggcaacatggaccgccgccagataagctgggtcaaccagcggcacatcacgacggagaacttggaccaagcgattcagttcatcatcaactcgtacaacaagttcgggctcccgaaatattggggcgacggcaagagcgcatccgccgacggcacgatctgggccctctacgagcagaacctgctgagcgagcgtcacatccggtacggcggctacggcggcattggctactaccacgtctcggacaactacatcgccctgttcagccacttcatcccctgcggcgtgtgggagggcctgtacatcctggatgttctgatgaacaataactccgagatccagcctgaggtgatccactcggacacccaggggcagtccgccacaatcttcggcctctcgaccctgatggggatcgagctgatgcctcgcatccggaactggaaagaccttaagatgttccgcccggacaaggagtcccgcttcaagcacatcgacgacatattcacggacgagatcgactgggatctgatcgagatccactacaaggacatgctccgggttgccatgagcatcgaggtgggcaagatcactccctccaccatcctcaacaagctcggcacgtacagcaagaagaacaagctctaccaggcgttccgggagctgggccgggtcatacgcaccatgttcctcctcaagtacatcgccgacgagcagctccgccgcaccatccagaccgcgaccaacaagagcgagagcttcaacggcttcacgaagtggttattctttggaggggaggggatcatcaccgagaacaacagggagaatcagcggaaggtcatcaagttcaaccacctggttgccaactgcttgatattctacaatgtctttgctttgactcaagtgttacacgcttaccgccaggacggcaacgagctggacgaggaggtgctgtcggagctgtcgccctacatcacggcccacgtcaaccggttcggcaagtacgggatcgaccccaaccggcagccgcccgaccttcaattcgacatgcccatctaccaagtggccaactga

SEQ ID NO: 2611 - DNA, 3018 bp, Unknown
  Bacillus sp. multi
atgccctcaatcgaggacacggcgtacccgcgcttgaagtccaacccgtcgcagaaggagctgcaagagctgtactccccgacaattgaggaaattcactggatgaagccccacgtcaagggcgacgtggcgaagctcggcgtgttcgtcctcctcaagaccttccagcgcctcgggtacttcctccccgtcacggagatcccggaggacatcgtgatccacatcgcccagaagatgaatctcaccctcgtgtcccggaacgacctccaaaagtaccacaactccgggacgcagaagcggcaccacgcgctcatccgcgagtaccggaacatccatttctttaacgaccaggcgcgcaagatcatgattgacacgatgaaccaagtatccagcacaaaggacgactccgccgacttcatcaacgccgctatcgacgagcttatccgccagcgcttcgagctgccgacgttctcgacgctcaacgagaccgcgaagcgcctgcgctcccagtcctaccacgtcgtgtacgaacaagtatatcagagcatcaacgagaacgacaagaacaagatcgacagcctctttcagacgaacgacggcacagtctatacaccctggcaccacctcaaacaagatgccaagaacccgaccattaagcacttccgcgaacttgtgacccagatggagtggctgatggcccagaaggtgaacaccaccatccttaagtccatacccagcgtcaagatccgccagatgaccagcgaggccaagaccctcgacgcggcccgtatgaagaagatggagcccaaaaaacgctacgcgctggcgctcagcttcatccagtcccaactggcgcacgtgctcgacaacatcggcgagatgatggtcaagaggatgatgtccgcgcgcaacaagagccgggaccagctccagcactaccagatgaagaaccagaagcgcacggacctacttattacgaccctctacgacgtgatccttgcctaccggtctggcaacgagagccaggacaagatggaggccatcgaacaagtggtcgggaaccggcacgaggagatcctgcacgactgcgagagccaccttgcgtactcgggcgacaactacttcgtgttcgtctgggactactacaagtcctcccggagcactctgttcaagatcctgaacacggtgtccctgcggagcaccaaccaggatcaggggcttgaagatgccattgctttccttaaaactcaccagaacagccgcaaggagtcgctgagcatcgtgtccattgagaagaaaggctactggaagaaagagattaaaccactgctggacctgagctggattccggacgcttggtggcgctggatcgcacctaaccgcaagtctggctgctaccccgaggaggtcaacaggcgacactttgaggcgtgcgtgttcacccagataatgtggggcctcaagtccggcgacctctacatcgaggggtccgagaagtacgcggactaccgacagcagctcatctcgtggaacgagtacgaacagaagctcctcgacttctgtcacaagagcaacctcccgtccaccggcaaggagtacgtcaagcagctccgaaagcggttcatgaagatcgccaagaaaacagacgcgagcttcccgtacaacaaacaagtcagaattgagaacggcgagatcgtgatcggcaagagcaaaaagcggaagccatctcccaagctcaagtcactggagaagtacatgacacagaacttggtgcctattaacgtgctggacatgctaggagacacggagcactggctcaactggacacggtttttcaagcccatcagtaagcacgaggcccggctggaagaccctattgaacgctacctcacgaccgtgttctgctacgggtgcaacctgggccctgtgcagaccgcccgcagcctgggcaacatggaccggcggcaaatcagttgggtcaaccagcggcacatcaccaccgagaatttggaccaggcaatccagttcatcatcaactcctacaacaagttcggcctcccgaaatattggggcgacggcaagagcgcctccgccgacggcaccatctgggctctgtacgagcagaacctgctcagcgagcgccacatccggtacggcggctacggcggcattggctactaccacgtcagcgacaactacatcgcgctgttctcccacttcatcccctgcggcgtgtgggaggggctctacatcctggacgtgctcatgaacaacaactcggagatccagccggaggtcatccacagcgacacccagggccagagcgcgaccatattcggcctgagcacgctcatgggcatcgagctgatgcctcgcatccgtaactggaaagacttaaagatgttccgcccggacaaggagtcgcggttcaagcacatcgacgacatattcacggacgagatcgactgggatctgatcgagatccactacaaggacatgctccgggtggccatgagcatcgaggtcggcaagatcaccccgtccaccatcctcaacaagctgggcacctactccaagaaaaataagctctaccaggcgttccgtgagctgggccgcgtcatccgcacgatgttcctactcaagtacatcgccgacgagcagctccggcgcaccatccagaccgccacgaacaagtcggagtccttcaacgggttcacgaagtggctctttttcggcggcgaagggataatcaccgagaacaacagggagaaccagcggaaggtcatcaagttcaaccatctcgtcgccaactgcctgatattctacaatgtcttcgccctgacacaagtgctccacgcttaccgccaggacgggaacgagcttgacgaggaggtgctgagcgagctgagcccgtacatcaccgcgcacgtcaaccgcttcgggaagtacggcatcgaccccaaccggcagccgccggacctccagttcgacatgccgatctaccaagttgccaactag

SEQ ID NO: 2612 - DNA, 3018 bp, Unknown
  Bacillus sp. multi
atgccgagcatcgaggacaccgcctacccgcgcctcaagtcgaatccatcccagaaggaactacaggagctgtactcgcccacaattgaggagatccattggatgaagccgcacgtcaagggcgacgtggcgaagctaggcgtgttcgtcctcctcaagaccttccagcgcctcgggtacttcctcccggtcacggagatccccgaggacatcgtgatccacatcgcgcagaagatgaatctcacgctcgtgagccggaacgacctccaaaagtaccacaacagcggcactcagaagcggcaccacgccctgatccgggagtaccggaacatccatttttttaacgaccaagcgcggaagatcatgattgacacgatgaatcaggtgtccagcacgaaggatgacagcgccgacttcatcaatgccgccatcgacgaactaatccgccagcgcttcgagctgccgacgttctccaccctcaacgagacggcgaagcgcctccggtcccagtcgtaccacgtcgtttacgagcaagtgtaccagtcgatcaacgagaacgacaagaacaagatcgactcgctcttccagacaaacgacggaacggtttacaccccgtggcaccacctcaaacaagatgccaagaatcccaccattaagcactttcgggagcttgttacacagatggagtggctcatggcgcaaaaggtcaacaccactatccttaagtccattcccagcgtgaagatccggcaaatgacaagcgaggcgaagaccctggacgcggcgcggatgaaaaagatggagcccaagaaacgctacgccctggccctgtccttcatccagtcccagctcgcgcacgtcctcgacaacatcggcgagatgatggtgaagcgcatgatgagcgcgcgcaacaagtcgcgggaccagctccagcactaccagatgaagaatcagaagcgcacggacctgttgataaccaccctgtacgatgtcatcttagcataccgctccgggaacgagtcccaggacaagatggaggcaatcgaacaagtggtcggcaatcggcacgaggagatcctccacgactgcgagtcgcacctggcctactccggggacaactacttcgtgttcgtctgggactactacaagtcgagccgcagcaccctcttcaagatcctcaacacggtgagcctccgctcgaccaaccaggaccagggtcttgaggacgccatcgccttcctcaaaacccaccagaactcccggaaggagtcgctgtccatcgtgtccatcgaaaaaaaggggtactggaagaaagagatcaaaccgctcctcgacctgtcgtggattccagatgcctggtggaggtggatcgctcccaaccggaagtcgggctgctaccccgaggaggtcaacaggcggcacttcgaggcgtgcgtgtttacccagatcatgtggggcctcaagagcggcgacctctacatcgagggctcggagaagtacgcggactaccgccagcagctcatctcgtggaacgagtacgagcagaagctactcgacttctgccacaagagcaacctgccgagcaccggcaaggagtacgtcaagcagctccggaagcggttcatgaagattgccaagaaaacagacgcctccttcccgtacaacaaacaagtaaggatcgagaacggcgagatcgtgatcggcaagagcaagaagcgaaagccctcgccgaagctcaagtccctggagaagtacatgacgcagaacctcgtgcctatcaatgtgctggacatgctcggggacaccgagcactggctcaactggaccagattctttaagcctatcagcaagcacgaggcccgcctggaagatcccattgagcgctacctgacgaccgtgttctgctacggctgcaacctcggccccgttcagacggcccggagcctgggcaacatggacaggcgtcagataagctgggtgaaccagaggcacatcaccacggagaatttggatcaggcgatccagttcatcatcaacagctacaacaagttcggcctgccgaagtattggggcgacggaaagagcgcgagcgccgacgggaccatctgggcactgtacgagcagaacctgctgtcagagcgccacatccggtacggcgggtacggcgggatcggctactaccacgtgagcgacaactacatcgccctgttctcccacttcatcccctgcggggtgtgggagggcctctacatcctcgacgtgctcatgaacaacaacagcgagatccagcccgaggtgatccactcggacacccaggggcagtcggcgaccatcttcgggctgagcacgctcatgggcatcgagctgatgccccggatacggaactggaaagaccttaagatgttccggcccgacaaggagagccggttcaagcacatcgacgacatcttcaccgacgagattgactgggatcttatcgagatccactacaaggacatgctgcgcgtggccatgagcatcgaagtgggcaagatcactccgtccaccatcctgaacaagctgggaacgtacagcaaaaagaacaagctctaccaggcgttccgggagctgggcagagtcatccggacgatgttcctgctcaagtacatcgcggacgagcagctccgtcgcacgatacagaccgccacgaacaagtccgagtcgttcaacggcttcacgaagtggctgttcttcggtggcgagggcatcatcacggagaacaacagggagaaccagcgtaaggtcatcaagttcaaccatctagtcgccaactgcttgatattctacaacgtcttcgcccttacccaagtgctacacgcatatcgccaggacggcaacgagctggacgaggaggtgctcagcgaactgagcccgtacatcacggcccacgtcaaccgtttcggcaagtacggcattgaccccaaccggcagccgccggacctccaattcgacatgccgatctaccaagtggcaaactga

SEQ ID NO: 2613 - DNA, 3018 bp, Unknown
  Bacillus sp. multi
atgccgtccatcgaggacaccgcctacccgcgcctcaagtccaacccctcgcagaaggagctacaggagttgtactccccgacaattgaggagattcactggatgaagcctcacgtgaagggcgacgtggccaagttgggcgtgttcgtcctgctcaagacgttccagcgcctcggctacttcctcccggtgactgagatccccgaggacatcgtgatccacatcgcgcagaagatgaatctgaccctggtcagccgcaacgacctacagaagtaccacaacagcggcacacaaaagcggcaccacgcgctcatccgcgagtaccgcaacatccatttcttcaacgaccaggcgcggaagattatgattgacacgatgaaccaagtaagtagcacgaaagatgactcggcggacttcatcaacgcggcgatagacgagctgattcggcagcgcttcgagctgccgacgttctccacattgaacgagacggccaagcggctgcgctcgcagtcgtaccacgtcgtgtacgaacaagtatatcagagcatcaacgagaacgacaagaacaagatcgactccctgttccagaccaacgacggcaccgtctatacgccgtggcaccacctcaaacaggacgccaagaaccccaccatcaagcacttccgcgaactcgttacccagatggagtggctcatggcgcagaaggtgaacacgaccatcctaaagtccatccccagcgtgaagatcaggcagatgacgagcgaggcgaagacactcgacgccgctcgcatgaagaaaatggagcccaagaaacgctacgcacttgcactgagcttcatccagtcgcaactcgcccacgttctcgacaacatcggggagatgatggtcaagcggatgatgagcgcccgcaacaagtcgagggaccagctccagcactaccagatgaagaaccagaagcgtaccgacctcctgattacaaccctctacgacgtgattctggcctaccgtagcggcaacgagtcccaggacaagatggaggccatcgaacaagtcgtgggcaaccgccacgaggagatcctccacgactgcgagtcccacctggcctactccggcgacaactacttcgtgttcgtctgggactactacaagtcgtcccgcagcaccctattcaagatcctgaacacagtgagcctgcggagcacaaaccaggaccaggggcttgaggacgccatagcgttcctcaaaacccatcagaactctcggaaggagagtctcagcatcgtgagcatcgagaagaaaggatactggaagaaagagatcaaacctctccttgacctgagttggattcctgacgcctggtggcggtggattgccccgaaccggaaatctgggtgctacccagaggaggtgaaccggcggcacttcgaggcgtgcgtgttcactcagatcatgtggggcttgaaatcgggcgacttgtacatcgaagggtcggagaagtacgccgactaccggcagcagctcattagctggaacgagtacgagcagaagctcctggacttctgccacaagtccaacctgccctccaccggcaaggagtacgtcaagcagctccgcaagcggtttatgaagatcgccaagaagaccgatgcctcgttcccctacaacaagcaagtccggatcgagaacggggagatcgtgatcggcaagtccaagaagcggaagccctcgccgaagctgaaatcgctggagaagtacatgacgcagaacttggtccccatcaacgtgctcgacatgctcggcgacaccgagcactggcttaactggactcgcttttttaagccgatctccaagcacgaggcccggctggaagatcccattgagcgctacctcaccaccgtgttctgctacgggtgcaacctggggccggtccagaccgcccggtcgctgggcaacatggaccgccgccagataagctgggtcaaccagcggcacatcacgaccgagaacttggaccaagccatccagttcatcatcaactcctacaacaagttcgggctgccgaaatattggggcgacgggaagtcggcctccgcagacggcaccatctgggccctctacgagcagaacctgctgtccgagcgccacatccgctacggcgggtacggcgggatcggctactaccacgtctctgacaactacatcgcgctgttcagccacttcatcccctgcggggtgtgggaagggctgtacatcctggacgtgctcatgaacaacaactccgagatccagccagaggtcatccactctgacacgcaagggcagtcggcgacgatcttcggcctgtccaccctgatgggcatcgagctgatgccccgcatccggaactggaaggatctcaagatgtttcgcccggacaaggagagccggttcaagcacatcgacgacatcttcaccgacgagatagactgggatctgattgaaatccactacaaggacatgctgcgcgtggcgatgagcatcgaggtcgggaagatcaccccgtccacaatcctgaacaagctcggcacatatagcaaaaaaaataaactctaccaggcgttccgggagctgggccgggtgatccgaaccatgttcctgctcaagtacatcgccgacgagcaactcagacgcacgatccagaccgcgaccaacaagagcgagtccttcaacggcttcacgaagtggctcttttttggcggcgaaggaatcattacggagaacaatagggagaaccagcgcaaggtcatcaagttcaaccacctcgtcgccaactgcctgatattctacaatgtcttcgcgctgacccaagtgctccatgcctaccgccaggacgggaacgagctggacgaggaagtgctgtccgaactgtcaccgtacatcaccgcccacgtgaaccgcttcggcaagtacgggatcgacccgaaccgccagccgcccgacttgcagttcgacatgcccatctaccaagtcgccaactag

SEQ ID NO: 2614 - DNA, 3018 bp, Unknown
  Bacillus sp. multi
atgccgtctatcgaagacaccgcctacccgcgcctcaagagcaacccgtcgcagaaggaactgcaagaattgtactccccgaccatcgaggagatccactggatgaagccccacgtcaagggtgatgttgccaaactcggcgttttcgtgcttctcaaaacctttcaacggctcgggtacttcctccccgtgacggagatccccgaggacatcgtgatccacatcgcgcagaagatgaatctcactctcgtctcgcggaacgacttgcagaagtaccacaacagcggcacgcagaagcgccaccacgcgctgatccgggagtaccggaacatccactttttcaacgaccaggcgcggaagattatgattgacaccatgaaccaagtttcaagcactaaggacgactccgccgacttcatcaacgcggccatcgacgagctgatccgccagcgcttcgaactgccgacgttttccacgctgaacgagaccgccaagcgcctccgcagccagtcctaccacgtcgtgtacgaacaagtctatcagagcatcaacgagaacgacaagaacaagatcgactccctgttccagacgaacgacggcaccgtctataccccgtggcaccacctcaagcaagacgccaagaacccgacgatcaagcacttccgggaactcgtcacacagatggagtggctgatggcgcagaaggtgaacaccaccatcctcaagtccatcccgtccgtgaagatccgtcagatgaccagcgaggccaagacgctcgacgccgcccgcatgaagaaaatggagcccaaaaagcgttacgcactcgcgctcagcttcatccagtcgcagttggcgcacgtgctggacaacatcggcgagatgatggtcaagcggatgatgtcggcgcggaacaagagccgcgaccagttgcagcactaccagatgaagaatcagaagcgcacagaccttctcatcacgacgctgtacgacgtcatcctcgcgtaccgctcgggcaacgagtcccaggacaagatggaggccatcgaacaagtagtggggaacaggcacgaggagatcctccacgactgcgagagccacctggcgtactccggcgacaactacttcgtcttcgtgtgggactactacaagtcttcgcgtagcacgttgttcaagatcctcaacaccgtcagccttaggtccactaaccaggatcagggactggaggacgccatcgccttcctcaaaacccatcagaacagccgtaaggagagcctgtcaatcgtgagcatcgagaagaaaggatactggaaaaaggaaattaagccgctgctggacctgagctggattccggacgcttggtggcgatggatcgcgccgaacaggaagtccgggtgctaccccgaggaggtgaaccggaggcactttgaagcctgcgtgtttacacagatcatgtggggcctcaagagcggcgatctctacatcgagggcagcgagaagtacgccgactaccgccagcagcttatctcgtggaacgagtacgagcagaagctattggacttctgccacaagtccaacctccccagcaccggcaaggagtacgttaaacagttgagaaaacggttcatgaagatagccaagaagaccgacgcctccttcccctacaacaagcaagtgcggattgagaacggcgagatcgtaatcggaaagtccaagaagcgcaagccctccccaaagctcaagagcctggagaagtacatgacacagaacctcgtccccatcaatgtgctagacatgctcggcgacaccgagcactggctcaactggacgcggttttttaagccgatctccaagcacgaggcccggctggaagatcccattgagcgctacctcaccaccgtgttctgctacggctgcaacctcggcccggtgcaaactgctcgctcactgggcaacatggacaggaggcagatcagttgggtcaaccagcgccacatcaccaccgagaacctcgaccaggccatacagttcattatcaactcctacaacaagttcggcctgcctaagtattggggcgacggcaagtccgcctcggccgacggcaccatctgggctctttacgagcagaacctgctgtcggagcgccacatccgctacggcggctacggcggcatcggctactaccacgtcagcgacaactacatcgcgctgttctctcacttcatcccctgcggggtgtgggagggcctctacatcctggacgtgctgatgaacaacaacagcgagatccagcccgaggtgatccacagcgacacccagggccagagcgcgacgatcttcggcctgagcaccctcatgggcatcgagcttatgccccgaatccgcaactggaaagaccttaaaatgtttcgccccgacaaggagagccggttcaagcacatcgacgacatattcacggacgagatcgactgggatctgatcgagatccactacaaggacatgctgcgggtggcgatgtccatcgaggtcgggaagatcacgcccagcaccatcctcaacaagctcggcacgtactccaagaaaaataaactgtaccaggctttccgcgagctggggcgggtcatccgaacaatgttcctcctcaagtacatcgccgacgagcagctccgacgtacgatccagacggccaccaacaagtcggagagcttcaacggcttcacaaagtggctcttcttcgggggtgagggcatcataaccgagaacaaccgggagaaccagcggaaggttatcaagttcaaccacctggtcgccaactgcctgatattctacaacgtcttcgcactgacccaagtattgcacgcttaccgtcaggacggcaacgagctggacgaggaggtgctgtccgagctgagcccgtacatcacggcccacgtcaaccgattcggcaagtacgggatcgaccccaaccgacagccgccggacctccagttcgacatgccgatctaccaagtcgccaactga

SEQ ID NO: 2615 - DNA, 1464 bp, Unknown
  Bacillus sp. multi
ctcatcacgtcccggaagatccgcctgtccatcgtctccgacaacagcaccgaggcgtacaacttcatccgcaaggagatgcgggagcagaacaaggccctgaacgtggccatgaaccacctctacttcaactacgtcgcccgccagaaaatttcgtttgcggacaaggcgtaccagcacaagctcaacaaggccatcgaggcgcagcagaagtccttcatcctgctcaaggagctggagcagaagcagatcgtcgagacggactccagcaagaagtccatactcaaggagcgcctcatcaagtcgaagacgacctacgagaaaacgaaggagaaactgtccagcctccggaaggcgcgcaacaaggagctgttccaggagtacaacaacatgatcgggcagcttgaggaaacacacctccgcgacatcgtgagcagccagttcaacctgctctcggacacgaaggaccgcctcacgaagatcgcctaccaggacttcaagaacgacatcaccgaggtgctgtccggcgaccgctcgctccggacgtacaagaaaaacaatccgctctacatccggggccggacgctgaacctgttcaaggagagcgaggaattctttatcaagtggaccaagaagatcgtcttcaagtgcgtgctgggcgtgaagtaccagaacaagacggagctgtacaagaccctggagtgcatcctgaccggcgagtacacgctgtgcgacagctccatgaacttcaaccagcagaacaagctgatcctgaacctggcgctgaacatcccggagaagtccgagaaccgcaaggtgcccggccgcatcgccgggatcgacctcggcctcaagatccccgcctacttcgccgtgaacgacgtgccgtacatccgcaaggccctcggcaagatcgaggacttcctcaaggtgcggacgaacatccagtcccagaagcggtccctccagcgggccctccagtccagcaagggcggcaagggccgcaaaaagaaactgaaagccctcgaccagttcaaggagaaggagaaaaactacatcatcacgtacaaccacttcatctccaaaaagatcatctcgctcgccgtccagtacggggtggagcagatcaacctggaattgctcacgctcaaggagacccagaagaaaagtctcctgcggaactggagctactaccagctccaacagttcatcgagtacaaggccaaccgcgaggagatcagcatcaagtacgtggacccgttccacacctcccagacctgctccaagtgcggccactacgaggacggccagcgggagaaacaagataccttctgctgcaagagctgcgggttcatcgacaacgccgactacaacgccgcccggaacatcgcggcgagcacccggtacatcaccaacaaggaggagtccgagtattaccgcaagaacaacaacgagatcgcctga

SEQ ID NO: 2616 - DNA, 1464 bp, Unknown
  Bacillus sp. multi
ctcatcacctcccggaagatccggctcagcatcgtgtcggacaacagcacggaggcgtacaacttcatccgcaaggagatgcgggagcagaacaaggccctcaacgtcgccatgaaccacctgtacttcaactacgtggcccggcagaaaatttccttcgccgacaaggcgtaccagcacaagctgaacaaggccatcgaggcgcagcagaagtccttcatcctgctcaaggagctggagcagaagcagatcgtcgagaccgacagctccaagaaatctattctcaaggagcggctcatcaagtccaagaccacgtacgagaagacgaaggagaagctgagcagcctccggaaggcgcgcaacaaggagctgttccaggagtacaacaacatgatcgggcaacttgaagagacccacctccgcgacatcgtgtccagccagttcaacctgctgtccgacacgaaggaccgcctcaccaagatcgcctaccaggacttcaagaacgacatcaccgaggtgctctccggcgaccgctccctccgcacgtacaaaaagaacaatccgctctacatccggggccggacgctgaacctgttcaaggagtccgaggagttctttatcaaatggaccaagaagatcgtcttcaagtgcgtgctcggcgtgaagtaccagaacaagaccgagctgtacaagaccctggagtgcatcctgaccggggagtacacactctgcgactcgtccatgaacttcaaccagcagaacaagctcatcctcaacctcgccctcaacatcccggagaagtcggagaaccggaaggtgcccggccgcatcgcgggcatcgacctgggcctcaagatccccgcgtacttcgccgtgaacgacgtgccctacatccgcaaggcgctgggcaagatcgaggacttcctcaaggtccggacgaacatccagagccagaagcgctccctccagcgcgccctccagagcagcaagggcggcaaggggcgcaagaaaaagctcaaggcgctcgaccagtttaaagaaaaggagaagaattacatcatcacctacaaccacttcatctccaagaaaatcatctcactcgccgtgcagtacggcgtcgagcagatcaacctggagctgctcacgctcaaggagacccagaagaaatcactgctccgcaactggagctactaccagctacaacagttcatcgagtacaaggcgaaccgcgaggagatcagcatcaagtacgtggacccgttccacacctcccagacgtgcagcaagtgcggccactacgaggacggccagcgggagaagcaggacaccttctgttgcaagtcgtgcggcttcatcgacaacgccgactacaacgccgcgcgcaacatcgccgcctcgacccggtacatcacgaacaaggaggagtccgagtattatcgcaagaacaacaacgagatcgcctag

SEQ ID NO: 2617 - DNA, 1464 bp, Unknown
  Bacillus sp. multi
ctcatcacgtcgcgcaagatccggctctccatcgtgtccgacaactcgaccgaggcgtacaacttcatccgcaaggagatgcgcgagcagaacaaggccctcaacgtggccatgaaccacctgtacttcaactacgtcgcccggcagaagatttcgttcgccgacaaggcgtaccagcacaagctgaacaaggccatcgaggcccagcagaagtccttcatcctgctcaaggagctggagcagaagcagatcgtggagaccgacagctccaagaagtctatcctcaaggagcggctcatcaagagcaagacgacctacgagaaaacgaaggagaagctgtcgtcgctccggaaggcgcgcaacaaggagctgttccaggagtacaacaacatgatcggccaactggaggagacacacctccgggacatcgtgtcctcgcagttcaacctcctgtcggacacgaaggaccgcctcacgaagatcgcgtaccaggacttcaagaacgacatcaccgaggtgctgagcggcgaccgcagcctccgcacgtacaagaagaacaacccgctctacatccggggccggaccctcaacctgttcaaggagtccgaggaattctttattaagtggaccaagaagatagtcttcaagtgcgtgctcggcgtcaagtaccagaacaagaccgagctgtacaagacgctggagtgcatcctcaccggggagtacaccctatgcgactccagcatgaacttcaaccagcagaacaagctgatcctgaacctcgccctgaacatcccggagaagtcggagaaccggaaggtgccggggcggatcgcgggcatcgacctggggctcaagatccccgcctacttcgccgtgaacgacgtgccgtacatccgcaaggccctcggcaagatcgaggacttcctcaaggtccgcaccaacatccagtcccagaagcgctcgctccagcgcgccctccagagcagcaagggcggcaaggggcgcaagaagaaactcaaggccctggaccagttcaaggagaaggagaagaattacatcataacctacaaccacttcatcagcaagaaaataatcagcctcgcggtgcagtacggcgtggagcagatcaacctggaacttctcacgctcaaggagacgcagaagaagtcgctcctccgcaactggagctactaccaactccaacaattcatcgagtacaaggccaaccgggaggagatcagcatcaagtacgtggaccccttccacaccagccagacctgctcgaagtgcggccactacgaggacgggcagcgggagaagcaagacaccttttgttgtaaatcctgcggcttcatcgacaacgccgactacaacgcggcccgcaacatcgcggcgtccacccgctacatcaccaacaaggaggagtccgagtattatcgcaagaacaacaacgagatcgcgtag

SEQ ID NO: 2618 - DNA, 1464 bp, Unknown
  Bacillus sp. multi
ctcatcacctcccggaagatccggctgtccatcgtgtcggacaactccacggaggcgtacaacttcatccgcaaggagatgcgggagcagaacaaggccctcaacgtggccatgaaccacctgtacttcaactacgtggcgcggcagaaaatttccttcgcagacaaggcgtaccagcacaagctcaacaaggccatcgaggcgcagcagaagtcgttcatcctgctcaaggagctggagcagaagcagatcgtggagaccgactccagcaagaagtcgatactcaaggagcgcctcatcaagagcaagaccacgtacgagaagacaaaggaaaagctgtccagcctgcggaaggcccgcaacaaggagctgttccaggagtacaacaacatgatcgggcaactcgaggaaactcacctccgcgacatcgtgtcgagccagttcaacctcctgtcggacacgaaggaccgcctgaccaagatcgcctaccaggacttcaagaacgacatcaccgaggtgctgagcggcgaccgcagcctccggacctacaagaaaaacaacccgctctacatccggggccgcacgctgaacctgttcaaggagtccgaggaattcttcatcaagtggaccaagaaaattgtcttcaagtgcgtgctgggcgtgaagtaccagaacaagaccgagctgtacaagaccctggagtgcatcctcaccggcgagtacactctgtgcgacagcagcatgaacttcaaccagcagaacaagctcatcctgaacctggccctgaacatccccgagaagtcggagaaccggaaggtgccgggccgcatcgccgggatcgacctcggcctcaagatccccgcctacttcgccgtcaacgacgtgccgtacatccgcaaggcgctggggaagatcgaggacttcctcaaggtgcggaccaacatccagagccagaagcggtccctccagcgggcgctccagagcagcaagggcgggaagggccgcaagaagaaactcaaggccctggaccaattcaaggagaaggagaagaactatatcatcacctacaaccacttcatctccaaaaagataatttccctcgccgtgcagtacggcgtggagcagatcaatctggaactgctcacgctcaaggagacccagaagaaatcgctgctccgcaactggtcgtactaccagctccagcagttcatcgagtacaaggccaaccgcgaggagatcagcatcaagtacgtggaccccttccacacctcccagacgtgcagtaaatgcgggcactacgaggacgggcagcgcgagaagcaggataccttctgctgcaagtcctgcggcttcatcgacaacgccgactacaacgcggcccgcaacatcgccgcctccacccggtacatcaccaacaaggaggagtcggagtattaccgcaagaacaacaacgagatcgcctga

SEQ ID NO: 2619 - DNA, 1464 bp, Unknown
  Bacillus sp. multi
ctcatcacgagccggaagatccggctcagcatcgtctccgacaactccaccgaggcgtacaacttcatccgcaaggagatgcgggagcagaacaaggcgctgaacgtggccatgaaccacctctacttcaactacgtcgcccgccagaagatctccttcgcagacaaggcgtaccagcacaagctgaacaaggccatcgaggcgcagcagaagtccttcatcctgctcaaggagctggagcagaagcagatcgtcgagaccgacagcagcaaaaagtctattctcaaggagcgcctcatcaagtccaagacgacgtacgaaaagactaaagaaaagctgtcctccctgcggaaggcccggaacaaggagctgttccaggagtacaacaacatgatcggccaactggaggagacgcacctccgggacatcgtgtcctcccagttcaacctcctgtccgacacgaaggaccgcctcacgaagatcgcgtaccaggacttcaagaacgacatcaccgaggtgctgagcggcgaccgcagcctccggacgtacaagaagaataatccgctgtacatccggggccgcaccctgaacctgttcaaggagtcggaggaattcttcattaagtggaccaagaaaatcgtcttcaagtgcgtgctgggcgtgaagtaccagaacaagacggagctgtacaagaccctggagtgcatcctcaccggcgagtatactctgtgcgacagctcgatgaacttcaaccagcagaacaagctgatcctcaacctggcgctcaacatcccggagaagtccgagaaccggaaggtgccgggccgcatcgcgggcatcgacctcggcctcaagatcccggcctacttcgcggtcaacgacgtcccgtacatccgcaaggcgctgggcaagatcgaggacttcctcaaggtccgcaccaacatccagtcccagaagcgctccctccagcgggccctccagtcgtcgaagggcggcaagggccgcaagaaaaagctcaaggcgctcgaccagttcaaggagaaggagaagaattacatcatcacgtacaaccacttcatcagcaagaagattattagcctcgcggtccagtacggcgtggagcagatcaacctagagctgctcaccctcaaggagacccagaagaaatcgctcctgcggaactggagctactaccaactacagcagttcatcgagtacaaggccaaccgggaggagatcagcatcaagtacgtggaccccttccacaccagccagacgtgctcgaagtgcgggcactacgaggacggccagcgggagaagcaagacaccttctgctgcaagtcctgcgggttcatcgacaacgccgactacaacgccgcgcggaacatcgcggcctccacccgctacatcaccaacaaggaggagtccgaatactatcgcaagaacaacaacgagatcgcctag

SEQ ID NO: 2620 - DNA, 1464 bp, Unknown
  Bacillus sp. multi
ctcatcacctcccgcaagatccggctctccatcgtctccgacaactcgaccgaggcgtacaacttcatccgcaaggagatgcgcgagcagaacaaggccctcaacgtggcgatgaaccacctctacttcaactacgtggcccgccagaaaatttcgttcgcggacaaggcgtaccagcagaagctcaacaaggccatcgaggcccagcagaacagcttcatcctcctcaaggagctggagcagaagcagatcgccgagacggacagctccaagaagtccatcctcaaggagcgcctcatcaagtccaagaccacctacgaaaagaccaaggagaagctgagcagcctccggaaggcgcgcaacaaggagctgttccaggagtacaacaacatgatcgggcagttggaggaaacgcacctccgggacatcgtgtcgtcgcagttcaacctgctgagcgacacgaaagaccggctcacgaagatcgcgtaccaggacttcaagaacgacatcaccgaggtgctgtccggcgaccgctcgctccgcacctacaaaaagaacaatccgctttacatccgaggccggacgctcaacctcttcaaggagagtgaggaattcttcattaagtggaccaagaagattgtcttcaagtgcgtcctcggggtgaagtaccagaacaagaccgagctatacaagaccctggagtgcatccttaccggcgagtatactttatgcgattcttccatgaacttcaaccagcagaacaagctgatcctgaacctggcgctgaacatcccggagaagtccgagaaccggaaggtgcccggccgcatcgcgggcatcgacctggggctcaagatccccgcgtacttcgccgtcaacgacgtcccgtacatccgcaaggccctcgggaagatcgaggacttcctcaaggtgcggaccaacatccaatctcagaagcgcagcctccagcgggccctccagagcagcaagggcgggaaggggcgcaagaagaagctcaaggccctcgaccagttcaaggagaaggagaagaactacataacgacctacaaccacttcatctccaagaaaattatctcgctggcggtgcagtacggggtggagcagatcaacctggagttgctcacgctcaaggagacccagaagaagtcgctcctccgcaactggagctactaccagttgcaacagttcatcgagtacaaggccaaccgcgaggagatcagcatcaagtacgtggaccccttccacaccagccagacgtgctccaagtgcgggcactacgaggacgggcagcgcgagaagcaggacaccttctgctgcaagtcgtgcgggttcatcgacaacgccgactacaacgcggcccgcaacatcgccgcctcgacgcggtacatcaccaacaaggaggagggcgaatactgccgcaagaacaacaacgagatcgcctag

SEQ ID NO: 2621 - DNA, 1464 bp, Unknown
  Bacillus sp. multi
ctcatcacctcgcgcaagatccggctgagcatcgtcagcgacaactccaccgaggcgtacaacttcatccgcaaggagatgcgggagcagaacaaggccctgaacgtcgccatgaaccacctgtacttcaactacgtggcccggcagaagatttccttcgcggacaaggcgtaccagcagaagctcaacaaggccatcgaggcgcagcagaacagcttcatcctgttgaaggagctggagcagaagcagatcgccgagaccgactcgtccaagaagtctatcctcaaggagcgcctcatcaagagcaagacgacgtacgagaaaacgaaggagaagctgagcagcctccgcaaggcccgcaacaaggagctgttccaggagtacaacaacatgatcggccagctagaggagacacacctccgcgacatcgtgtccagccagttcaacctcctgtcggacacgaaggaccggctgaccaagatcgcctaccaggacttcaagaacgacatcaccgaggtgctgtccggggaccggagcctccgcacgtacaagaagaataacccgctgtacatccggggccgcaccctcaacctgttcaaggagtccgaggaattcttcataaagtggaccaagaagattgtcttcaagtgtgtcctcggggtcaagtaccagaacaagaccgagctgtacaagaccctggagtgcatcctgaccggcgaatatactctctgcgacagctccatgaacttcaaccagcagaacaagctgatcctgaacctcgccctgaacatcccggagaagtccgagaaccgcaaggtgcccggccgcatcgcgggcatcgacctgggcctcaagatcccggcctacttcgccgtcaacgacgtgccgtacatccgcaaggcgctcgggaagatcgaggacttcctcaaggtccggacgaacatccagagccagaagcggagcctccagcgcgccctccagtccagcaagggcgggaagggccgcaaaaagaaactcaaggccctggaccagttcaaggagaaggagaagaattacatcaccacctacaaccacttcatctccaagaaaataatcagtctcgcggtccagtacggcgtggagcagatcaacctggaactactcaccctcaaggagacgcagaagaagtctctgctccgcaactggagctactaccaactacagcagttcatcgagtacaaggccaaccgggaggagatcagcatcaagtacgtggacccgttccacacgagccagacgtgcagcaagtgcggccactacgaggacgggcagcgggagaagcaagataccttctgctgcaagagctgcggcttcatcgacaacgccgactacaacgcggcccggaacatcgcggcctcgacccgctacatcaccaacaaggaggagggcgaatattgtcgcaagaacaacaacgagatcgcctag

SEQ ID NO: 2622 - DNA, 1464 bp, Unknown
  Bacillus sp. multi
ctcatcacctcccgcaagatccgcctgagcatcgtcagcgacaactccacggaggcgtacaacttcatccgcaaggagatgcgggagcagaacaaggccctcaacgtggccatgaaccacctctacttcaactacgtggcgcggcaaaagatttctttcgcggacaaggcgtaccagcagaagctcaacaaggccatcgaggcgcagcagaacagcttcatcctgctcaaggagctggagcagaagcagatcgccgagacggactcgtccaagaagtccatcctcaaggagcgcctcatcaagtccaagaccacgtacgagaagacaaaagaaaagctgtcctcgctgcggaaggcccggaacaaggagctgttccaggagtacaacaacatgatcggccagcttgaggagacccacctccgcgacatcgtgtcctcccagttcaacctgctcagcgacacgaaggaccgcctcacgaagatcgcctaccaggacttcaagaacgacatcaccgaggtgctctccggcgaccgcagcctccggacgtacaagaagaataacccgctctacatccggggccggacgctcaacctgttcaaggagagcgaggagttctttattaaatggaccaagaagatagtcttcaagtgcgtgctgggcgtgaagtaccagaacaagacggagctgtacaagacgctggagtgcatcctcaccggggagtacactctctgcgactcgtcgatgaacttcaaccagcagaacaagctcatcctgaacctggcgctgaacatccccgagaagtccgagaaccgcaaggtgcccggccgcatcgcgggcatcgacctggggctcaagatcccggcctacttcgccgtgaacgacgtcccgtacatccgcaaggcgctggggaagatcgaggacttcctcaaggtgcggacgaacatccagtcccagaagcgctccctccagcgggccctccagtccagcaagggcgggaagggccgcaagaagaaactcaaggccctcgaccagtttaaggagaaggaaaagaactacatcactacctacaaccacttcatctccaagaaaattatcagcctcgcggtccagtacggggtcgagcagatcaacttggaactcctgaccctcaaggagacccagaagaaatctctgctccggaactggagctactaccagttacagcagtttatcgagtacaaagccaaccgggaggagatcagcatcaagtacgtggacccgttccacacctcccagacgtgctcgaagtgcggccactacgaggacggccagcgcgagaaacaggataccttctgctgcaagagctgcgggttcatcgacaacgccgactacaacgccgcccgcaacatcgcggccagcacccgctacatcacgaacaaggaggagggcgagtattgtcgcaagaacaacaacgagatcgcctga

SEQ ID NO: 2623 - DNA, 1464 bp, Unknown
  Bacillus sp. multi
ctcatcacgtcccgcaagatccgcctgagcatcgtgtccgacaactccaccgaggcgtacaacttcatccgcaaggagatgcgcgagcagaacaaggcgctgaacgtggcgatgaaccacctctacttcaactacgtcgcgcgccagaagataagctttgcggacaaggcgtaccagcagaagctgaacaaggccatcgaggcgcagcagaactcgttcatcctgctcaaggagctggagcagaagcagatcgcggagacggactccagcaaaaagtccattctcaaggagcgcctcatcaagtccaagaccacctacgagaaaacgaaggagaaactgtccagcctgcggaaggcccgcaacaaggagctgttccaggagtacaacaacatgatcggccaactggaggagacccacctccgggacatcgtgtcgtcccagttcaacctcctcagcgacacgaaggaccgcctcacgaagatcgcgtaccaggacttcaagaacgacatcaccgaggtgctctcgggcgaccgcagcctgcggacctacaagaagaataatccgctgtacatccggggccggaccctgaacctcttcaaggagagcgaggaattctttattaaatggaccaaaaagatagtcttcaagtgcgtgctcggcgtcaagtaccagaacaagaccgagctgtacaagacgctggagtgcatcctgaccggggaatatactctgtgcgactccagcatgaacttcaaccagcagaacaagctcatcctgaacctggccctgaacatcccggagaagtcggagaaccggaaggtgccggggcgcatcgcggggatcgacctcggcctcaagatcccggcgtacttcgcggtcaacgacgtgccgtacatccgcaaggccctgggcaagatcgaggacttcctcaaggtccggacgaacatccagagccagaagcgctccctccagcgcgccctccagtccagcaagggcggcaagggccgcaagaagaagctcaaggccctcgaccagttcaaggagaaggagaagaactatatcaccacctacaaccacttcatctccaagaaaattatctcactggcggtgcagtacggcgtggagcagatcaacctggagctactcaccctcaaggagacgcagaagaagtcactgctccgcaactggagctactaccaactccagcaattcatcgagtacaaggccaaccgggaggagatcagcatcaagtacgtggacccgttccacacgagccagacctgctcgaagtgcggccactacgaggacggccagcgcgagaagcaagataccttctgctgcaaaagctgcggcttcatcgacaacgcggactacaacgccgcgcggaacatcgccgcctccacgcggtacatcaccaacaaggaggagggcgagtattgtcgcaagaacaacaacgagatcgcgtag

SEQ ID NO: 2624 - DNA, 1464 bp, Unknown
  Bacillus sp. multi
ctcatcacctcccggaagatccgcctctccatcgtgtcggacaactcgacggaggcgtacaacttcatccgcaaggagatgcgcgagcagaacaaggccctcaacgtggccatgaaccacctctacttcaactacgtggcccgccagaagataagcttcgcggacaaggcgtaccagcagaagctcaacaaggccattgaggcccagcagaactcgttcatcctgctcaaggagctcgaacagaagcagatcgctgagacagactcgtccaagaagtccatcctcaaggagcgccttattaagtccaagaccacgtacgagaagacaaaggagaagctcagttcgctgcgcaaggcccggaacaaggagctcttccaggagtacaacaacatgatcgggcagctggaggagacgcacctgcgtgatatcgtgagtagccagttcaacctcctgtcggacacgaaggaccggctgacgaagatcgcctaccaggacttcaagaacgacatcaccgaggtgctctccggcgaccgcagcctgcggacctacaagaagaataacccgctctacatcaggggccggacgctgaacctcttcaaggagtcggaggagttcttcatcaagtggaccaagaagatcgttttcaagtgcgtgttgggcgtgaagtaccagaacaagacggagctatacaagacgctggagtgcatcctcacgggcgaatatacactgtgcgacagctcgatgaacttcaaccagcagaacaagctaatcctcaacctggcgctcaacatcccggagaagtcggagaaccgcaaggtgccggggcgcattgccggaatcgacctcggcctcaagatcccggcctacttcgccgtgaacgacgtcccctacatccgcaaggccctcggcaagatcgaggacttcttgaaggttcggacaaacatccagtcgcagaagcgctcgctccaacgggccctccagtcctccaagggcgggaagggccgcaagaagaagctcaaggcgctggaccagttcaaggagaaggagaaaaactacatcaccacctacaaccacttcatcagcaagaagatcatcagcctggccgtgcagtacggggtcgagcagatcaacctggagctgctgacgctcaaggagacgcagaagaagtccctgctcaggaactggagctactaccagctgcagcagttcatcgagtacaaggccaaccgtgaggagatcagcatcaagtacgtggaccccttccacaccagccagacctgctcgaagtgcgggcactacgaggacggccagcgcgagaagcaggataccttctgctgcaagtcgtgcggcttcatcgacaacgccgactacaacgccgcccggaacatcgccgccagcacgcgctacatcacgaacaaggaggagggcgagtactgccggaagaacaacaacgagatcgcctga

SEQ ID NO: 2625 - DNA, 1461 bp, Unknown
  Bacillus sp. multi
ttgatcacgagccggaagatccggctgagcatcgtgtccgacaacgcggccgaggcgtacaacttcatccgcaaggagatgcgcgagcagaacaaggccctcaacgtcgccatgtcgcacctctacttcaactccatcgcgcggcagaagatactcctcgcggacgaggcgtaccagcagaagctcaaggacgcgatcaactcccaggagaagtccttcaacaccttgaaggagctggagcggaagcagtgcatcgagggcgactccgagaagaaacagaccctcaaagagcggctcatcaagacgcagaacgcctacgagaagtcgaaggagaaggtgagcaacctccggaagtcccgctcaaaagattccttccaggagtacaacaacatcatcggccaggtggagcagacccacttgcgcgacgtgatctcctcccagttcaacctgcactccgacacgaaggaccgcctgaccatgatcgccaaccaggacttcaagaacgacatcggggaggtgctctccgggaactgctccctccgcacgtacaagaaaaataacccgctgtacatccggggccgcaacaccgtgctgtacaaggaggggaacgagttctttattaagtggatcaagggcatcgtgctcaagtgcatcctcggcgtcaagaatcagaacaagacggagctgtacaagaccctggagtgcgtgctggccggggtctacaaaatatgtgacagcagcatgaacttcaaccagcagaacaagctcatcctgaacctcgcgctgaacatgccagacaagtccgagaacaagaaggtgccgggccgcatcgcgggcatcgacctcgggctcaagatccccgcctacttctccgtgaacgacgccccttacatccgcaagggcatcggcaagatcgaggacttcctcaaggtgaggactagcatccagtcccagaagcggtccctcgagcgtgccctccagagcagcaagggcggcaagggccgcaagaagaagctcaaggcgctgaaccagttcaaggagaaggagaagtcgtacgtgaccacgtacaaccacttcatctccaaaaagatcatcagcctggccatccagtacggcgtggagcggatcaacttggagctgctgacgcttaaggagactcaaaagaagtcgctcctcaggaactggagctactaccagctccagcagttcatcgagtacaaggccaaccgggagggcattctcatcaagtacgtggacccgttccacacgagccagacgtgcagcaagtgcgggcactacgaggacgggcagcgcgagaagcaggataacttccactgcaagagctgcgggttcaaggagaacgcggactacaacgccgcccggaacatcgccaagtccaccaactacatcaccaagaaggaggagagcgagtactataagcgcaacaacgagatcgcctag

SEQ ID NO: 2626 - DNA, 1461 bp, Unknown
  Bacillus sp. multi
ctcatcaccagccgcaagatccggctctccatcgtgtcggacaacgcggccgaggcgtacaacttcatccgcaaggagatgcgggagcagaacaaggcgctgaacgtcgccatgtcgcacctctacttcaacagcatcgcccgccagaagatcctactcgcagacgaggcgtaccagcagaagctcaaggacgcgatcaactcacaggaaaagtcctttaacaccctcaaggagctggagcgcaagcagtgcatcgagggcgactccgagaagaaacagaccctcaaggagcgcctcatcaagacccagaacgcctacgagaagtcgaaggagaaggtgtccaacctccggaagtcccgcagcaaggactccttccaggagtacaacaacatcatcggccaggttgagcagacccacctccgcgacgtcatctccagccagttcaacctccactccgacacgaaggaccggctcacgatgatcgccaaccaggacttcaagaacgacatcggcgaggtgctctcgggcaactgctccctccggacctacaagaagaataacccgctctacatccgagggcggaacaccgtgctgtacaaggaggggaacgagttcttcatcaagtggatcaaggggatcgtgctcaagtgcatcctcggcgtcaagaaccagaacaagaccgagctgtacaagaccctggagtgcgtcctggccggggtgtataagatatgcgactcgtccatgaacttcaaccagcagaacaagctgatcctgaacctggcgctgaacatgccggacaagtcggagaacaagaaggtgcccggccgcattgctggaatagacctcggcctcaagattccagcctacttctccgtcaacgacgcgccctacatccggaaggggatcggcaagatcgaggacttcctcaaggtccgcacctccatccagtcgcagaagcggtccctggagcgggccctccagagcagcaagggcggcaagggccgcaagaaaaaactcaaggccctcaaccagttcaaggagaaggagaagtcgtacgtgacgacctacaaccacttcatctccaaaaagatcatttccctcgccatccagtacggcgtggagcgcatcaacctggaactactgaccctcaaggagacccagaagaaatccctgctgcggaactggagctactaccagctccagcagttcatcgagtacaaggcgaaccgcgagggcatccttattaagtacgtggaccccttccacacctcccagacgtgcagcaagtgcgggcactacgaggacggccagcgggagaaacaagacaacttccactgcaagagctgcggcttcaaggagaacgccgactacaacgccgcgcgcaacatcgccaagtccaccaactacatcaccaaaaaggaagagtcggagtattacaagcgcaacaacgagatcgcctga

SEQ ID NO: 2627 - DNA, 1461 bp, Unknown
  Bacillus sp. multi
ctcatcacctcccggaagatccggctcagcatcgtcagcgacaacgcggcggaggcgtacaacttcatccgcaaggagatgcgcgagcagaacaaggcgctgaacgtggccatgagccacctctacttcaactccatcgcgcgccagaaaatcctcctcgccgacgaggcgtaccagcagaagctcaaggacgcgatcaactcccaggagaagtcgttcaacacgctcaaggagctggagcgcaagcagtgcatcgagggcgacagcgagaagaagcagaccctcaaggagcgcctcatcaagacgcagaacgcctacgagaagtcgaaggagaaggtcagcaacctccgcaagagccgcagcaaggactccttccaggagtacaacaacatcatcggccaagtggagcagacccacctccgggacgtcatctccagccagttcaacctccactccgacacgaaggaccgcctgacgatgatcgccaaccaggacttcaagaacgacatcggcgaggtgctgagcggcaactgctccctccggacctacaaaaagaataacccgctgtacatccggggccggaacaccgtgctgtacaaggaggggaacgaattcttcatcaagtggatcaaggggatcgtgcttaagtgcatcctgggcgtcaagaaccagaacaagacggagctgtacaagacgctggagtgcgtgctcgccggggtgtacaagatatgcgactcctccatgaacttcaaccagcagaacaagctcatcctgaacctggcgctcaacatgcccgacaagtccgagaacaaaaaagttcccggccggatcgcgggcatcgacctcgggctcaagatccccgcgtacttcagcgtgaacgacgcgccctacatccgcaagggcatcggcaagatcgaggacttcctcaaggtccgcacctccatccagtcccagaagcgcagcctggagcgcgccctccagtcgagcaagggcgggaagggccgcaagaaaaaactcaaggcgctgaaccagttcaaggagaaggagaagtcctacgtcacgacgtacaaccacttcatcagcaagaaaatcatatctctggccatccagtacggggtcgagcgcatcaacctcgaactgctcacgctcaaggagacgcagaagaaatcgctcctccgaaactggtcttactaccaactccagcagttcattgagtacaaggccaaccgggagggcatccttatcaagtacgtggaccccttccacaccagccagacgtgctcgaagtgcggccactacgaggacgggcagcgggagaagcaagataacttccactgcaagagctgcgggttcaaggagaacgcggactacaacgcggcccgcaacatcgccaagagcaccaactacatcaccaaaaaggaagaatccgagtattacaagcgcaacaacgagatcgcctga

SEQ ID NO: 2628 - DNA, 1461 bp, Unknown
  Bacillus sp. multi
ctcatcacctcgcgcaagatccggctgtccatcgtcagcgacaacgcggcggaggcgtacaacttcatccgcaaggagatgcgggagcagaacaaggccctgaacgtcgccatgtcgcacctctacttcaactccatcgcccgccagaagatactgctcgccgacgaggcgtaccagcagaagctcaaggacgcgatcaactcccaggagaagagctttaatacgctcaaggagctggagcggaagcagtgcatcgagggcgactccgagaagaaacagacattaaaagaacgcctcatcaagacgcagaacgcctacgagaagtcgaaggagaaggtgagcaacctgcggaagtcccgcagcaaggactccttccaggagtacaacaacatcatcggccaggtggagcagacgcacctccgggacgtcatctcgtcgcagttcaacctccactcggacacgaaggaccgcctcacgatgatcgccaaccaggacttcaagaacgacatcggcgaggtgctcagcgggaactgctccctccggacgtacaagaagaataatccgctgtacattcggggccggaacaccgtcctctacaaggagggcaacgaattctttataaagtggatcaaggggatcgtcctcaagtgcatcctcggggtcaagaaccagaacaagaccgagctgtacaagaccctggagtgcgtgctggcgggcgtgtacaagatatgcgattcctccatgaacttcaaccagcagaacaagctcatcctgaacctggccctgaacatgccggacaagtcggagaacaagaaggtgccgggccggatcgcagggattgacctgggcctcaagattcctgcgtacttctcggtgaacgacgcgccgtacatccgcaagggcatcggcaagatcgaggacttcctcaaggtgcggaccagcatccagtcccagaagcgcagccttgaacgggccctccagtcgtcgaagggcgggaagggccgcaagaagaagctcaaggccctcaaccagttcaaggagaaggagaagtcctacgtgacgacctacaaccacttcatcagcaagaaaatcatcagtctggcaatccagtacggcgtggagcggatcaacctcgagctgctcaccctcaaggagacgcagaagaaatccctcctccgcaactggtcctactaccagctccagcagttcatcgagtacaaggcgaaccgggagggcatcctcatcaagtacgtggacccgttccacacctcgcagacctgctctaagtgcggccactacgaggacggccagcgcgagaagcaggacaacttccactgcaagtcgtgcggcttcaaggagaacgcggactacaacgcggcccggaacatcgccaagtccaccaactacatcaccaaaaaggaagagtccgagtattacaagcgcaacaacgagatcgcgtga

SEQ ID NO: 2629 - DNA, 1461 bp, Unknown
  Bacillus sp. multi
ctcatcacgagccggaagatacgcctgtccatcgtgtcggacaacgccgccgaggcgtacaacttcatccggaaggagatgcgcgagcagaacaaggccctcaacgtggccatgtcgcacctgtacttcaacagcatcgcgcggcagaaaatcctgctggccgacgaggcgtaccagcagaagctcaaggacgccatcaactcccaggagaagtccttcaacaccctcaaggagctggagcggaagcagtgcatcgagggcgactccgaaaaaaagcagaccctcaaggaacgcctcatcaagacccagaacgcctacgagaagtctaaggagaaggtgtccaacctccgcaagagccgcagcaaggactcgttccaggagtacaacaacatcatcggccaagtggagcagacccacctccgcgacgtcatcagcagccagttcaacctgcacagcgacacgaaggaccggctcacgatgatcgccaaccaggacttcaagaacgacatcggcgaggtgctctccgggaactgctccctccgcacctacaaaaagaataacccgctctacatccggggccgcaacaccgtcctctacaaggagggcaacgaattcttcattaagtggatcaagggcatcgtcctcaagtgcatcctgggcgtcaagaaccagaacaagacggagctgtacaagacgctggagtgcgtgctcgccggggtgtacaagatttgcgactccagcatgaacttcaaccagcagaacaagctgatcctgaacctggccctcaacatgcccgacaagagcgagaacaaaaaagtgcccggccggatcgcgggcatcgacctggggctcaagatacccgcgtacttcagcgtgaacgacgcgccctacatccgcaaggggatcgggaagatcgaggacttccttaaggtgcggacgagcatccagagccagaagcgctcgctggagcgggcgctccagagcagcaagggcgggaaggggcgcaaaaagaaactcaaggccctgaaccagttcaaggagaaggagaagtcctacgtgacgacctacaaccacttcatctccaagaagattatcagtctcgccatccagtacggcgtggagcgcatcaacctagaactgctcacgctcaaggagacgcagaagaagtctctgctccggaactggtcctactaccagctccagcagttcatcgagtacaaggcgaaccgcgagggcatcctcatcaagtacgtggacccgttccacacctcccagacgtgcagcaagtgcgggcactacgaggacgggcagcgggagaagcaagacaacttccactgcaagtcctgcggcttcaaggagaacgccgactacaacgcggcccggaacatcgccaagtccacgaactacatcaccaaaaaagaggaatcggagtattacaagcggaacaacgagatcgcctga

SEQ ID NO: 2630 - DNA, 1839 bp, Unknown
  Lysinibacillus sp. multi
atgctggcctacttcccgcgcccgtacgagaacgagacgatctacagcatcgcggcgcgctacgcccgccacatgggcatcctctcgaagcggaacgtcctcaaagacctctttgagatcgtgaaccccacctcgtccgaggactacaccttccacatctacacgctggtcaacaagatccgccacttcagcaacgaatataccgacgagtatttcctcaacaagcacaccgtctcgcccctctacagcccgttcatcaaggacagctccggcaacccgtcccgctcgctggacaacttcatcaagggcaaaaagcggtatatgtgggacatcccggagaaggagaacctgttctactgctccgagtgcgtggaggaggacttggagaagtacggcgagtgctactggaaccgcatcttccagatccccggcatcatgatctgcgggaagcacgagcgcccgctgagcaagtcgcagctcaacatccaccggaacccgctcaacaagttcatcatgcccaaccaggaggtcgcggtggacatcaagatcgacaacgagattttcgaacagcttctggagataacgcgcaacgtggagtactttttcaccaacaaggtggacaccttcaactatcaggaactctacgagaagtattttgagtttatcaagatcgcctccatcgccatcccgctgtcccacctcaaaaagaagctcggcgaacttatcatcagccggttcaacgagaagactctggacttcctcaacagcaacccgcgcaagaacgactggctgagctacctctccgtggagcggatcaagcacatccacccgatccggcacgtcctcctcatgatgtccctcgcgctctccgtggagcggttcatcaacatcgtgccgaagtaccagcccttcggcagcggggcctggatctgcatgaactccctcagcgagcactacctggagaaggtggtgaccaacgtgaacatcaccttcaacaaggacatcgggaacttccagggcgagttcaagtgctcgtgcgggttcacctacgtgctctacaacggcgagaacaacccctgcaacatcagcaagttcagtcctcgtgtcaaggagaagggccacatctggcgcaaggagttcgacgagctggtgagccggggcgcttcgatcaaggagatcgcgctcaagaccaactacagcacgggcacggtccgcaagatcattaagcaaggccacaactaccacgagaacgaaaagaaacggcggcagcagaacctggaggagcgccgcatcatccgggagaagaatgacaagatggactggaacggcatccggcggaagtaccccaactcctcccgcaccgagctgatgtacgagaacaaggccctctacaaccgcctcctgcgctacgaccgcgagtggctcatcgagaactcgccgacgagccagcgcggggccgtgaagaccagcgacgacatcaaccacaagcgggacgtcctgtacctcaaggtggcccaggacatgctggagaactggtccgagtacgagaagcaagcggggaagatcatcaaaaagacacagttcacgctctacacgcgcctcggcatgaagacccgcaacaacgacaagtacccgctcaccgtggcgttcatcagcacgttcatcgagagcaacgaggactaccagatccggctcatcaaccagtgcatcgagaaccacttcatcaactcggagatcaagcgctaccgcatcctggagtacagcggcctgcgctacctgcacccgaaggccgagaagtacctggaggtcatcatcaacgagaacaacaagcggaactga

SEQ ID NO: 2631 - DNA, 1839 bp, Unknown
  Lysinibacillus sp. multi
atgctcgcgtacttcccgcgcccgtacgagaacgagaccatctactccatcgccgcgcggtacgcgcgccacatgggcatcctctccaagcgcaacgtcctcaaagacctcttcgaaatcgtcaacccgacgtccagcgaggactacaccttccacatctacaccctcgtcaacaagatccgccacttcagcaacgagtataccgacgagtactttctcaacaagcacaccgtgagcccgctctactcgcccttcatcaaggactcctcggggaacccgtcgcgcagcctcgacaacttcatcaagggcaaaaaacggtatatgtgggacatccccgagaaggagaacctgttctactgctccgagtgcgtcgaggaagacttggagaagtacggggagtgctactggaaccgcatcttccagatccccggcatcatgatctgcggcaagcacgagcgcccgctctcgaagtcccagctcaacatccaccggaacccgctcaacaagttcatcatgcccaaccaggaggtcgcggtggacatcaagatcgacaacgaaatcttcgagcaactcctggaaatcacccgcaacgtcgaatacttctttacgaacaaggtggacaccttcaactaccaggagctgtacgagaagtatttcgagttcatcaagatcgcctccatcgccatcccgctctcgcacctcaagaaaaaactgggcgagctaatcatcagccgcttcaacgagaaaacgctcgacttcctgaacagcaacccgcgcaagaacgactggctgagctacctgagcgtcgagcggatcaagcacatccacccgatccgccacgtgctcctcatgatgtccctggcgctcagcgtggagcggttcatcaacatcgtccccaagtaccagcccttcgggtccggggcctggatctgcatgaactccctgtccgagcactacctggagaaggtggtcacgaacgtgaacatcacgttcaacaaggacatcggcaacttccagggcgagttcaagtgctcctgcggcttcacctacgtgctgtacaacggcgagaacaacccctgcaacatctcgaagttctccccgcgcgtgaaggagaaggggcacatctggcggaaggagttcgacgagttggtgagtcgaggggcgtccatcaaggagatcgcgctcaagaccaactacagcaccggcaccgtccgcaagatcatcaagcaagggcacaactaccacgagaacgaaaaaaagcggcggcagcagaacctggaggagcgccgcatcatccgcgagaagaacgacaagatggactggaacggcatccgccgcaagtacccgaactccagccggacggagctgatgtacgagaacaaggccctctacaaccgactgctccggtacgaccgcgagtggctgatcgagaacagcccgacctcccagcgcggggccgtgaagacgtcggacgacatcaaccacaagcgcgacgtgctgtacctcaaggtcgcccaggacatgctggagaactggtccgagtacgagaagcaagcgggcaagatcattaagaaaacccagttcacgctctacacccggctggggatgaagacccggaacaacgacaagtacccgctgaccgtggcgttcatctccacgttcatcgagtccaacgaggactaccagatccggctcatcaaccagtgcatcgagaaccacttcatcaactccgagatcaagcgctaccgcatcctggagtacagcggcctccgctacctccacccgaaggccgagaagtacctggaggtcatcatcaacgagaacaacaagcgcaactga

SEQ ID NO: 2632 - DNA, 1839 bp, Unknown
  Lysinibacillus sp. multi
atgctggcgtacttcccgcgcccgtacgagaacgagaccatctacagcatcgccgcccgctacgcccgccacatgggcatcctgtccaagcgcaacgtcctcaaagaccttttcgagatcgtcaacccgacgtcgagcgaggactacaccttccacatctacacgctggtgaacaagatccgccacttcagcaacgagtatactgacgaatatttcctgaacaagcacaccgtgtcgccgctctactccccgttcatcaaggactcctccgggaacccgagccgctccctggacaacttcatcaagggcaaaaagcgctatatgtgggacatcccggagaaggagaacctgttctactgctccgagtgcgtcgaggaggacttggagaagtacggcgagtgctactggaaccgcatcttccagatccccggcatcatgatctgcgggaagcacgagcggcccctgtccaagagccagctcaacatccaccgcaacccgctcaacaagttcatcatgcccaaccaggaggtcgcggtggacatcaagatcgacaacgaaatcttcgagcagttgctggagatcacgcgcaacgttgaatatttctttaccaacaaggtggatacctttaactaccaggagctgtacgagaaatattttgagtttatcaagattgccagcatcgccatcccgctgtcccacctcaagaagaaactgggcgagctaatcatctcccgcttcaacgagaaaaccctggacttcctcaactcgaacccgcgcaagaacgactggctgagctacctctcggtggagcggatcaagcacatccacccgatccggcacgtcctgctgatgatgtccctggccctctccgtggagcggttcatcaacatcgtgcccaagtaccagccgttcggctcgggcgcgtggatctgcatgaactccctcagcgagcactacctggagaaggtggtcaccaacgtgaacatcacgttcaacaaggacatcgggaacttccagggcgagttcaagtgctcctgcgggttcacctacgtgctgtacaacggggagaacaacccctgcaacatcagcaagttcagcccgcgcgtgaaggagaagggccacatctggcgcaaggagttcgacgagctggtgtctcggggcgcgtcgatcaaggagatcgcgctcaagaccaactactccaccggcaccgtccggaagatcattaagcaagggcacaactaccacgagaacgagaagaaacggcggcagcagaacctggaggagcgccgcatcatccgcgagaagaacgacaagatggactggaacggcatccgccggaagtaccccaacagctcgcgcacggagctgatgtacgagaacaaggccctgtacaaccggctgctccgctacgaccgcgagtggctgatcgagaactcgcccacctcccagcgcggcgcggtcaagacgtccgacgacatcaaccacaagcgggacgtcctctacctcaaggtggcccaggacatgctggagaactggtccgagtacgagaagcaagcgggcaagataatcaaaaagacgcagttcacgctctacacccggctgggcatgaagacgcggaacaacgacaagtacccgctcacggtggcgttcatcagcaccttcatcgagagcaacgaggactaccagatccgcctcatcaaccagtgcatcgagaaccacttcatcaacagcgagatcaagcgctaccgcatcctggagtacagcgggctgcgctacctccacccgaaggcggagaagtacctggaggtcatcatcaacgagaacaacaagcgcaactga

SEQ ID NO: 2633 - DNA, 1839 bp, Unknown
  Lysinibacillus sp. multi
atgctggcgtacttcccgcgcccgtacgagaacgagaccatctactccatcgccgcccggtacgcccggcacatgggcatcctgagcaagcgcaacgtcctcaaggatctattcgagatcgtgaaccccacgagcagcgaggactacaccttccacatctacaccctcgtgaacaagatccgccacttcagcaacgaatatactgacgagtatttcctgaacaagcacaccgtctcgcccctctactcgcccttcatcaaggactcctccgggaaccccagccgcagcctcgacaacttcatcaagggcaagaagcgctatatgtgggacatcccggagaaggagaacctgttctactgctccgagtgcgtggaggaggacttggagaagtacggcgagtgctactggaaccggatcttccagatccccggcatcatgatctgcgggaagcacgagcggcccctgagcaagtcccagctcaacatccaccgcaacccgctgaacaagttcatcatgcccaaccaggaggtcgcggtggacatcaagatcgacaacgaaatcttcgagcaacttctggagatcacgcgcaacgtggagtacttctttaccaacaaggtcgataccttcaactaccaggaactgtacgagaagtacttcgaattcatcaagatcgccagcatcgccatcccgctgtcgcacctcaagaaaaaactgggcgagctgataatctctcggttcaacgagaagacgctggacttcctcaacagcaacccgcgcaagaacgactggctgagctacctctccgtggagcggatcaagcacatccaccccatccgccacgtgctcctcatgatgtcgctcgcgctctcggtggagcggttcatcaacatcgtgccgaagtaccagccgttcgggtccggggcgtggatctgcatgaacagcctctccgagcactacctggagaaggtggtcaccaacgtgaacatcacgttcaacaaggacatcgggaacttccagggcgagttcaagtgctcctgcgggttcacctacgtgctctacaacggcgagaacaacccgtgcaacatctccaagttcagcccgagggtgaaggagaagggccacatctggcggaaggagttcgacgagctggtgtcgcggggcgcgtcgatcaaggagatcgccctcaagaccaactacagcacgggcaccgtccggaagattatcaagcaagggcacaactaccacgagaacgagaagaaacgccgccagcagaacctggaggagcggcgcatcatccgcgagaagaacgacaagatggactggaacggcatccggcgcaagtacccgaactcgtcccgcacggagctgatgtacgagaacaaggccctctacaaccgcctcctccgctacgaccgcgagtggctgatcgagaacagcccgacctcccagcgcggggcggtgaagacgtccgacgacatcaaccacaagcgggacgtcctctacctcaaggtcgcccaggacatgctggagaactggtcggagtacgagaaacaagccggcaagatcatcaagaaaacgcagttcaccctctacacgcgcctcgggatgaagacgcgcaacaacgacaagtacccgctgaccgtggcgttcatctcgaccttcatcgagtccaacgaggactaccagatccggctcatcaaccagtgcatcgagaaccacttcatcaactcggagatcaagcgctaccgcatcctggagtacagcgggctgcgctacctccacccgaaggccgagaagtacctggaggtcatcatcaacgagaacaacaagcggaactag

SEQ ID NO: 2634 - DNA, 1839 bp, Unknown
  Lysinibacillus sp. multi
atgctcgcctacttcccgcgcccctacgagaacgagacgatctactccatcgcggcccggtacgcgcgccacatgggcatcctcagcaagcggaacgtgctcaaggacctgttcgagatcgtcaaccccacgtcctccgaggactacaccttccacatctacacgctggtcaacaagatccgccacttcagcaacgagtacacagacgaatactttctgaacaagcacacggtgtccccgctctacagcccgttcatcaaggactcctccgggaacccgtcgcggagcctggacaacttcatcaagggcaagaagcggtacatgtgggacatcccggagaaggagaacctgttctactgctccgagtgcgtggaggaagacctggaaaagtacggggagtgctactggaaccggatcttccagatccctggcatcatgatctgcgggaagcacgagcgcccgctcagcaagagccagcttaacatccaccggaacccgctgaacaagttcatcatgcccaaccaggaggtcgcggtggacatcaagatcgacaacgagatattcgagcagttgctggagatcacgcggaacgtggagtacttcttcaccaacaaggtggacaccttcaactaccaggaattgtacgaaaagtactttgagttcatcaagatcgcgtccatagcgatcccactatcccacctcaagaagaaactgggcgagctcatcatctcacgcttcaacgagaagactctcgacttcctgaacagcaacccgcgcaagaacgactggctcagctacctgagcgtggagcggatcaagcacatccaccccatccggcacgtgctcctcatgatgtcgctcgcgctcagcgtcgagcgcttcatcaacatcgtcccgaagtaccagcccttcgggtccggggcctggatctgcatgaacagcctctccgagcactacctggagaaggtggtcacgaacgtgaacatcacgttcaacaaggacatcggcaacttccagggcgagttcaagtgctcctgcggcttcacctacgtgctgtacaacggggagaacaacccgtgcaacatctccaagttctcgccacgggtcaaggagaaggggcacatctggcggaaggagttcgacgagctggtgagcagaggggcgagcatcaaggagatcgcgctcaagacgaactactccaccgggaccgtccgcaagatcattaagcaagggcacaactaccacgagaacgagaagaaacggcggcagcagaacctggaggagcggcgcatcatccgcgaaaagaacgacaagatggactggaacggcatccggcggaagtaccccaacagctcccgcacggagctgatgtacgagaacaaggcgctgtacaaccgcctcctgcgctacgaccgcgagtggctcatcgagaactcgccgacgtcccagcggggcgcggtcaagacctccgacgacatcaaccacaagcgcgacgtgctgtacctcaaggtggcccaggacatgctggagaactggtcggagtacgagaaacaggccggcaagattattaagaaaacacagttcaccctctacacgcggctcggcatgaagacgcgcaacaacgacaagtacccgctcaccgtggccttcatcagcacgttcatcgagagcaacgaggactaccagatcaggctcatcaaccagtgcatcgagaaccacttcatcaacagcgagatcaagcgataccgcatcttggagtacagcgggctccgctacctccacccgaaggcggagaagtacctggaggtcatcatcaacgagaacaacaagcggaactga

SEQ ID NO: 2635 - DNA, 1431 bp, Unknown
  Bacillus sp. multi
atgagcgtcagcgtgtccgacgaacttcagctcttcgcccaggagatacagtcgttcctgtccccgaacactctacgcgacctggcccgcgacgtggggttcgtgcagcgcaccagcaagtaccaggcgaaagacctcgttgccctctgcatctggatgtcgcagaacatcgccacgacctcgctcgcccaactgtcctcgtgcctggagtcctccaccgaagtccttatctccccggagggcctgaaccagcggttcaatacctccgccgtccagttcctccaacacatcctcaccaacctcctcaacaagaagctcacgtcctccatgcccctcagcagcccctatacttctgtcttcaaacgcatccgcatactggactccacggccttccagctccccgacatcttcagcaccatctatccgggtgctggcggctgctcccacacagcgggcatgaagatccagctagagtacgacctcctgtccggccagttcctgcacatccacacgggaccgggaaagcagcacgaccggacctacgggagcctgtgcgtccccaccgtgacgcccaacgacctgtgcatacgcgacctcggctacttccacctcaaagatttgcaacacatccaggacaaaaaggcgtattacatcagccggatcaagtccaacacgcggatctaccaaaaaaatctgacacctgactacttccaggacggacggattaagaaaggcacagagtacatccagatcgacatggaggttcttatgaactccctccagcccggccagacgtacgagatttcggatgcgtacgtgggcatgacggacaaggtgccgacgcgggtcatcgtccaccgcctgaccgacgagcagcagcagaagcggctccaagaccaggccgtgcgcgaaaaaaagaaggggatcaagtacagcccgagatccaagcggctcagcggcatcaacgtttacatgaccaacacctcgaccgataccgtgccgatgggccaagtccatgactggtacagcctgcgctggcagatcgagatcctgttcaagacttggaaatcctttttccacatccaccactgcaaaaagatcaaacgcgagcgcctggagtgccacctctacgggcagctcatcgccatcctcctctgctcctcgacgatgttccagatgcggcagttgctcctcatgaaaaagaaacgcgagctgtcggagtacaaggcgatctacatgatccgggactatttcttcctgatctaccaagcgatccagaaggacacccaggaacttagcaagatcctcatccgcctgttcaacctgctccagcagaacgggcgcaagtcgcaccgctacgagaagaagaccgtcttcgacatcctcggcgtcgtgtacaactcgacgatctccgaggaccaggccgcgtga

SEQ ID NO: 2636 - DNA, 1431 bp, Unknown
  Bacillus sp. multi
atgtcggtcagcgtgtccgacgaactccagctattcgcccaggagatccagagcttcctctcgcccaacaccctccgcgacctggcgcgcgacgtggggttcgtccagcggactagcaagtaccaggcgaaggacttggtggcactctgcatctggatgagccagaacatcgccaccacctccctcgcccagctctcctcctgcctagaatcgagcacagaggtgcttatctccccggaggggctcaaccagcggttcaacacaagcgcggtgcagttcctccagcacatcctcaccaacttgctgaacaagaagctgacgtcttccatgcctctctcgtcgccctacacctccgtctttaagcgcatccggatactcgacagcaccgccttccagctcccggacatattcagtacgatataccccggcgcgggcgggtgcagtcacactgcggggatgaagatacaacttgagtatgatctcctgagtggccagttcctgcacatccacacagggccgggcaagcagcacgaccggacgtacggcagcctgtgcgtgccgacggtgaccccgaacgacctctgcatccgcgacctggggtacttccacctcaaggacttgcagcacatccaggacaagaaagcttactacataagccggatcaagagcaacacccgcatctaccagaagaatctgacgccggactacttccaggacgggcggatcaaaaaaggcaccgagtacatccagatcgacatggaggtgctcatgaactccctccagcccggacaaacgtacgagatcagcgacgcctacgtcgggatgacggacaaggtgccaaccagggtcatcgtccataggctcacggacgagcagcagcagaagcggctccaggaccaagccgtgcgggagaagaaaaagggtatcaagtattcgccgcgctccaagcgcctcagcggcatcaatgtgtacatgaccaacacctccaccgacaccgtgccgatgggccaagtgcacgactggtactcgctccggtggcagatcgagatcctcttcaagacatggaagtcgttctttcacatccaccactgcaagaaaatcaagcgcgagcgcctggagtgccacctctacgggcaattgatcgctattctgctctgctcctcgacgatgttccagatgcgccagctcctgctcatgaaaaagaaacgcgaactctcggagtacaaggcgatctacatgatccgggactatttctttctgatataccaggcgatccaaaaggacacccaggaactgagcaagatcctcatccggctgttcaacctgctccagcagaacgggcggaagtcgcaccgctacgaaaaaaagacagtcttcgacatcctgggcgtcgtgtacaattctaccatctccgaggaccaggccgcgtga

SEQ ID NO: 2637 - DNA, 1431 bp, Unknown
  Bacillus sp. multi
atgtcggtgtccgtctcggacgaattacaattgttcgcccaggagatccagtccttcctgtccccaaacacgctccgcgacctggcgcgcgatgtggggttcgtgcagcggacctcgaagtaccaggcgaaggacctcgtggccctgtgcatctggatgtcccagaacatcgcaaccacctccctcgcgcagttatcgtcatgcttggagagcagcaccgaggtgctcatctcgcccgagggcctcaaccagcggttcaacacctccgccgtgcagttcctccaacacatcctcaccaacctcctgaacaagaaactcacctcgtcaatgccgctgtcgagcccttacaccagcgtgttcaagcgcatccgcatcctcgactccacggcgttccagctgccggacatttttagcacgatctaccctggcgccggcggctgttcccacaccgctgggatgaagatccagttggagtacgacctgctgagcgggcagttcctgcacatccacacgggaccggggaagcagcacgaccgcacgtacggttcactctgcgtcccgaccgtgacgcccaacgacctctgcatccgcgatttgggctatttccaccttaaagatctccagcacatacaggacaagaaggcgtactatatcagccgcatcaagagcaacacgcgaatctaccagaagaaccttacacccgactacttccaggacgggcgtatcaagaagggcaccgagtacatccagatagacatggaggtcttgatgaactcgcttcagccgggccagacgtacgagatcagcgacgcctacgtcggcatgaccgacaaggtgccgacgagggtcatcgtgcaccgcctgacggacgaacaacagcagaagcggctccaggaccaggccgtccgggagaagaaaaaagggatcaagtacagcccgcgctccaagcgcctgtcgggcatcaacgtctatatgacgaacaccagcacggacaccgtgcctatgggacaagtgcacgactggtactcgctccggtggcagatcgagatcctcttcaagacctggaagtcgttctttcacatccaccactgcaagaaaataaagcgtgagcgcctggagtgccatctgtacgggcagctcatcgccatcctcctttgtagtagcactatgttccagatgcgccaactcctgctcatgaaaaagaaacgcgagctgtccgagtacaaagccatctacatgatccgcgactacttcttccttatctaccaggccatacagaaggacacccaagagctgagcaagatcctgatccgcctgtttaacctactgcaacaaaacgggcgcaagagccaccgctacgagaagaagacagtgttcgacatcctgggagtcgtgtataactccacaatcagcgaagaccaggcggcgtga

SEQ ID NO: 2638 - DNA, 1431 bp, Unknown
  Bacillus sp. multi
atgtccgtgagcgtgagcgatgagctgcaactcttcgcccaggagatccagtcgttcctgtcgccgaatacgctgcgcgacctggcccgcgacgtcggcttcgtgcagcgcacctccaagtaccaggcgaaggacttggtggcgctctgcatctggatgtcccagaacatcgccaccaccagcctcgcccagttgtcgagctgcctggagtcctccacagaagtcctcatcagcccggaggggttgaaccagcgcttcaacacctccgccgttcagttcctgcaacacatcctgaccaacctcctgaacaaaaagctcaccagctcgatgcccctcagcagcccctatacaagcgtcttcaagcggattcgcatcctcgactccacggcgttccagctcccggacatattcagtaccatctatccaggggcgggaggatgctcccacacggcgggtatgaagatccagctagaatacgacctgctgtccggccagttcctgcacatccacacggggcccggcaagcagcacgaccggacgtacggctccctttgcgtccccaccgtcaccccaaacgacctctgcatcagggatctggggtacttccacctcaaggatctccagcacatccaggacaagaaggcgtactacatctcccgcatcaagagcaacacccgcatctaccaaaaaaatctcacccctgactacttccaggacgggcggattaagaaaggcactgagtacatccagatcgacatggaggtgctgatgaacagtctccagcctgggcagacctacgaaatctcggacgcctacgtgggcatgacggataaggtgccgacccgcgtcatcgtgcatcgcctgaccgacgagcagcagcagaagcggctccaggaccaagccgtgcgcgaaaaaaagaaagggatcaagtacagcccacgcagcaagcgcctgtctggcatcaacgtctatatgaccaacaccagcacggacaccgtgccgatgggccaagttcacgattggtactccctccgctggcagatcgagatcctgttcaagacctggaagtccttttttcacatccaccactgcaagaaaatcaagcgcgagcgcctggagtgccacctctacgggcaactcatcgccatactcctctgctcctcgaccatgttccagatgcgccagcttctactgatgaagaagaagcgcgagctgagcgagtacaaggccatctacatgatccgggactactttttcctcatctaccaggccatccagaaggacactcaggagctgagcaagatcctcatccggcttttcaacctgctccagcagaacggccggaagtcccaccgctacgagaagaaaaccgtcttcgacatcctgggcgtcgtgtacaacagcactatcagcgaggaccaagccgcatga

SEQ ID NO: 2639 - DNA, 1431 bp, Unknown
  Bacillus sp. multi
atgtccgtgtccgtgtccgacgagcttcagctcttcgcccaggagatacaatccttcctgtcccccaacaccctgcgggatctggcccgcgatgtgggcttcgtccagcgcacctcaaagtaccaggcgaaggatctcgtggccctctgtatctggatgtcccagaacatcgccaccacgagcctcgcccaactctcctcctgcctcgaatcctccactgaggtgctcatcagccccgagggcctcaaccagaggttcaacacctccgccgtccagttcctccagcacatcctcacaaacctcctcaacaagaaattgacctcgtccatgccgctgtcgtctccttacacctctgtcttcaagcgcatcaggatcctcgattccacggcgttccagctcccggacattttcagcactatctaccccggggcgggcggctgctcccacacggcggggatgaagatccagctagagtacgacctgctcagtggccagttcctgcacatccacaccggaccaggcaagcagcacgaccgcacctacggctcgctctgcgtccccaccgtgacacctaatgacctctgcatccgagacctggggtacttccacctcaaggatctgcaacacatccaagacaagaaggcgtactacatctcccggattaaatccaacacccgcatataccagaaaaatctcacgcccgattacttccaggacgggcgtatcaagaaaggcactgagtacatacagatcgacatggaggtgctgatgaactccctccagccgggacagacgtacgagatcagcgacgcctacgtcgggatgaccgacaaggtgccgacgcgggtcatcgtgcaccgcctgacggacgagcagcagcagaagcggcttcaagatcaggccgtgcgcgaaaagaagaagggcatcaagtactcgccgcgcagcaagaggctgagcggtattaatgtctatatgacgaacacctcgacggacaccgtgccgatgggtcaagtacacgactggtactcgctccgctggcagatcgagatcctgttcaagacgtggaagagcttcttccacattcaccactgcaagaaaatcaagcgggagcgcctcgagtgccacctgtacggccagctgatcgccatcctcctgtgctccagtacgatgttccagatgcgccaactgttgctcatgaagaagaagcgggaactctctgagtacaaggcgatatacatgatccgcgactatttctttctaatctaccaggccatccagaaggacacgcaggagctgagcaagatcctgatccgcctgttcaacctccttcagcagaacggccgtaagtcgcaccgctacgagaagaaaactgtcttcgacatcctgggtgtggtgtacaactcgacgattagcgaggaccaggcggcatga

SEQ ID NO: 2640 - DNA, 828 bp, Unknown
  Streptomyces sp. multi
atgtcagaacggaggcgttatcccagcgacctgagcgacgccagttggcagcttgtggagcccgtccttgccgcctggcggtgcgaacgtcgtggccggggccttgatattggccgtccaccggaccacgacctacgctcgcttctcgatgcggttctctatgtcaaccgcacgggaatcccgtggcggtatctccctcacgactatccacactggaacacagtatatgcttactttgccagatggcaagaagaggacatattcgaccagctcaacaccttgctccgaagacaggaaggccgcgaggaggaacctaccgcgtgcgttattgactcccaatctatcaagacttcaacgaacgtccctgccagggaacaaggaattgatgctggcaagaagattgtcggacacaagaggaacattgtcattgacacagtggggctcctgcgaactgtactggtcactgcggcatcggtacaagattccatagccgggcaaacgcttattgaccgaatcgccgccgaccatcctacggtacgcaagacgtgggtggatggcggctaccggcaatacctggtcgaacacgcagccacactggggatcgacatgcacatcgtccggcgtgatcctacgacacgcggcttcactgtgcttccgagacgttggacagtggagcgaacacttgggtggcttatgaaccaccgacgtttggctcgggactacgaagcccacagccgttgttcagaagccatgattcacctggcgatgattaacctcatgacgaggcgtcctaccgccgagtgcacgcccacctggaggggtgcctaa

SEQ ID NO: 2641 - DNA, 828 bp, Unknown
  Streptomyces sp. multi
atgagtgaaagacggcgttatccttcggacctttcggacgcgagttggcagttggtggaaccggtactcgccgcgtggagatgcgagcggcgtggacggggactcgacattggtaggccgccggatcacgacctgcggtcccttctggatgccgttctctacgtcaacaggacgggtatcccgtggagatacctcccgcatgactacccgcactggaatacggtttatgcctacttcgcgcggtggcaagaagaggacatcttcgaccagctcaacactctccttagacgtcaggaggggagggaggaggaacccacggcgtgtgtaattgactctcagtcgattaagaccagtaccaacgttccagcgcgggaacaaggaattgacgctggcaagaaaatcgtcggccacaaacgcaatatcgtcattgatacggtgggactattgaggactgtgctcgtgaccgccgcgagtgtccaagactctatagccgggcagacactaatcgaccgcattgcggctgaccatcctaccgttcgcaaaacctgggtggacggagggtatcggcaatatctggtggagcacgccgctaccctcggtatcgacatgcacattgttcggcgtgaccctactacgaggggcttcaccgtgctgcctcggcgctggaccgttgaaaggacactggggtggcttatgaaccaccgtcgtctcgcacgggattacgaggcgcatagtcggtgctcggaggccatgatccaccttgcgatgataaacttgatgacaaggcgtccaacagcagaatgcactccgacttggcgcggcgcttga

SEQ ID NO: 2642 - DNA, 828 bp, Unknown
  Streptomyces sp. multi
atgtccgagcggaggcgctatccatcggacctgagcgatgcaagttggcagctagtggagcccgttctagcagcgtggcgctgcgagcgccggggacgcggattggatattggacgtcctcccgatcacgacctgaggtcgctgctcgatgccgtcttgtacgtgaatcgtacaggaatcccctggcgctatctcccgcacgactacccgcactggaacacagtgtacgcctactttgcgcgatggcaagaggaggacatcttcgaccaactgaacaccctcttgcgacgccaggagggccgcgaggaggaaccgaccgcctgcgtaatcgacagccagtcgattaagacatcaacaaatgtccctgcgcgtgaacagggtattgacgcgggcaagaaaatcgtcggccacaagcggaacattgtcattgatactgtggggctcttgagaaccgtgctggtcactgccgcatcagtgcaagattccattgcgggacagaccctaattgacaggatcgctgctgaccacccgaccgtcaggaaaacgtgggtggacggcggatacaggcaatatctagtcgagcacgctgccactttggggatcgacatgcacatcgttagacgtgacccaactactcgtgggttcactgttctgccaagacgctggacagtcgaacgaacgctcgggtggctcatgaaccatcgaaggctcgccagggattacgaagcgcacagtagatgttcggaagctatgatccacttggccatgattaacctcatgacgcggcggcctacagccgaatgtacccctacatggcgaggcgcgtga

SEQ ID NO: 2643 - DNA, 828 bp, Unknown
  Streptomyces sp. multi
atgtccgagcggaggcgctatcccagcgatctcagcgatgcgtcttggcagctcgtagagccggtcttggccgcctggcgatgcgagcgccgtggacggggcctggacatcggtcggcctcctgaccacgacctgcggtcgctgctcgacgcagtgctctacgtcaaccgtacgggtatcccgtggcggtatctgcctcatgactacccacactggaacaccgtttatgcgtacttcgcaagatggcaagaggaggacatcttcgaccagctcaacacccttctaaggagacaggaggggcgcgaggaggaacctaccgcctgcgtgatcgactcacagagtatcaagaccagcaccaatgtcccggccagggaacagggcatcgacgcgggcaagaagattgtcggccataagaggaacatcgttatcgacacagtagggcttctccggactgtgttagttaccgcagcctcggttcaagacagcattgcggggcaaacactcattgatcgaatcgcggcagaccacccgacagtcaggaagacctgggtggatggcggctacaggcagtacctcgtagaacacgcagcaactttgggaatcgacatgcacattgttcgcagagatccaaccactagaggcttcacggtattgccgaggagatggacagtggaacggacactaggctggctgatgaaccaccgcagattggccagagattacgaggcacactcgcggtgttctgaggccatgattcatcttgccatgattaacctcatgacgcggcggcctacagccgaatgcactcccacatggaggggcgcatga

SEQ ID NO: 2644 - DNA, 828 bp, Unknown
  Streptomyces sp. multi
atgtcggaacgtaggcggtatccgtccgacctgtcagacgcatcttggcaactcgttgagccagtcctcgccgcctggaggtgcgagcggcgcgggcgcggcctcgatattggtcgcccgcccgaccatgatctccgctccctcctagatgcagttctctatgtgaatcgtacgggtatcccgtggcgctacctgccgcacgattacccgcactggaacaccgtctatgcgtacttcgcccggtggcaagaggaggacatcttcgaccaattgaacacattactcaggagacaggagggtcgggaggaggaacctacggcctgtgttattgactcgcagtcgatcaagacttcaacaaacgtgcctgcgcgcgaacaaggaattgacgctggcaagaaaatcgtgggtcacaagcgcaacattgtgatcgacactgtgggcttgctgaggaccgttctcgtgacagcggcatccgtccaagactctattgcggggcagaccctgattgacaggatcgcggccgaccaccccacggtgcgaaagacttgggtcgatggaggatacagacaatacctggtcgaacacgctgctacactgggaatagacatgcacatcgtgcgccgagatccgacaacaaggggctttaccgtactcccacgacggtggacagtcgagcgcacactgggctggctcatgaaccaccgacggttggcccgagactatgaagcccactcgcgctgctcagaggccatgattcatctggctatgataaacctgatgacacgacgtccgactgctgagtgcacacccacatggcgcggagcttaa

SEQ ID NO: 2645 - DNA, 1332 bp, Unknown
  Bacillus sp. multi
atgaagtaccagatcgtgtgcccggtcaacatcgagtggaagacgttcgagatctacctccggacgctgagctaccacttccgcaccatcgggaaccgcacgatccagaagctctgggagtacgacaaccagtccctcaagcacttcaaggacacggggcagtaccccagcgcccagcagctctacggctgcacccagaaaacgatctccggctacatctacgaccagctcaaggaggagtaccaggacatcaacaaggcgaacatgagcaccaccctccagaagaccatccggacgtggaactcccgcaagaaggagatatggagcggcgagatgtccatccccagcttccggaacaacctgcccatcgacatccacggcaactcgatccagatcatcaaggagaagtccggcgactacatcgccagcgtgagcctgttctccagcaagttcatcaaggagaacgacctgcccaacggcaagatcctggtcaagctcagcacgcgcaagcagaacagcatgaaggtgatcctcgaccggatcatcgactccacctacgcgaagggcgcgtgcatgctccacaagcacaagaagaagtggtacctctccatcacctacaagagcaacatcaaggaggagctgaagttcgacgaggacctcataatgggcatcgacatgggcaagatcaacgtcctgtacttcgcgttcaacaaggggctggtgcgcggggcgatctccggcgaggagatcgaggcgttccgcaagaagattgagcaccgccggatctcgctcctccgccagggcaaatactgctcgggcaaccgcatcggcaaggggcgggagaagcgcatcaagcccatcgacgtgctgaacgacaaggtggccaagttccgcaacgccacgaaccacaagtacgccaactacatcgtccagcagtgcctcaagtacaactgcggcaccatccagctcgaggatctcaaggggatcagcaaggagcagaccttcctcaagaactggacgtacttcgacctccaggagaagatcaagaaccaggcgaaccagtacggggtgaaggtggtgaagatcgacccgagctacacctcccagcggtgctccgagtgcgagtacatccacaagaacaaccgccaggaccagagcacgttcgagtgccagcagtgcagcttcaaggtccacgccgactacaacgcggccaagaacatctcggtgtacaacatcgagaaggtgatccagaaacagctcgaactccaggagaagctgaaccagaccaagtacaaggagcagtacatcgagcagatgaagaacatcaactga

SEQ ID NO: 2646 - DNA, 1332 bp, Unknown
  Bacillus sp. multi
atgaagtaccagatcgtgtgccccgtcaacatcgagtggaagacgttcgagatatacctgcggaccctctcctaccacttccgcaccatcggcaaccgcaccatccagaagctctgggagtacgacaaccagagcctcaagcacttcaaggacacgggccagtaccccagcgcgcagcagctctacggctgcacgcagaagacgatctcggggtacatctacgaccagctcaaggaggagtaccaggacatcaacaaggccaacatgagcaccaccctccagaagacgatccgcacctggaactcccgcaagaaggagatatggagcggggagatgtccatcccgtccttccgcaacaacctgcccatcgacatccacggcaacagcatccagatcatcaaggagaagtcgggcgactacatcgccagcgtgagcctgttctcctccaagttcatcaaggagaacgacctgccgaacggcaagatcctggtgaagctgtccacccgcaagcagaacagcatgaaggtgatcctggaccgcatcatcgactccacctacgcgaagggcgcgtgcatgctgcacaagcacaagaagaagtggtacctctccatcacctacaagagcaacatcaaggaggagctgaagttcgacgaggatctcatcatggggatcgacatgggcaagatcaacgtgctctacttcgccttcaacaaggggctcgtgcggggcgcgatcagcggcgaggagatcgaggcgttccgcaagaaaatcgagcaccgccgcatctccctcctgcgccagggcaagtattgctccggcaaccgcatcggcaagggccgcgagaagcgcatcaagcccatcgacgtgctgaacgacaaggtggccaagttccgcaacgcgacgaaccacaagtacgcgaactacatcgtccagcagtgcctcaagtacaactgcgggaccatacagctcgaagacctgaaggggatcagcaaggagcagaccttcctcaagaactggacctacttcgacctccaggagaagatcaagaaccaggccaaccagtacggggtgaaggtggtgaagatcgacccctcctacaccagccagcgctgctccgagtgcgagtacatccacaagaacaaccgccaggaccagagcaccttcgagtgccagcagtgctcgttcaaggtccacgcggactacaacgcggccaagaacatcagcgtgtacaacatcgagaaggtgatccagaagcagctcgaactccaggagaagctgaaccagaccaagtacaaggagcagtacatcgagcagatgaagaacatcaactag

SEQ ID NO: 2647 - DNA, 1332 bp, Unknown
  Bacillus sp. multi
atgaagtaccagatcgtgtgcccggtcaacatcgagtggaagaccttcgagatctacctccggaccctgagctaccacttccggaccatcggcaaccgcaccatccagaagctgtgggagtacgacaaccagtccctcaagcacttcaaggacaccggccagtacccgtccgcccagcagctctacggctgcacgcagaagacgatctccggctacatctacgaccagctcaaggaggagtaccaggacatcaacaaggcgaacatgagcacgaccctccagaaaaccatccggacctggaactcgcgcaagaaggagatctggagcggggagatgagcatcccgagcttccgcaacaacctgcccatcgacatccacgggaactcgatccagatcatcaaggagaagtcgggcgactacatcgcctcggtgagcctgttctcctccaagttcatcaaggagaacgacctccccaacgggaagatcctggtcaagctctccacgcggaagcagaactccatgaaggtgatcctggaccggatcatcgactccacctacgcgaagggcgcgtgcatgctccacaagcacaagaagaagtggtacttgtccatcacctacaagagcaacatcaaggaggagctgaagttcgacgaggacttgatcatgggcatcgacatggggaagatcaacgtcctgtacttcgccttcaacaagggcctcgtgcgcggggccatctcgggcgaggagatcgaggcgttccgcaagaagatcgagcaccggcgcatctcgctgctgcgccagggcaagtactgctccggcaaccgcatcgggaagggccgggagaagcgcatcaagcccatcgacgtcctcaacgacaaggtggccaagttccgcaacgccacgaaccacaagtacgcgaactacatcgtgcagcagtgcctcaagtacaactgcggcacgattcagctggaggatcttaaggggatcagcaaggagcagacgttcctcaagaactggacctacttcgacctccaggagaagattaagaaccaggccaaccagtacggggtcaaggtcgtcaagatcgaccccagctacacctcccagcggtgctccgagtgcgagtacatccacaagaacaaccgccaggaccagagcacgttcgagtgccagcagtgctccttcaaggtgcacgcggactacaacgcggccaagaacatcagcgtgtacaacatcgagaaggtgatccagaagcagcttgagctccaggagaagctgaaccagaccaagtacaaggagcagtacatcgagcagatgaagaacatcaactag

SEQ ID NO: 2648 - DNA, 1332 bp, Unknown
  Bacillus sp. multi
atgaagtaccagatcgtgtgcccggtgaacatcgagtggaagaccttcgagatctacctccggacgctctcgtaccacttccgcaccatcggcaaccggaccatccagaagctgtgggagtacgacaaccagagcctcaagcacttcaaggacacgggccagtacccgtccgcccagcagctctacggctgcacccagaagacgatctccggctacatctacgaccagctcaaggaggagtaccaggacatcaacaaggccaacatgagcaccaccctccagaaaaccatccggacctggaacagccgcaagaaggagatttggagcggcgagatgagcatcccgagcttccgcaacaacctgcccatcgacatccacggcaacagcatccagatcatcaaggagaagtccggcgactacatcgcgtccgtcagcctgttctcgtccaagttcatcaaggagaacgacctccccaacggcaagatcctggtgaagctcagcacccggaagcagaactcgatgaaggtcatcctggaccgcatcatcgactcgacctacgcgaagggcgcgtgcatgctccacaagcacaagaagaagtggtacctctccatcacctacaagtccaacatcaaggaggagctcaagttcgacgaggacctcattatgggcatcgacatggggaagatcaacgtcctctacttcgccttcaacaagggcctcgtgcgcggcgcgatctccggcgaggagatcgaggcgttccgcaagaagatcgagcaccgccggatctccctgctccgccagggcaaatactgctcgggcaaccggatcggcaagggccgggagaagcgcatcaagcccatcgacgtgctcaacgacaaggtggccaagttccgcaacgccaccaaccacaagtacgcgaactacatcgtgcagcagtgcctcaagtacaactgcgggacgatccagttggaggacttgaaggggatcagcaaggagcagacgttcctcaagaactggacgtacttcgacctccaggagaagatcaagaaccaggccaaccagtacggcgtcaaggtcgtcaagatcgacccgtcctacaccagccagcggtgctcggagtgcgagtacatccacaagaacaaccgccaggaccagagcacgttcgagtgccagcagtgcagcttcaaggtccacgccgactacaacgcggccaagaacatctccgtgtacaacatcgagaaggtcatccagaagcagctggagttgcaggagaagctgaaccagaccaagtacaaggagcagtacatcgagcagatgaagaatatcaactga

SEQ ID NO: 2649 - DNA, 1332 bp, Unknown
  Bacillus sp. multi
atgaagtaccagatcgtctgccccgtgaacatcgagtggaagacgttcgaaatctacctgcggaccctctcctaccacttccggaccatcggcaaccgcacgatccagaagctctgggagtacgacaaccagtcgctcaagcacttcaaggacaccgggcagtacccctccgcgcagcagctctacggctgcacccagaaaacgatcagcggctacatctacgaccagctcaaggaggagtaccaggacatcaacaaggccaacatgagcaccaccctccagaagaccatccggacgtggaactcccgcaagaaggagatatggagcggcgagatgtccatcccgagcttccggaacaacctccccatcgacatccacgggaacagcatccagatcatcaaggagaagtccggcgactacatcgcctcggtgtccctcttcagcagcaagttcatcaaggagaacgacctccccaacggcaagatcctggtgaagctgagcacgcgcaagcagaacagcatgaaggtgatcctcgaccgcatcatcgactccacctacgcgaagggcgcgtgcatgctccacaagcacaagaagaagtggtacctgagcatcacctacaagtccaacatcaaggaggagctaaagttcgacgaggacctgatcatggggatcgacatgggcaagatcaacgtgctgtacttcgcgttcaacaaggggctcgtccggggcgcgatcagcggggaggagatcgaggcgttccgcaagaagatagagcaccggcgcatctccctgctgcgccaggggaagtactgctcggggaaccggatcgggaagggccgcgagaagcgcatcaagcccatcgacgtcctcaacgacaaggtggccaagttccgcaacgccacgaaccacaagtacgccaactacatcgtccagcagtgcctcaagtacaactgcggcaccatccagttggaggatctcaaggggatctcgaaggagcagaccttcctcaagaactggacctacttcgacctccaggagaagatcaagaaccaggccaaccagtacggcgtcaaggtggtgaagatcgacccgagctacacgagccagcggtgctccgagtgcgagtacatccacaagaacaaccgccaggaccagagcacgttcgagtgccagcagtgctcgttcaaggtgcacgccgactacaacgccgccaagaacatctcggtgtacaacatcgagaaggtgatccagaagcagttggagctgcaggagaagctgaaccagaccaagtacaaggagcagtacatcgagcagatgaagaacatcaactag

SEQ ID NO: 2650 - DNA, 1362 bp, Unknown
  Bacillus sp. multi
gtgacgtacctgtccatcgccgtgaaggtcatgaagtaccagatcgtgtgcccggtgaacatcgagtggaagaccttcgagatatacctccggaccctctcctaccacttccgcaccatcggcaaccggacgatccagaagctctgggagtacgacaaccagtcgctcaagcacttcaaggacacgggccagtacccctccgcgcagcagctctacggctgcacccagaagactatctccgggtacatctacgaccagctcaaggaggagtaccaggacatcaacaaggcgaacatgagcacgaccctccagaaaaccatccgcacctggaactcgcgcaagaaggagatctggagcggcgagatgagcatcccgtcgttccgcaacaacctgcccatcgacatccacgggaacagcatccagatcatcaaggagaagtccggcgactacatcgcgtccgtcagcctcttcagcagcaagttcatcaaggagaacgacctgcccaacgggaagatcctggtcaagctgtccacccgcaagcagaacagcatgaaggtgatcctcgaccgcatcatcgactccacctacgcgaagggcgcgtgcatgctgcacaagcacaagaagaagtggtatctctcgatcacctacaagagcaacatcaaggaggagctcaagttcgacgaggatctcatcatgggcatcgacatgggcaagatcaacgtgctgtacttcgccttcaacaagggcctcgtgcggggcgcgatctccggcgaggagatcgaggcgttccgcaagaagatcgagcaccgccggatctccctcctgcgccagggcaagtattgctccgggaaccgcatcgggaaggggcgggagaagcgcatcaagcccatcgacgtcctgaacgacaaggtggcgaagttccgcaacgccaccaaccacaagtacgccaactacatcgtccagcagtgcctcaagtacaactgcggcacgatccagttagaggacctcaaggggatcagcaaggagcagacgttcctcaagaactggacctacttcgacctccaggagaagatcaagaaccaggccaaccagtacggcgtcaaggtcgtgaagatcgacccgagctacacgagccagcggtgctccgagtgcgagtacatccacaagaacaaccgccaggaccagagcaccttcgagtgccagcagtgctcgttcaaggtgcacgccgactacaacgcggccaagaacatcagcgtgtacaacatcgagaaggtgatccagaagcagctggagctacaggagaagctgaaccagaccaagtacaaggagcagtacatcgagcagatgaagaacatcaactga

SEQ ID NO: 2651 - DNA, 1362 bp, Unknown
  Bacillus sp. multi
gtgacctacctgagcatcgccgtgaaggtgatgaagtaccagatcgtgtgccccgtgaacatcgagtggaagaccttcgagatctacctccggacgctctcctaccacttccggaccatcggcaaccgcacgatccagaagctgtgggagtacgacaaccagtcgctcaagcacttcaaggacacgggccagtaccccagcgcccagcagctctacgggtgcacgcagaagacgatcagcggctacatctacgaccagctcaaggaggagtaccaggacatcaacaaggccaacatgagcaccaccctccagaaaacgatccggacctggaacagccgcaagaaggagatttggagcggcgagatgagcatccccagcttccgcaacaacctccccatcgacatccacgggaacagcatccagatcatcaaggagaagtccggggactacatcgccagcgtgagcctgttctccagcaagttcatcaaggagaacgacctgcccaacgggaagatcctggtgaagctcagcacgcggaagcagaacagcatgaaggtgatcctggaccgcatcatcgactccacgtacgcgaagggcgcgtgcatgctccacaagcacaagaagaagtggtatctctccatcacctacaagtccaacatcaaggaggagcttaagttcgacgaagaccttatcatgggcatcgacatggggaagatcaacgtcctctacttcgccttcaacaagggcctggtgcgcggggccatctcgggcgaggagatcgaggcgttccgcaagaagatcgagcaccggcggatctccctcctgcgccagggcaagtactgctccggcaaccgcatcggcaagggccgcgagaagcgcatcaagcccatcgacgtcctgaacgacaaggtggcgaagttccgcaacgccacgaaccacaagtacgccaactacatcgtgcagcagtgcctcaagtacaactgcggcaccattcagctggaggaccttaaggggatctcgaaggagcagaccttcctcaagaactggacctacttcgacctccaggagaagatcaagaaccaggcgaaccagtacggggtcaaggtcgtgaagatcgaccccagctacacgagccagcgctgctccgagtgcgagtacatccacaagaacaaccgccaggaccagagcacgttcgagtgccagcagtgcagcttcaaggtccacgcggactacaacgccgccaagaacatcagcgtgtacaacatcgagaaggtgatccagaagcagctcgagttgcaggagaagctgaaccagacgaagtacaaggagcagtacatcgagcagatgaagaacatcaactag

SEQ ID NO: 2652 - DNA, 1362 bp, Unknown
  Bacillus sp. multi
gtgacctacctctccatcgccgtgaaggtcatgaagtaccagatcgtgtgccccgtgaacatcgagtggaagacgttcgagatctacctgcggaccctcagctaccacttccggaccatcgggaaccgcaccatccagaagctctgggagtacgacaaccagtccctcaagcacttcaaggacaccgggcagtacccgtcggcccagcagctctacggctgcacccagaagacgatcagcggctacatctacgaccagctcaaggaggagtaccaggacatcaacaaggcgaacatgagcaccaccctccagaaaacaatccggacctggaactcccgcaagaaggaaatctggagcggcgagatgtccatcccctcgttccgcaacaacctccccatcgacatccacggcaacagcatccagatcatcaaggagaagtcgggcgactacatcgcctcggtgtccctgttctcctcgaagttcatcaaggagaacgacctgccgaacgggaagatcctggtgaagctgagcacccgcaagcagaactcgatgaaggtgatcctcgaccggatcatcgactccacctacgcgaagggcgcgtgcatgctgcacaagcacaagaagaagtggtacctatccatcacctacaagtccaacatcaaggaggagctgaagttcgacgaagacctcatcatgggcatcgacatgggcaagatcaacgtgctctacttcgccttcaacaagggcctcgtgcgcggcgcgatcagcggggaggagatcgaggcgttccgcaagaagatagagcaccgccgcatctccctgctccgccagggcaagtattgctccgggaaccgcatcggcaagggccgcgagaagcggatcaagcccatcgacgtgctcaacgacaaggtggccaagttccgcaacgccacgaaccacaagtacgcgaactacatcgtgcagcagtgcctcaagtacaactgcgggacgatccagctcgaagacctgaaggggatcagcaaggagcagacgttcctcaagaactggacctacttcgacctccaggagaagatcaagaaccaggccaaccagtacggggtgaaggtggtgaagatcgacccgtcctacacctcccagcggtgcagcgagtgcgagtacatccacaagaacaaccgccaggaccagagcaccttcgagtgccagcagtgctccttcaaggtccacgccgactacaacgccgccaagaacatctcggtgtacaacatcgagaaggtgatccagaagcagctcgagttgcaggagaagctgaaccagacgaagtacaaggagcagtacatcgagcagatgaagaacatcaactga

SEQ ID NO: 2653 - DNA, 1362 bp, Unknown
  Bacillus sp. multi
gtcacctacctgtccatcgccgtcaaggtcatgaagtaccagatcgtgtgccccgtcaacatcgagtggaagacgttcgagatctacctccggaccctctcgtaccacttccgcaccatcggcaaccggacgatccagaagctctgggagtacgacaaccagtccctcaagcacttcaaggacaccgggcagtacccgtcggcgcagcagctctacggctgcacccagaagaccatcagcggctacatctacgaccagctcaaggaggagtaccaggacatcaacaaggcgaacatgagcaccaccctccagaaaaccatccggacctggaactcgcgcaagaaggagatctggagcggcgagatgagcatccccagcttccgcaacaacctgcccatcgacatccacgggaactccatccagatcatcaaggagaagtccggcgactacatcgccagcgtctccctgttctccagcaagttcatcaaggagaacgacctccccaacgggaagatcctggtgaagctgtccacccgcaagcagaactccatgaaggtgatcctcgaccgcatcatcgactcgacgtacgcgaagggcgcgtgcatgctgcacaagcacaagaagaagtggtatctctccatcacctacaagagcaacatcaaggaggagctaaagttcgacgaggatctgataatggggatcgacatgggcaagatcaacgtgctgtacttcgccttcaacaagggcctcgtgcgcggcgcgatctcgggcgaggagatcgaggcgttccgcaagaagatcgagcaccggcggatctccctgctgcgccaggggaagtactgctccggcaaccgcatcgggaaggggcgggagaagcgcatcaagcccatcgacgtcctcaacgacaaggtggccaagttccgcaacgcgaccaaccacaagtacgcgaactacatcgtgcagcagtgcctcaagtacaactgcggcacgatccagcttgaggacttgaaggggatcagcaaggagcagacgttcctcaagaactggacgtacttcgacctccaggagaagattaagaaccaggccaaccagtacggggtgaaggtggtcaagatcgacccgagctacaccagccagcgctgctccgagtgcgagtacatccacaagaacaaccgccaggaccagagcacgttcgagtgccagcagtgctccttcaaggtgcacgcggactacaacgcggccaagaacatctccgtgtacaacatcgagaaggtgatccagaagcagttggagctgcaggagaagctgaaccagaccaagtacaaggagcagtacatcgagcagatgaagaacatcaactag

SEQ ID NO: 2654 - DNA, 1362 bp, Unknown
  Bacillus sp. multi
gtcacgtacctctccatcgccgtcaaggtgatgaagtaccagatcgtctgccccgtgaacatcgagtggaagaccttcgagatctacctccgcaccctctcctaccacttccgcaccatcggcaaccgcaccatccagaagctgtgggagtacgacaaccagtcgctcaagcacttcaaggacaccggccagtacccctccgcccagcagctctacgggtgcacgcagaagactatcagcgggtacatctacgaccagctcaaggaggagtaccaggacatcaacaaggccaacatgagcacgaccctccagaaaaccatccgcacctggaactcccgcaagaaggagatttggagcggggagatgtccatcccgtccttccggaacaacctccccatcgacatccacggcaactccatccagatcatcaaggagaagtccggggactacatcgcctcggtgtccctgttcagctcgaagttcatcaaggagaacgacctgcccaacgggaagatcctggtgaagctcagcacgcggaagcagaactcgatgaaggtcatcctggaccggatcatcgactccacctacgcgaagggcgcgtgcatgttgcacaagcacaagaagaagtggtacctgtccatcacctacaagagcaacatcaaggaggagcttaagttcgacgaagacctcatcatggggatcgacatgggcaagatcaacgtgctgtacttcgcgttcaacaagggcctcgtgcggggcgcgatctccggcgaggagatcgaggcgttccgcaagaagatagagcaccgccggatcagcctcctgcgccaggggaagtattgctccggcaaccggatcggcaaggggcgggagaagcggatcaagcccatcgacgtgctcaacgacaaggtggcgaagttccgcaacgcgaccaaccacaagtacgccaactacatcgtccagcagtgcctcaagtacaactgcggcaccatccagctcgaagacctcaaggggatctcgaaggagcagaccttcctcaagaactggacgtacttcgacctccaggagaagatcaagaaccaggcgaaccagtacggcgtgaaggtggtgaagatcgacccgagctacaccagccagcgctgctcggagtgcgagtacatccacaagaacaaccgccaggaccagtccacgttcgagtgccagcagtgcagcttcaaggtgcacgcggactacaacgcggccaagaacatctccgtgtacaacatcgagaaggtcatccagaagcagctggagctgcaggagaagctgaaccagacgaagtacaaggagcagtacatcgagcagatgaagaacatcaactag

SEQ ID NO: 2655 - DNA, 813 bp, Unknown
  Bacillus sp. multi
atgaaggtgatcctcgaccgcatcatcgacagcacctacgcgaagggcgcgtgcatgctgcacaagcacaagaagaagtggtacctgtccatcacctacaagagcaacatcaaggaggagctgaagttcgacgaggacctcatcatgggcatcgacatggggaagatcaacgtgctctacttcgcgttcaacaagggcctggtgcgcggcgggatctccggcgaggagatcgaggcgttccgcaagaagatcgagcaccgccgcatcagcctgctccgccaggggaagtactgctccggcaaccgcatcggcaagggccgcaagaagcggatcaagcccatcgaggtgctgaacgacaagatcgccaagttccgcaacgcgaccaaccacaagtacgccaactacatcgtgcagcagtgcctcaagtacaactgcgggaccatccagctcgaggatctccaggggatctcgaaggagcagaccttcctcaagaactggacgtacttcgacctccaggagaagatcaagaaccaggcgaaccagtacgggatcaaggtcgtcaagatcgaccccagctacacctcccagcgctgctcggagtgcggctacatccacaagaacaaccgccagaaccagtccaccttcgagtgccagcagtgcagcttcaaggtgcacgcggactacaacgcggccaagaacatctccgtgtacaacatcgagaaggtgatccagaagcagctcaagctccaggagaagctgaacctgacgaagtacaaggagcagtacatcgagcagatggagaacatcaactga

SEQ ID NO: 2656 - DNA, 813 bp, Unknown
  Bacillus sp. multi
atgaaggtgatcctcgaccgcatcatcgactccacgtacgcgaagggcgcgtgcatgctgcacaagcacaagaagaagtggtacctctccatcacgtacaagtcgaacatcaaggaggagctcaagttcgacgaagacctcatcatgggcatcgacatgggcaagatcaacgtgctctacttcgccttcaacaagggcctggtccggggcggcatctccggggaggagatcgaggcgttccgcaagaagatcgagcaccgccggatctccctcctgcgccaggggaagtactgctccggcaaccgcatcgggaagggccgcaagaagcgcatcaagcccatcgaggtgctgaacgacaagatcgccaagttccgcaacgccaccaaccacaagtacgccaactacatcgtccagcagtgcctcaagtacaactgcggcaccatccagctcgaggacctccaggggatctcgaaggagcagaccttcctcaagaactggacctacttcgacctccaggagaagatcaagaaccaggcgaaccagtacggcatcaaggtcgtcaagatcgacccgtcctacaccagccagcggtgctccgagtgcgggtacatccacaagaacaaccgccagaaccagagcaccttcgagtgccagcagtgctcgttcaaggtccacgccgactacaacgccgccaagaacatctccgtgtacaacatcgagaaggtgatccagaagcagctcaagctccaggagaagctcaacctgaccaagtacaaggagcagtacatcgagcagatggagaacatcaactga

SEQ ID NO: 2657 - DNA, 813 bp, Unknown
  Bacillus sp. multi
atgaaggtgatcctggaccggatcatcgacagcacctacgcgaagggcgcgtgcatgctgcacaagcacaagaagaagtggtacctgagcatcacgtacaagtccaacatcaaggaggagctcaagttcgacgaggacctcatcatgggcatcgacatgggcaagatcaacgtcctctacttcgccttcaacaaggggctcgtgcgcggcgggatctcgggcgaggagatcgaggcgttccgcaagaagatcgagcaccgccgcatctcgctcctccgccagggcaagtactgctcgggcaaccgcatcgggaaggggcgcaagaagcgcatcaagcccatcgaggtgctgaacgacaagatcgccaagttccgcaacgcgaccaaccacaagtacgccaactacatcgtgcagcagtgcctcaagtacaactgcgggacgatccagctcgaagacctccagggcatctcgaaggagcagaccttcctcaagaactggacgtacttcgacctccaggagaagatcaagaaccaggcgaaccagtacggcatcaaggtcgtgaagatcgacccgtcctacaccagccagcggtgcagcgagtgcgggtacatccacaagaacaaccgccagaaccagagcaccttcgagtgccagcagtgcagcttcaaggtgcacgcggactacaacgcggccaagaacatcagcgtgtacaacatcgagaaggtgatccagaagcagctcaagctccaggagaagctgaacctgaccaagtacaaggagcagtacatcgagcagatggagaacatcaactga

SEQ ID NO: 2658 - DNA, 813 bp, Unknown
  Bacillus sp. multi
atgaaggtcatcctcgaccggatcatcgacagcacgtacgcgaagggcgcgtgcatgctccacaagcacaagaagaagtggtacctgtccatcacctacaagtcgaacatcaaggaggagctgaagttcgacgaggacctcatcatggggatcgacatgggcaagatcaacgtcctgtacttcgcgttcaacaagggcctggtgcgcggcgggatctccggcgaggagatcgaggcgttccgcaagaagatcgagcaccgccggatcagcctcctccgccaggggaagtactgctcgggcaaccgcatcgggaagggccgcaagaagcggatcaagcccatcgaggtgctgaacgacaagatcgccaagttccgcaacgcgaccaaccacaagtacgccaactacatcgtgcagcagtgcctcaagtacaactgcggcaccatccagctcgaggatctccagggcatctcgaaggagcagacgttcctcaagaactggacctacttcgacctccaggagaagatcaagaaccaggccaaccagtacggcatcaaggtcgtcaagatcgacccgtcctacaccagccagcgctgctccgagtgcgggtacatccacaagaacaaccgccagaaccagagcaccttcgagtgccagcagtgctcgttcaaggtgcacgcggactacaacgccgccaagaacatctcggtgtacaacatcgagaaggtgatccagaagcagctcaagctccaggagaagctcaacctcaccaagtacaaggagcagtacatcgagcagatggagaacatcaactga

SEQ ID NO: 2659 - DNA, 813 bp, Unknown
  Bacillus sp. multi
atgaaggtgatcctcgaccgcatcatcgactcgacgtacgcgaagggcgcgtgcatgctccacaagcacaagaagaagtggtacctctccatcacgtacaagagcaacatcaaggaggagctgaagttcgacgaagacctgatcatggggatcgacatgggcaagatcaacgtcctctacttcgccttcaacaagggcctggtgcgcggcgggatcagcggggaggagatcgaggcgttccgcaagaagatcgagcaccggcgcatctcgctgctgcgccaggggaagtactgctccgggaaccgcatcggcaagggccgcaagaagcgcatcaagcccatcgaggtgctgaacgacaagatcgccaagttccgcaacgcgaccaaccacaagtacgcgaactacatcgtgcagcagtgcctcaagtacaactgcggcaccatccagctcgaggacctccagggcatcagcaaggagcagacgttcctcaagaactggacgtacttcgacctccaggagaagatcaagaaccaggcgaaccagtacggcatcaaggtggtgaagatcgacccgtcctacacgagccagcgctgctccgagtgcggctacatccacaagaacaaccggcagaaccagagcacgttcgagtgccagcagtgctccttcaaggtgcacgccgactacaacgccgccaagaacatcagcgtgtacaacatcgagaaggtcatccagaagcagctcaagctccaggagaagctgaacctgaccaagtacaaggagcagtacatcgagcagatggagaacatcaactga

SEQ ID NO: 2660 - DNA, 1353 bp, Unknown
  Bacillus sp. multi
ctcagcatcgccgtgaaggtcatgaagtaccagatcgtgtgccccgtcaacatcgagtggaagaccttcgaaatctacctccggacgctctcgtaccacttccggaccatcggcaaccggacgatccagaagctctgggagtacgacaaccagagcctcaagcacttcaaggacacggggcagtacccctccgcgcagcagctctacggctgcatccagaagacgatctcgggctacatctacgaccagctcaaggaggagtaccaggacatcaacaaggccaacatgagcaccaccctccagaaaacaatccgcacgtggaactcgcgcaagaaggagatttggagcggcgagatgtccatcccgtccttccgcaacaacctgcccatcgacatccacggcaactcgatccagatcatcaaggagaagtccggcgactacatcgcgtcggtcagcctgttctccagcaagttcatcaaggagaacgacctgcccaacggcaagatcctggtgaagctgtccacgcggaagcagaactcgatgaaggtgatcctcgaccggatcatcgactccacctacgcgaagggcgcgtgcatgctccacaagcacaagaagaagtggtacctgagcatcacctacaagtccaacatcaaggaggagctgaagttcgacgaggacctcatcatgggcatcgacatgggcaagatcaacgtgctctacttcgccttcaacaagggcctcgtgcgcggggccatctccggggaggagatcgaggcgttccgcaagaagattgagcaccggcggatcagcctcctccgccaggggaagtattgctcggggaaccgcatcggcaagggccgggagaagcgcatcaagcccatcgacgtcctgaacgacaaggtggccaagttccgcaacgcgaccaaccacaagtacgccaactacatcgtgcagcagtgcctcaagtacaactgcgggacgatccaactggaggacttgaaggggatcagcaaggagcagaccttcctcaagaactggacgtacttcgacctccaggagaagatcaagaaccaggccaaccagtacggcgtgaaggtggtgaagatcgacccgagctacacgagccagcggtgcagcgagtgcggctacatccacaagaacaaccgccaggaccagtccaccttcgagtgccagcagtgctccttcaaggtgcacgccgactacaacgcggccaagaacatcagcgtgtacaacatcgagaaggtgatccagaagcagctggagttgcaggagaagctgaaccagaccaagtacaaggagcagtacatcgagcagatgaagaacatcaactga

SEQ ID NO: 2661 - DNA, 1353 bp, Unknown
  Bacillus sp. multi
ctctccatcgccgtgaaggtgatgaagtaccagatcgtgtgcccggtcaacatcgagtggaagacgttcgagatctacctgcggacgctcagctaccacttccgcaccatcggcaaccggacgatccagaagctgtgggagtacgacaaccagtccctcaagcacttcaaggacacgggccagtacccctccgcccagcagctctacggctgcatccagaagacgatcagcggctacatctacgaccagctcaaggaggagtaccaggacatcaacaaggccaacatgagcaccaccctccagaagaccatccggacgtggaactcccgcaagaaggagatctggagcggggagatgagcatcccctcgttccgcaacaacctccccatcgacatccacgggaactcgatccagatcatcaaggagaagtccggcgactacatcgcctcggtgagcctgttctcctccaagttcatcaaggagaacgacctgccgaacgggaagatcctggtcaagctcagcacgcgcaagcagaacagcatgaaggtgatcctggaccgcatcatcgactccacgtacgcgaagggcgcgtgcatgctacacaagcacaagaagaagtggtatcttagcatcacctacaagtcgaacatcaaggaggagttgaagttcgacgaggacctcatcatgggcatcgacatgggcaagatcaacgtgctgtacttcgcgttcaacaagggcctggtgcggggcgcgatctccggcgaggagatcgaggcgttccgcaagaagatagagcaccggcgcatcagcctcctccgccagggcaagtactgctcggggaaccggatcggcaaggggcgggagaagcgcatcaagcccatcgacgtgctcaacgacaaggtggccaagttccgcaacgcgaccaaccacaagtacgcgaactacatcgtgcagcagtgcctcaagtacaactgcgggacgatccagctcgaagacctcaaggggatcagcaaggagcagaccttcctcaagaactggacctacttcgacctccaggagaagatcaagaaccaggccaaccagtacggggtgaaggtggtcaagatcgacccctcctacacctcccagcggtgcagcgagtgcgggtacatccacaagaacaaccgccaggaccagagcaccttcgagtgccagcagtgctcgttcaaggtccacgccgactacaacgccgccaagaacatctccgtgtacaacatcgagaaggtgatccagaagcaactggagttacaggagaagctcaaccagaccaagtacaaggagcagtacatcgagcagatgaagaacatcaactag

SEQ ID NO: 2662 - DNA, 1353 bp, Unknown
  Bacillus sp. multi
ctcagcatcgcggtgaaggtcatgaagtaccagatcgtctgccccgtcaacatcgagtggaagaccttcgagatctacctccgcaccctcagctaccacttccggaccatcgggaaccgcaccatccagaagctctgggagtacgacaaccagtccctcaagcacttcaaggacaccgggcagtacccctcggcgcagcagctctacgggtgcatccagaagaccatcagcgggtacatctacgaccagctcaaggaggagtaccaggacatcaacaaggcgaacatgagcaccaccctccagaagaccatccgcacctggaactcccgcaagaaggagatatggagcggggagatgtccatcccgtccttccgcaacaacctccccatcgacatccacgggaacagcatccagatcatcaaggagaagtccggcgactacatcgcctccgtgagcctgttctcctccaagttcatcaaggagaacgacctgccgaacggcaagatcctggtgaagctcagcacgcggaagcagaactcgatgaaggtgatcctggaccgcatcatcgactccacctacgcgaagggcgcgtgcatgctgcacaagcacaagaagaagtggtatctgagcatcacctacaagtccaacatcaaggaggagctaaagttcgacgaggacttgatcatgggcatcgacatgggcaagatcaacgtgctctacttcgccttcaacaagggcctggtccggggcgcgatctccggggaggagatcgaggcgttccgcaagaaaatcgagcaccgccgcatctccctgctgcgccagggcaagtactgctccggcaaccggatcggcaaggggcgggagaagcggatcaagcccatcgacgtgctgaacgacaaggtggccaagttccgcaacgccacgaaccacaagtacgccaactacatcgtccagcagtgcctcaagtacaactgcgggaccatccaacttgaggacctcaaggggatcagcaaggagcagacgttcctcaagaactggacctacttcgacctccaggagaagatcaagaaccaggccaaccagtacggggtgaaggtggtgaagatcgacccgagctacacgagccagcggtgcagcgagtgcgggtacatccacaagaacaaccgccaggaccagtccaccttcgagtgccagcagtgctccttcaaggtgcacgccgactacaacgcggccaagaacatctccgtgtacaacatcgagaaggtcatccagaagcagctcgagttacaggagaagctgaaccagaccaagtacaaggagcagtacatcgagcagatgaagaacatcaactga

SEQ ID NO: 2663 - DNA, 1353 bp, Unknown
  Bacillus sp. multi
ctcagcatcgcggtgaaggtgatgaagtaccagatcgtctgcccggtcaacatcgagtggaagaccttcgagatatacctccggaccctcagctaccacttccgcaccatcggcaaccgcaccatccagaagctctgggagtacgacaaccagagcctcaagcacttcaaggacacgggccagtacccctccgcccagcagctctacggctgcatccagaagactatcagcggctacatctacgaccagctcaaggaggagtaccaggacatcaacaaggcgaacatgagcaccaccctccagaaaacgatccgcacctggaactcccgcaagaaggagatctggagcggcgagatgtccatcccgtccttccgcaacaacctgcccatcgacatccacgggaacagcatccagatcatcaaggagaagtccggcgactacatcgcgtcggtgagcctgttctcctccaagttcatcaaggagaacgacctccccaacgggaagatcctggtcaagctctcgacccgcaagcagaacagcatgaaggtgatcctggaccgcatcatcgactccacctacgcgaagggcgcgtgcatgttgcacaagcacaagaagaagtggtacctgtccatcacctacaagtccaacatcaaggaggagctcaagttcgacgaggacctcattatgggcatcgacatgggcaagatcaacgtgctgtacttcgccttcaacaaggggctggtccggggcgcgatctccggggaggagatcgaggcgttccgcaagaagatcgagcaccgccggatcagcctgctccgccaggggaagtactgctcgggcaaccggatcgggaagggccgggagaagcggatcaagcccatcgacgtcctgaacgacaaggtggccaagttccgcaacgcgacgaaccacaagtacgccaactacatcgtccagcagtgcctcaagtacaactgcggcaccatccagctcgaagacctgaaggggatcagcaaggagcagacgttcctcaagaactggacctacttcgacctccaggagaagatcaagaaccaggccaaccagtacggcgtgaaggtggtgaagatcgacccgagctacacctcccagcggtgctcggagtgcggctacatccacaagaacaaccgccaggaccagagcaccttcgagtgccagcagtgctccttcaaggtgcacgccgactacaacgccgccaagaacatcagcgtgtacaacatcgagaaggtgatccagaagcagctagagttgcaggagaagctgaaccagaccaagtacaaggagcagtacatcgagcagatgaagaatatcaactag

SEQ ID NO: 2664 - DNA, 1353 bp, Unknown
  Bacillus sp. multi
ctgagcatcgcggtgaaggtcatgaagtaccagatcgtgtgccccgtgaacatcgagtggaagaccttcgagatctacctgcggaccctctcctaccacttccgcaccatcggcaaccgcaccatccagaagctctgggagtacgacaaccagtccctcaagcacttcaaggacacgggccagtacccgagcgcgcagcagctctacggctgcatccagaaaacgatctccggctacatctacgaccagctcaaggaggagtaccaggacatcaacaaggcgaacatgagcacgaccctccagaagacgatccggacctggaactcccgcaagaaggagatttggagcggcgagatgtccatcccctcgttccgcaacaacctccccatcgacatccacggcaactcgatccagatcatcaaggagaagtccggggactacatcgcgtccgtgtccctgttctcctccaagttcatcaaggagaacgacctccccaacgggaagatcctggtgaagctgagcacccgcaagcagaactcgatgaaggtcatcctggaccgcatcatcgactccacgtacgcgaagggcgcgtgcatgctccacaagcacaagaagaagtggtacctgagcatcacctacaagtccaacatcaaggaggagttgaagttcgacgaggatctgatcatgggcatcgacatgggcaagatcaacgtcctctacttcgcgttcaacaaggggctcgtgcggggcgcgatctccggcgaggagatcgaggcgttccgcaagaagatcgagcaccgccggatcagcctcctgcgccagggcaagtattgctcggggaaccggatcgggaaggggcgcgagaagcggatcaagcccatcgacgtgctgaacgacaaggtggcgaagttccgcaacgcgacgaaccacaagtacgccaactacatcgtgcagcagtgcctcaagtacaactgcggcacgatccagcttgaggatctcaaggggatcagcaaggagcagaccttcctcaagaactggacctacttcgacctccaggagaagattaagaaccaggccaaccagtacggcgtgaaggtggtcaagatcgaccccagctacacctcccagcggtgcagcgagtgcggctacatccacaagaacaaccgccaggaccagagcacgttcgagtgccagcagtgctcgttcaaggtgcacgccgactacaacgccgccaagaacatctcggtgtacaacatcgagaaggtcatccagaagcagcttgagctgcaggagaagctgaaccagaccaagtacaaggagcagtacatcgagcagatgaagaacatcaactga

SEQ ID NO: 2665 - DNA, 303 bp, Unknown
  Bacillus sp. multi
ctccaggagaagatcaaaaaccaggcgaatcagtatggagtgaaagttgtgaagatcgacccatcctatacctcccagagatgttctgagtgcggcttcattcataagaacaaccgacaagaccaatctactttcgagtgccagcagtgcagcttcaaggttcacgctgactacaacgcggccaagaacatcagcgtgtacaacattgaaaaggtcatccagaagcagcttgaattacaggagaaactcaatcagacaaagtacaaggagcagtacatcgagcagatgaagaacatcaactag

SEQ ID NO: 2666 - DNA, 303 bp, Unknown
  Bacillus sp. multi
ctccaggaaaaaatcaagaatcaggcaaaccagtacggcgtgaaggtcgttaagatagacccctcctatacgtcccagcggtgcagcgagtgtgggttcattcacaagaataaccgccaggaccagagcacctttgagtgccaacagtgttcgttcaaagtccatgccgactacaatgctgccaagaacatctcagtttacaatatcgaaaaggtgattcagaagcagcttgaactccaggagaagctcaatcagacgaagtacaaggagcagtacatcgagcagatgaagaacattaactga

SEQ ID NO: 2667 - DNA, 303 bp, Unknown
  Bacillus sp. multi
ctacaggagaagatcaaaaaccaggccaatcagtatggcgtgaaggtggtcaagatcgacccttcatacacctctcaacgatgctcggagtgcgggttcattcacaagaacaacaggcaagaccaatccaccttcgagtgccagcagtgttcgttcaaggtgcacgcggactacaatgctgccaagaatatctccgtttacaacatcgaaaaggtcatccagaagcaactagagctacaggagaaactgaatcagacgaagtacaaggaacagtatatcgagcagatgaagaacattaactga

SEQ ID NO: 2668 - DNA, 303 bp, Unknown
  Bacillus sp. multi
ctccaggagaagatcaaaaaccaggcgaaccagtatggtgtgaaagtcgtcaaaatcgacccatcatatacctcgcaacggtgctcggaatgtggcttcattcacaagaataaccgacaagaccagtcaaccttcgagtgccaacagtgcagctttaaagtccacgctgattacaatgcagccaagaatatctcggtttacaatatcgaaaaggttatccagaagcaacttgaactacaggagaagctgaatcagacgaagtacaaagagcagtatatcgaacagatgaagaacatcaactga

SEQ ID NO: 2669 - DNA, 303 bp, Unknown
  Bacillus sp. multi
ttacaggagaagatcaaaaaccaggccaaccagtacggggttaaggtggtgaagatagacccgagctacacatctcaacgatgcagtgagtgcggcttcatccataagaacaatcgccaagaccaaagcacgttcgaatgtcagcagtgctctttcaaagtacatgcggactacaatgcggccaagaatatctctgtgtacaacatcgaaaaggttatccaaaagcaacttgaactacaggagaagctcaatcagacgaagtacaaggagcagtatatcgaacagatgaagaatatcaactga

SEQ ID NO: 2670 - DNA, 1332 bp, Unknown
  Bacillus sp. multi
atgaagtaccagatcgtgtgcccggtcaacgtcgagtggaaggtgttcgagacgtacctccgcaccctgagctaccagtcccggaccatcgggaaccgcaccatccagaaaatctgggagttcgacaacctctccctcaagcacttcaaggagacgggcgagtacccgtcggcgcagcagctctacgggtgcacgcagaaaaccatcagcgggtacatctacgaccagctcaaggaggagtacaaggacatcaacaaggcgaacatgagcacgaccatccagaagaccctcaagaactggaactcccgcaagaaggagatctggcgcggggagatgtccatccccagcttccgcagcgacctgcccatcgacatccacggcaactccatccagctcatcaaggagaagggcggcgactacatcgcgtcggtgtccctgttctccagcaagttcatcaaggagaacgacctcccgaacgggaagatcctggtgaagctgagcacgcggaagcagaacagcatgaaggtgatcctggaccggctcatcaactcgacgtactcgaagggcgcgtgcatgctgcacaagcacaagaagaagtggtacttgtcgatcacctacaagagcaacatcaaggaggagctaaagttcgacgaggatctcatcatgggcatcgacatggggaagatcaacgtcctctacttcgcgttcaacaagtcgctcgtgcggggcgcgatcagcggggaggagatcgaggcgttccgcaagaagatagagcaccggcggatcagcctgctccgccagggcaaatactgctccgggaaccggatcggcaaggggcgggagaagcggatcaagcccatcgacgtcctcaacgacaaggtggcgaagttccgcaacgccaccaaccacaagtacgccaactacatcgtccagcagtgcctcaagtacaactgcggcaccatccagctcgaggacctcaaggggatcagcaaggagcagaccttcctcaagaactggacctacttcgacctccaggagaagattaagaaccaggcgaaccagtacggggtcaaggtggtcaagatcgacccctcctacacctcccagcggtgcagcgagtgcggctacatccacaaggacaaccgccaggaccagtccaccttcgagtgcctccagtgctcgttcaaggtccacgccgactacaacgccgccaagaacatctccgtgtacaacatcgagaaggtgatccagaagcaacttgagctacaggagaagctgaacctcacgaagtacaaggagcactacatcgagcagatgaagaacatcaactag

SEQ ID NO: 2671 - DNA, 1332 bp, Unknown
  Bacillus sp. multi
atgaagtaccagatcgtgtgcccggtcaacgtcgagtggaaggtcttcgagacctacctccggacgctgagctaccagagccgcaccatcggcaaccgcacgatccagaaaatctgggagttcgacaacctctcgctcaagcacttcaaggagacgggcgagtacccgtccgcccagcagctctacggctgcacccagaagacgatctcggggtacatctacgaccagctcaaggaggagtacaaggacatcaacaaggcgaacatgagcaccaccatccagaaaaccctcaagaactggaactcccgcaagaaggaaatctggcgcggcgagatgtccatcccctccttccggtcggacctgcccatcgacatccacggcaactccatccagctcatcaaggagaagggcggggactacatcgcctccgtcagcctgttctcctccaagttcatcaaggagaacgacctccccaacgggaagatcctggtcaagctcagcacccggaagcagaacagcatgaaggtcatcctcgaccgcctcatcaactcgacctacagcaagggcgcgtgcatgctccacaagcacaagaagaagtggtacctgtccatcacctacaagtccaacatcaaggaggaactcaagttcgacgaggaccttatcatgggcatcgacatgggcaagatcaacgtcctgtacttcgcgttcaacaagagcctggtgcgcggcgcgatcagcggcgaggagatcgaggcgttccgcaagaagatcgagcaccgccgcatcagcctcctgcgccagggcaagtactgctcgggcaaccggatcgggaagggccgcgagaagcgcatcaagcccatcgacgtcctgaacgacaaggtggcgaagttccgcaacgcgaccaaccacaagtacgcgaactacatcgtccagcagtgcctcaagtacaactgcggcacgatccagcttgaagaccttaaggggatcagcaaggagcagaccttcctcaagaactggacgtacttcgacctccaggagaagattaagaaccaggcgaaccagtacggcgtcaaggtggtcaagatcgacccgtcctacaccagccagcggtgcagcgagtgcggctacatccacaaggacaaccgccaggaccagagcacgttcgagtgcctccagtgctcgttcaaggtgcacgcggactacaacgccgccaagaacatcagcgtgtacaacatcgagaaggtcatccagaagcagctagagctgcaagagaagctgaacctcaccaagtacaaggagcactacatcgagcagatgaagaacatcaactga

SEQ ID NO: 2672 - DNA, 1332 bp, Unknown
  Bacillus sp. multi
atgaagtaccagatcgtgtgccccgtgaacgtcgagtggaaggtcttcgagacctacctccggaccctcagctaccagtcccgcaccatcgggaaccgcaccatccagaaaatctgggagttcgacaacctgtcgctcaagcacttcaaggagaccggggagtacccgtccgcccagcagctctacgggtgcacgcagaagaccatcagcggctacatctacgaccagctcaaggaggagtacaaggacatcaacaaggccaacatgagcaccaccatccagaaaacgctcaagaactggaacagccgcaagaaggagatttggcggggcgagatgtccatccccagcttccggagcgacctgcccatcgacatccacggcaactccatccagctcatcaaggagaagggcggggactacatcgccagcgtgtccctgttcagcagcaagttcatcaaggagaacgacctgcccaacgggaagatcctggtcaagctgtccacccgcaagcagaactccatgaaggtcatcctcgaccgcctcatcaactccacctactcgaagggcgcgtgcatgctgcacaagcacaagaagaagtggtatctctccatcacctacaagagcaacatcaaggaggagctgaagttcgacgaggacctgatcatgggcatcgacatgggcaagatcaacgtcctgtacttcgccttcaacaagtccctcgtgcgcggcgcgatcagcggggaggagatcgaggcgttccgcaagaagattgagcaccgccgcatctccctcctgcgccagggcaagtactgctcgggcaaccggatcgggaagggccgcgagaagcggatcaagcccatcgacgtcctgaacgacaaggtggccaagttccgcaacgcgaccaaccacaagtacgccaactacatcgtgcagcagtgcctcaagtacaactgcgggacgatacaacttgaggacctgaaggggatcagcaaggagcagaccttcctcaagaactggacctacttcgacctccaggagaagatcaagaaccaggcgaaccagtacggcgtgaaggtggtgaagatcgacccgagctacaccagccagcggtgctccgagtgcgggtacatccacaaggacaaccgccaggaccagagcaccttcgagtgcctccagtgctcgttcaaggtgcacgcggactacaacgccgccaagaacatcagcgtgtacaacatcgagaaggtcatccagaagcagttagagctacaggagaagctgaacctgacgaagtacaaggagcactacatcgagcagatgaagaacatcaactga

SEQ ID NO: 2673 - DNA, 1332 bp, Unknown
  Bacillus sp. multi
atgaagtaccagatcgtctgcccggtcaacgtggagtggaaggtgttcgagacctacctccgcacgctgagctaccagtcccggaccatcggcaaccggaccatccagaagatctgggagttcgacaacctgtccctcaagcacttcaaggagaccggggagtacccctcggcccagcagctctacgggtgcacgcagaagaccatcagcgggtacatctacgaccagctcaaggaggagtacaaggacatcaacaaggccaacatgagcacgacgatccagaaaaccctcaagaactggaactcccgcaagaaggaaatctggcgcggcgagatgtccatcccgtccttccggagcgacctgcccatcgacatccacgggaactccatccagctcatcaaggagaagggcggcgactacatcgcgtccgtgtcgctgttctcctccaagttcatcaaggagaacgacctccccaacggcaagatcctggtcaagctgagcacccggaagcagaactcgatgaaggtgatcctggaccgcctcatcaactcgacctacagcaagggcgcgtgcatgctgcacaagcacaagaagaaatggtacttatccatcacctacaagtcgaacatcaaggaggagctcaagttcgacgaagaccttatcatggggatcgacatgggcaagatcaacgtgctgtacttcgcgttcaacaagtcgctggtgcgcggggccatcagcggcgaggagatcgaggcgttccgcaagaagatcgagcaccggcgcatctcgctcctccgccagggcaaatactgctccggcaaccgcatcggcaagggccgcgagaagcggatcaagcccatcgacgtgctcaacgacaaggtggccaagttccgcaacgcgacgaaccacaagtacgccaactacatcgtccagcagtgcctcaagtacaactgcggcacgatccagctagaggacctcaaggggatcagcaaggagcagaccttcctcaagaactggacctacttcgacctccaggagaagatcaagaaccaggcgaaccagtacggcgtcaaggtggtcaagatcgacccgtcctacaccagccagcgctgctccgagtgcgggtacatccacaaggacaaccgccaggaccagtccacgttcgagtgcctccagtgcagcttcaaggtccacgcggactacaacgcggccaagaacatcagcgtgtacaacatcgagaaggtgatccagaagcagctcgaactccaggaaaagctgaacctgacgaagtacaaggagcactacatcgagcagatgaagaacatcaactga

SEQ ID NO: 2674 - DNA, 1332 bp, Unknown
  Bacillus sp. multi
atgaagtaccagatcgtctgcccggtgaacgtggagtggaaggtcttcgagacctacctccgcaccctgtcctaccagagccgcaccatcggcaaccgcaccatccagaaaatctgggagttcgacaacctctcgctcaagcacttcaaggagacgggcgagtacccctcggcccagcagctctacggctgcacccaaaagaccatcagcggctacatctacgaccagctcaaggaggagtacaaggacatcaacaaggccaacatgagcaccacgatccagaagacgctcaagaactggaactcccgcaagaaggagatctggcgcggcgagatgtccatcccctcgttccggtccgacctgcccatcgacatccacggcaactcgatccagctcatcaaggagaagggcggcgactacatcgcctccgtgtccctgttcagcagcaagttcatcaaggagaacgacctgccgaacgggaagatcctggtgaagctctcgacccggaagcagaactccatgaaggtcatcctggaccgcctcatcaacagcacgtacagcaagggcgcgtgcatgctccacaagcacaagaagaagtggtacctgtcgatcacctacaagtccaacatcaaggaggaactcaagttcgacgaagacctcatcatggggatcgacatggggaagatcaacgtcctgtacttcgccttcaacaagtccctcgtgcgcggggccatcagcggcgaggagatcgaggcgttccgcaagaaaatcgagcaccggcggatctccctcctccgccaggggaagtattgttccggcaaccgcatcggcaagggccgcgagaagcgcatcaagcccatcgacgtcctgaacgacaaggtggccaagttccgcaacgccaccaaccacaagtacgccaactacatcgtccagcagtgcctcaagtacaactgcggcaccatccagttggaggacttgaaggggatcagcaaggagcagacgttcctcaagaactggacctacttcgacctccaggagaagatcaagaaccaggcgaaccagtacggcgtcaaggtcgtgaagatcgaccccagctacacctcgcagcggtgctcggagtgcggctacatccacaaggacaaccgccaggaccagagcaccttcgagtgcctccagtgctcgttcaaggtgcacgccgactacaacgcggccaagaacatcagcgtgtacaacatcgagaaggtgatccagaagcagctcgaacttcaggagaagctgaacctgacgaagtacaaggagcactacatcgagcagatgaagaacatcaactga

SEQ ID NO: 2675 - DNA, 1353 bp, Unknown
  Bacillus sp. multi
ctgagcatcgccgtcaaggtgatgaagtaccagatcgtgtgcccggtgaacatcgagtggaagaccttcgagatttacctgcggaccctcagctaccacttccggaccatcggcaaccgcaccatccagaagctgtgggagtacgacaaccagagcctcaagcacttcaaggacaccggccagtacccgtccgcgcagcagctctacggctgcacccagaaaacgatctccgggtacatctacgaccagctcaaggaggagtaccaggacatcaacaaggcgaacatgagcacgaccctccagaagacgatccgcacctggaactcgcgcaagaaggagatctggagcggcgagatgagcatccccagcttccgcaacaacctccccatcgacatccacgggaactcgatccagatcatcaaggagaagtccggggactacatcgccagcgtcagcctgttcagcagcaagttcatcaaggagaacgacctgcccaacggcaagatcctcgtcaagctgagcacgcgcaagcagaactccatgaaggtcatcctcgaccgcatcatcgactccacgtacgcgaagggcgcgtgcatgctccacaagcacaagaagaagtggtatttgtccatcacctacaagagcaacatcaaggaggagcttaagttctaccaggacctgatcatggggatcgacatggggaagatcaacgtgctctacttcgccttcaacaaggggctggtgcgcggggcgatctccggcgaggagatcgaggcgttccgcaagaaaatcgagcaccgccgcatcagcctgctccgccagggcaagtactgctcggggaaccggatcggcaagggccgcgagaagcgcatcaagcccatcgacgtcctgaacgacaaggtggccaagttccgcaacgcgacgaaccacaagtacgccaactacatcgtccagcagtgcctcaagtaccactgctccaccatccaactggaagacctcaaggggatcagcaaggagcagaccctcctcaagaactggacctacttcgacctccaggagaagatcaagaaccaggccaaccagtacggcgtgaaggtggtgaagatcgacccctcctacacctcccagcggtgctccgagtgcgggtacatccacaagaacaaccgccaggaccagtccaccttcgagtgccagcagtgctccttcaaggtgcacgccgactacaacgccgccaagaacatctcggtgtacaacatcgagaaggtgatccagaagcagctcgaactccaggagaagctgaaccagaccaagtacaaggagcagtacatcgagcagatgaagaatatcaactga

SEQ ID NO: 2676 - DNA, 1353 bp, Unknown
  Bacillus sp. multi
ctcagcatcgcggtgaaggtgatgaagtaccagatcgtgtgccccgtcaacatcgagtggaagaccttcgagatctacctgcggaccctgagctaccacttccggaccatcggcaaccgcacgatccagaagctctgggagtacgacaaccagtcgctcaagcacttcaaggacaccggccagtaccccagcgcgcagcagctctacggctgcacgcagaaaaccatctcgggctacatctacgaccagctcaaggaggagtaccaggacatcaacaaggcgaacatgagcaccaccctccaaaagacgatccggacgtggaactcccgcaagaaggagatctggagcggggagatgtccatcccgtccttccggaacaacctccccatcgacatccacgggaactcgatccagatcatcaaggagaagtccggcgactacatcgcctcggtgtccctgttctcgtcgaagttcatcaaggagaacgacctccccaacgggaagatcctcgtgaagctcagcacccgcaagcagaacagcatgaaggtgatcctggaccgcatcatcgactccacctacgcgaagggcgcgtgcatgttgcacaagcacaagaagaagtggtatctgagcatcacgtacaagtcgaacatcaaggaggagctgaagttctaccaggatctcatcatgggcatcgacatgggcaagatcaacgtgctctacttcgcgttcaacaaggggctggtgcgcggcgcgatctcgggcgaggagatcgaggcgttccgcaagaagatcgagcaccggcgcatctcgctgctccgccagggcaaatactgctcgggcaaccgcatcggcaagggccgggagaagcggatcaagcccatcgacgtgctcaacgacaaggtggccaagttccgcaacgccacgaaccacaagtacgcgaactacatcgtccagcagtgcctcaagtaccactgctccacgatccagctcgaggatctcaaagggatcagcaaggagcagaccctcctcaagaactggacgtacttcgacctccaggagaagatcaagaaccaggccaaccagtacggcgtgaaggtcgtcaagatcgacccgagctacaccagccagcgctgctccgagtgcggctacatccacaagaacaaccgccaggaccagagcacgttcgagtgccagcagtgctccttcaaggtccacgcggactacaacgcggccaagaacatctcggtgtacaacatcgagaaggtgatccagaagcagctagagctccaggagaagctgaaccagaccaagtacaaggagcagtacatcgagcagatgaagaatatcaactag

SEQ ID NO: 2677 - DNA, 1353 bp, Unknown
  Bacillus sp. multi
ctctccatcgcggtcaaggtgatgaagtaccagatcgtgtgcccggtcaacatcgagtggaagaccttcgagatctacctccggaccctcagctaccacttccgcaccatcgggaaccgcacgatccagaagctctgggagtacgacaaccagagcctcaagcacttcaaggacaccggccagtacccctcggcccagcagctctacggctgcacccagaaaacgatctccggctacatctacgaccagctcaaggaggagtaccaggacatcaacaaggcgaacatgagcaccaccctccagaaaaccatccggacgtggaactcccgcaagaaggaaatctggagcggcgagatgagcatccccagcttccgcaacaacctgcccatcgacatccacggcaacagcatccagatcatcaaggagaagtccggcgactacatcgccagcgtgagcctgttcagcagcaagttcatcaaggagaacgacctccccaacggcaagatcctcgtcaagctgagcacgcggaagcagaactccatgaaggtgatcctggaccggatcatcgactcgacctacgcgaagggcgcgtgcatgctccacaagcacaagaagaagtggtacttgtccatcacctacaagagcaacatcaaggaggaactcaagttctaccaggatctgatcatggggatcgacatggggaagatcaacgtgctgtacttcgccttcaacaaggggctcgtgcgcggggccatctccggcgaggagatcgaggcgttccgcaagaagattgagcaccggcggatcagcctcctccgccaggggaaatactgctccggcaaccgcatcgggaagggccgcgagaagcgcatcaagcccatcgacgtcctcaacgacaaggtggcgaagttccgcaacgcgaccaaccacaagtacgcgaactacatcgtgcagcagtgcctcaagtaccactgctccaccatccaactcgaggatctcaaggggatcagcaaggagcagacgctgctcaagaactggacgtacttcgacctccaggagaagatcaagaaccaggcgaaccagtacggggtcaaggtggtgaagatcgacccctcctacacctcgcagcggtgctccgagtgcggctacatccacaagaacaaccgccaggaccagtccacgttcgagtgccagcagtgctccttcaaggtccacgccgactacaacgcggccaagaacatcagcgtgtacaacatcgagaaggtcatccagaagcagctggagctgcaggagaagctgaaccagaccaagtacaaggagcagtacatcgagcagatgaagaacatcaactga

SEQ ID NO: 2678 - DNA, 1353 bp, Unknown
  Bacillus sp. multi
ctgtccatcgccgtgaaggtgatgaagtaccagatcgtgtgccccgtcaacatcgagtggaagaccttcgagatctacctgcggacgctcagctaccacttccggaccatcgggaaccgcaccatccagaagctgtgggagtacgacaaccagagcctcaagcacttcaaggacaccggccagtacccgagcgcccagcagctctacggctgcacccagaaaaccatctcggggtacatctacgaccagctcaaggaggagtaccaggacatcaacaaggccaacatgagcacgaccctccagaaaaccatccggacctggaacagccgcaagaaggagatctggagcggcgagatgtccatcccgagcttccgcaacaacctgcccatcgacatccacggcaacagcatccagatcatcaaggagaagtccggcgactacatcgccagcgtgtccctgttcagctcgaagttcatcaaggagaacgacctcccgaacggcaagatcctcgtcaagctgtccacccggaagcagaacagcatgaaggtgatcctggaccgcatcatcgactccacctacgcgaagggcgcgtgcatgctccacaagcacaagaagaagtggtacctctccatcacctacaagagcaacatcaaggaggagttgaagttctaccaggacctcattatgggcatcgacatgggcaagatcaacgtcctgtacttcgccttcaacaagggcctggtgcgcggcgcgatctcgggcgaggagatcgaggcgttccgcaagaagatagagcaccggcgcatctccctgctgcgccagggcaagtattgctcgggcaaccgcatcggcaagggccgcgagaagcgcatcaagcccatcgacgtgctgaacgacaaggtggccaagttccgcaacgccaccaaccacaagtacgccaactacatcgtccagcagtgcctcaagtaccactgctccaccatccagctcgaagacttgaaggggatcagcaaggagcagacgctgctcaagaactggacctacttcgacctccaggagaagatcaagaaccaggcgaaccagtacggggtgaaggtcgtgaagatcgacccgtcctacacctcccagcggtgcagcgagtgcggctacatccacaagaacaaccgccaggaccagtccacgttcgagtgccagcagtgcagcttcaaggtccacgccgactacaacgcggccaagaacatctccgtgtacaacatcgagaaggtgatccagaagcagcttgaactccaggagaagctgaaccagaccaagtacaaggagcagtacatcgagcagatgaagaacatcaactga

SEQ ID NO: 2679 - DNA, 1353 bp, Unknown
  Bacillus sp. multi
ctcagcatcgcggtcaaggtgatgaagtaccagatcgtgtgccccgtcaacatcgagtggaagaccttcgagatttacctccggacgctcagctaccacttccgcaccatcggcaaccggacgatccagaagctctgggagtacgacaaccagagcctcaagcacttcaaggacaccggccagtacccctccgcccagcagctctacggctgcacccagaaaaccatcagcggctacatctacgaccagctcaaggaggagtaccaggacatcaacaaggccaacatgagcaccaccctccagaagacgatccggacctggaactcccgcaagaaggagatatggagcggggagatgagcatcccgtccttccgcaacaacctgcccatcgacatccacggcaactcgatccagatcatcaaggagaagtcgggcgactacatcgcgtccgtgtcgctgttctcctcgaagttcatcaaggagaacgacctccccaacggcaagatcctcgtgaagctgtccacccggaagcagaactcgatgaaggtgatcctggaccggatcatcgactccacgtacgcgaagggcgcgtgcatgctgcacaagcacaagaagaagtggtacctgtccatcacctacaagagcaacatcaaggaggagcttaagttctaccaagacctgattatggggatcgacatggggaagatcaacgtcctgtacttcgccttcaacaaggggctggtgcgcggggcgatcagcggcgaggagatcgaggcgttccgcaagaaaatcgagcaccgccggatctccctgctccgccaggggaagtactgctcgggcaaccgcatcggcaagggccgcgagaagcgcatcaagcccatcgacgtgctcaacgacaaggtggccaagttccgcaacgccacgaaccacaagtacgcgaactacatcgtgcagcagtgcctcaagtaccactgctccaccatccagttggaagacctcaaggggatcagcaaggagcagacgctgctcaagaactggacctacttcgacctccaggagaagatcaagaaccaggcgaaccagtacggcgtgaaggtggtgaagatcgaccccagctacacctcccagcggtgctcggagtgcgggtacatccacaagaacaaccgccaggaccagtccaccttcgagtgccagcagtgctcgttcaaggtgcacgccgactacaacgccgccaagaacatcagcgtgtacaacatcgagaaggtgatccagaagcaactcgagctgcaggagaagctgaaccagaccaagtacaaggagcagtacatcgagcagatgaagaacatcaactga

SEQ ID NO: 2680 - DNA, 594 bp, Unknown
  Paenibacillus thiaminolyticus (multi)
atgggcaagcgccgctggactgccagccgtcagttccgacaactcttggccaacgagacgatgttcggttccgaattactcaacttcgagtatgtccttatcgacgtggcgcgctattcggaggaggaactgctcgcccttagcaacaccattgggtccgttttcctgctcgatcagaccgccgaccaggctgagttactggaccgcttggggaagctgatgcacacgatccaacagctcccagaggacagccagcaacagctcgtcgcgtggatggcgaacatcttgagccagaagttacccgagaacgagcctcaacttcgtgaattgatccagaacgtgaaaggcggtgtgtcagtcatggggctggagaaaacactcgacgctatcaagcgtgagggccgccgcgaggggcggcgtgaggggctgcgtcagggactacaggagggcatccgtgagggaaaacaggagggcaaacgcgaggccaagaaggaggtggtgaagcaaatgatcgcggaggacttagacccggaactcatcgcgcgagtgaccggcttcagtctggagatgattacccagttgcgcgaacagtga

SEQ ID NO: 2681 - DNA, 594 bp, Unknown
  Paenibacillus thiaminolyticus (multi)
atgggcaaacgccggtggaccgcctctcgtcagtttcgccagcttttagcgaacgagaccatgttcggctccgagttgcttaactttgagtatgtccttattgatgtggcgcgctacagcgaggaggaacttctcgccctttccaacactatcgggtcggtctttctgttggaccaaaccgccgaccaggcggagttgctagaccggctggggaagctcatgcacaccatccaacaactgcccgaagacagtcagcagcaattggtggcgtggatggccaacatcctctcacagaagctgccggagaacgagccccagttgagggagctgatccagaatgtgaaaggcggtgtgtcagtgatggggctggagaagaccctcgacgctatcaagcgcgaggggcgtcgggaggggcgtcgggagggtctgagacaagggctccaggagggcatccgtgaaggaaaacaggagggcaagcgtgaggccaagaaggaagttgtcaagcagatgatcgccgaggatctcgaccccgagctgatcgccagggtcacggggttctcccttgaaatgataacgcaactgcgggaacagtga

SEQ ID NO: 2682 - DNA, 594 bp, Unknown
  Paenibacillus thiaminolyticus (multi)
atgggcaaacgacggtggacggcttccaggcagttccgccaactcctcgctaacgagaccatgttcggcagcgagctactgaacttcgagtacgtccttatcgacgttgcgcgttactcggaggaggagctgctcgcgctgtccaataccatcgggtccgtcttcctgctggaccagactgccgaccaagccgagctgctcgaccgtcttggcaaactgatgcacaccatccaacagctcccggaggacagccagcaacagttggtggcttggatggcgaacatcctcagccagaaactgccggaaaacgagccccaactgcgggaactcattcagaatgtaaaaggaggagtgagcgtgatgggcctggagaagaccctggacgcgattaagcgcgagggacggcgcgagggacggagggagggactccggcaagggctacaagagggcatccgtgagggcaaacaggaaggcaaacgcgaggccaaaaaggaagtggtcaagcaaatgatcgctgaggacttggaccctgaactcattgccagagtcaccggcttctcgctagagatgataacacagttacgggaacagtga

SEQ ID NO: 2683 - DNA, 594 bp, Unknown
  Paenibacillus thiaminolyticus (multi)
atggggaaacggcgctggaccgcatctcgccaatttcggcaacttctggccaacgagaccatgttcggctcggagctgctgaacttcgagtatgtcctcatcgacgtagcgagatactccgaggaggagctgctcgctctgtccaacaccatcggctcggtattcctgctggaccagacagccgaccaggcggagctgttagaccgactcgggaaactgatgcacacgatccaacaactcccggaggactcccagcaacaacttgtggcgtggatggccaatatcctctcacaaaagctgcccgaaaacgagccccaactccgggaactaattcagaatgtgaagggcggcgtttccgtgatgggcctggagaaaactctcgatgccatcaagcgcgagggccgtcgggaaggccgccgggagggcctacgtcaggggttacaggagggcatccgcgagggaaaacaggagggaaaacgggaggccaagaaggaggtcgtgaaacaaatgatcgcggaggatctcgacccggaactgatcgcacgagttaccggcttcagcctggagatgattactcaactccgcgaacagtga

SEQ ID NO: 2684 - DNA, 594 bp, Unknown
  Paenibacillus thiaminolyticus (multi)
atgggcaagcggcggtggactgcatctcggcagttccgacaacttctagccaatgagacgatgttcgggagcgagcttctcaacttcgagtacgtcttaatcgacgtcgcacgctacagcgaggaggaacttctagcgctatccaacaccatcggctccgtgttcttgctcgatcagacggccgatcaggccgaattgcttgaccggttggggaaactgatgcacacaatccagcagctcccggaagactcccagcagcagctagttgcatggatggccaacattctctcccaaaagctaccggagaacgagccacaactgcgggaattgatccagaacgtgaagggtggggtgtccgtcatggggctggagaagactctggatgcgattaagcgtgaggggaggcgcgagggccgtcgggagggcctgcgccagggactccaggagggcatacgggaggggaaacaggaaggcaagcgtgaggccaagaaagaggtcgtgaagcagatgatcgcggaggacttggacccggagctgattgccagagtcaccggctttagcctggagatgattacgcagctcagagagcagtga

SEQ ID NO: 2685 - DNA, 687 bp, Unknown
  Paenibacillus lentimorbus (multi)
atgccgtacaggctcctactctaccaagtcgagatatggcgatacctgatgaaggaccaggagaaaactaaaggcaagccgaagaccttccggctgccacccatagtcccgattgtcctctacaacggcaagcgccgctggaccgcctcacgccagttccgacaattgctggcaaatgagaccatgttcggctcggagctgctcaacttcgagtacgtcctaatcgacgtggcgcgctacacggaggaggaacctctcgccttgagcaacacgattggctcggtattcctcctggaccagacagtcgatcaggcggaactgctggaccgcctcgggaagctgatgcacaccatccagcaactgcccgaggactcgcagcaacagctagtagcgtggatggccaacatcctctcacacaagctcccggagaacgagccccaactgagagacctcattcagaacgtgaaaggcggcgtgtcagtcatggggctggagaagacgctcgacgcgatcaagagggagggtcggcgtgaggggcgacgggaggggaaacaggaaggcaagagggaggcgaaggaggaagtggtcaagcagatgatcgcggaagacctggacccagagctgatcgccagagtcaccggcttcccgttggacatcatcacccagctcaagaagcagtcacactaa

SEQ ID NO: 2686 - DNA, 687 bp, Unknown
  Paenibacillus lentimorbus (multi)
atgccttacaggcttctgctttaccaagtggagatatggcgctacctcatgaaggaccaggagaaaacaaaaggaaagcccaagaccttccgcctgccacccatcgtgcctatcgtgctttacaacggcaagcgccgctggacggcctcacgacaattccggcaactgctcgcaaacgagaccatgttcggttccgaacttctcaacttcgagtacgtcctaatcgacgtggctcgatacacagaggaggagcccctggcgctgtccaacaccataggctcggtgttccttctcgaccagactgttgaccaggccgaactgctggaccgcttggggaagctgatgcacactatccagcagctcccggaggactcgcagcagcagttggtcgcctggatggccaacatcctgagccacaagctgcccgagaacgagccacagctccgcgacctgatacagaatgtgaagggcggagtctcggtgatgggccttgagaaaaccctggacgccatcaagcgggaaggaagacgggagggaaggagggagggcaaacaggagggaaaacgcgaagcaaaggaggaggtcgtgaagcaaatgatcgccgaggacttggaccctgaactgatcgcgcgggtcacgggtttcccgttagacattatcacccagctcaagaaacagagccactag

SEQ ID NO: 2687 - DNA, 687 bp, Unknown
  Paenibacillus lentimorbus (multi)
atgccctaccggctgttgctttaccaagtcgagatatggcgttacctcatgaaggaccaggagaagacgaaaggcaaaccgaagaccttcagactgccgcccatcgtcccgatagtcctctacaacggcaagcgccgctggacggcctccaggcagttccgccagctcctcgcaaacgagacgatgttcgggagtgagctgctgaacttcgaatatgtcctaatcgacgtggctcgctatacggaggaggaaccgctcgcgctctccaacacgataggctccgtcttcctgctcgaccagactgttgaccaagccgaactgctggaccggctcggcaagctcatgcacacgatacagcagctacctgaggatagccagcagcagttggtagcatggatggccaacattctgtcgcacaagctgcccgaaaacgagccccaattacgagacctcatccagaacgtcaagggtggcgtgagcgtcatggggctggagaaaaccctcgacgccatcaagcgggagggaaggcgggaagggcggcgcgagggaaaacaggagggcaaacgcgaggctaaagaggaggtcgttaagcagatgatcgccgaagacttggaccccgaactgatcgcgcgggtcaccggcttcccgttggacatcatcacacaactcaaaaagcagtcgcattga

SEQ ID NO: 2688 - DNA, 687 bp, Unknown
  Paenibacillus lentimorbus (multi)
atgccgtaccgcctactgctgtaccaagtggagatttggcgatacctgatgaaggaccaggagaaaactaagggaaagcccaagacctttcggttgccgcccatcgtccccatcgtgctctacaacggaaagcggcgctggacggcctcgcgccagtttcgacaactcctcgcaaacgagaccatgttcggctccgaactcctcaacttcgagtacgtgctcatcgacgtcgcgcgctacacggaggaggagcctctcgccttgagcaacacaattgggtcggtgttcctcctggaccagacggttgaccaagcggaactactggacagactcggcaagctgatgcacacgatccagcaactgccggaggacagccagcagcaactcgttgcctggatggccaacatcctctcgcacaaactgcccgagaatgagccacaattacgcgacctgattcagaacgtcaaaggcggcgtttccgtcatgggcctggagaagaccctggacgccatcaagcgggaggggcgtcgggagggtcgccgggagggaaaacaagaggggaaacgtgaagctaaggaggaggttgtgaagcagatgattgcggaggatcttgacccggaacttatcgcccgtgtcaccggcttccctctcgacatcatcacccagctcaagaaacagtcgcactga

SEQ ID NO: 2689 - DNA, 687 bp, Unknown
  Paenibacillus lentimorbus (multi)
atgccgtaccggctgctcctctaccaagtcgagatttggcgctacctgatgaaggaccaggagaaaacgaaggggaagcccaagacgttccgactgccgcccattgtgcccatcgtgctctacaacgggaagcgacgttggaccgcgagccgccagttccggcagctcctggccaacgaaaccatgttcggctcggaactactcaacttcgagtacgtgctaatcgacgtggcacgctacacagaggaggagcccctcgccctctccaacacaattggctccgtctttctcctagatcagaccgttgaccaagccgagttactggaccgcctcgggaaactgatgcacactatacaacagctcccggaggacagccagcaacaactggtggcctggatggccaacatcctcagccataagctgcccgagaatgagccccagttaagggatctcatccagaacgtcaagggcggcgtctctgtaatgggcttggagaagactttagatgcgatcaagcgtgaaggccgccgggagggccgtcgggagggcaaacaggagggaaagcgggaggcgaaggaggaagtggtcaagcagatgatcgctgaggacttagaccctgaactcatcgcgcgcgttactggctttcctctggacatcatcacgcagctcaaaaagcagagccactag

SEQ ID NO: 2690 - DNA, 603 bp, Unknown
  Paenibacillus thiaminolyticus (multi)
atgcgcgaccaggagaacgcgaagggcaagccgaagacgttccggctgccacctatcgtccccatagtcctatacaacggaaagcgccgctggactgcctcccggcagtttcgacagctcctggcgaatgagacgatgttcgggtccgaactgctgaacttcgagtacgtgctcatcgacgtcgcccgctacactgaggaggagttactggcactgtcgaacaccatcggctcagtgttcctactcgaccagacggcggaccagacggagctgctgaaccgcctcggcaagctcatgcacacgatccagcagctacccgaggaatcgcagcagcagttggtcgcgtggatggcgaacatactctcccagaaacttcctgaaaatgagccgcagcttcgtgagcttatccagaacgttaagggtggcgtgagcgtgatgggcttggagaaaacactggacgcgatcaagcgggaaggcaagcgggaagcgaaggaggaagttgtgaagcaaatgatcgcggaggatctcgaccccgaactgatcgctagagttaccggctttccggttgacattatcgcaaagctgcgtgaacagtcccattga

SEQ ID NO: 2691 - DNA, 603 bp, Unknown
  Paenibacillus thiaminolyticus (multi)
atgcgcgaccaggagaacgcaaaggggaaacccaagaccttccggctccctcccatcgtcccgattgtgctttacaacggcaaacgccgctggacggcctcccgacaattccgacagctcctggccaacgagacaatgttcgggagtgaactgctgaacttcgagtatgtcctcatcgacgttgcgcgctacacggaggaggagcttctcgcgctctcgaacaccattgggagcgtctttctacttgaccaaacagccgaccagactgagctgctgaatcgcctcgggaagctgatgcacacgatacagcaactgccggaggagtcgcagcaacagttggtggcgtggatggcgaatatcctgagccagaaactcccggagaacgagcctcagttgcgggaattgatccagaacgtgaaaggtggtgtgagcgtgatgggcctggagaagacactggacgcgatcaagcgggaggggaagcgcgaagcgaaggaggaggtggtgaagcagatgatcgcggaggacttggaccctgagctgatcgctcgggtgactgggtttccggtggacataatcgccaagctgagggagcagtcccactaa

SEQ ID NO: 2692 - DNA, 603 bp, Unknown
  Paenibacillus thiaminolyticus (multi)
atgcgcgaccaggagaacgcgaaggggaagccgaagaccttccgcctccctcccatagtgcccatcgtgctctacaacgggaagcgccggtggaccgccagccgtcagttccgtcaactcctggcgaacgagaccatgttcgggtccgagctgctcaactttgagtatgtcctcatcgacgtggcacgttacaccgaggaggagctattggcacttagcaacaccatcggctccgtgttcctcctggaccagactgcggatcagactgaattgctgaaccggctgggcaagctgatgcacaccatacaacaattaccggaggagtcccagcagcaactcgttgcctggatggccaacattctctcccagaaactcccggaaaatgagccccaactacgggaacttatccagaacgtgaagggcggcgtgtcagtcatgggcctggagaagaccctggacgccattaagcgcgagggaaaacgtgaagcgaaggaggaagtcgtcaagcagatgattgccgaagatttggacccagagctgatcgcccgcgtcacgggattccccgttgacatcatcgctaagctacgcgaacagtcccactga

SEQ ID NO: 2693 - DNA, 603 bp, Unknown
  Paenibacillus thiaminolyticus (multi)
atgcgtgaccaggagaacgccaaaggaaaacccaagactttccgcctgccgccgattgtcccaattgtcctctacaacgggaaaaggcggtggacggcctcgcgccaattccgccaactcctcgccaacgagacgatgttcgggagcgaactgctcaacttcgagtatgtgctcatcgacgttgcccgctacacggaggaggaattgctcgcgctcagcaacaccattggctcggtctttctactcgaccagacggccgaccagactgaattactaaaccgcctgggcaagctgatgcacacgatccagcaactgccggaggagtctcagcaacaattggtggcatggatggcgaacatccttagccagaagctccccgaaaatgagccacaactcagagagctgatccagaacgtcaagggcggggtgtcggtcatgggacttgagaagactctcgacgcgatcaagcgcgaggggaagcgggaggcaaaggaggaagtcgtgaagcagatgattgcggaggacttagacccggagctgatcgcacgggtcaccgggttccccgtggacatcatagcgaagctgagagagcagagccactag

SEQ ID NO: 2694 - DNA, 603 bp, Unknown
  Paenibacillus thiaminolyticus (multi)
atgcgggaccaggagaatgcgaaggggaagcccaagaccttccgactgccgcccatcgtgcccattgtcctgtacaatggcaagaggaggtggacggcgagtcgccagtttcgtcagcttttagccaacgagacgatgttcgggagcgagcttctcaacttcgagtacgtcctgattgacgtcgcgcgttacaccgaggaggagctgcttgcgctctcaaataccatcggatcggtctttctgttggaccagacggcggaccagacagaacttctcaacaggctgggcaaactcatgcacacgatccagcagctacccgaggaatcccagcaacaactggtagcgtggatggccaacatcctctcacagaagctccctgagaacgagccccagctacgcgaactgatccagaacgtgaagggaggggtgtcggtgatgggactggagaagactctcgacgccattaagcgggaggggaagcgggaggcgaaggaggaggtggtcaagcagatgattgcggaagatttggaccccgagctgattgctcgggttaccggtttccccgtggacatcattgctaagctgcgagagcagtcgcattag

SEQ ID NO: 2695 - DNA, 450 bp, Unknown
  Stenotrophomonas sp. multi
atggcgagtcctagactccgctatgggcgctactcccgcacggggaatgtctatagtctcacaacgaccacccacggccgcgaaccattctttagtgacgcgggcaacgtcgctgtcctggtggacgctctcagattcgtggaacgctcgggtatttcacactctttggcatgggtggttatgcccgaccacctccactggctaatggaactacagaagggcacgcttgcacagtgcatggcgctgcttaaaagccgcagctcacgacaactcaaccgaatcagtggtaggaagggccctctgtggcagcacggataccacgaccatgccgtccgcacagacgagtctctgcatgataacgccatgtacattcttgggaacccagtacgtgcgggactcgctggaggtctaggagattatccccacgcatggtgccgatggcccctctga

SEQ ID NO: 2696 - DNA, 450 bp, Unknown
  Stenotrophomonas sp. multi
atggcttcgccgcgtttgcgctacggacgatattcccgcactgggaatgtgtactccttgaccacaacgacccacggaagggagccattcttcagcgacgcggggaatgtggccgttctggttgatgctttgcggttcgtagaacggagcggtatcagccatagcctcgcctgggtggtcatgcccgaccatctccactggctcatggagcttcagaagggaactcttgctcagtgcatggcgctccttaaatcacgaagcagccgtcaacttaaccgcataagcggtcggaaaggcccactatggcagcacggctatcacgaccatgccgtcaggacggacgagtccctccacgataacgcaatgtacatactcggcaatccagtgcgtgctggccttgcgggtggcttgggtgactatcctcacgcctggtgccgctggcccttgtga

SEQ ID NO: 2697 - DNA, 450 bp, Unknown
  Stenotrophomonas sp. multi
atggcctcgccgaggctccgctatgggcgctattcccggactgggaatgtctattcccttactacgactacgcacggacgcgagccattctttagtgacgcgggcaacgtggcagtgttagtagatgcccttcggttcgtcgaacgctccggaatctctcactccctcgcctgggtggtcatgcccgatcatctgcactggctaatggaacttcagaagggaaccctggctcagtgcatggcactgctcaagtctcggtcctcccgtcagctcaacaggatcagcggtaggaagggtccattgtggcaacacggctaccacgatcacgcagtcagaaccgacgagtctctccatgacaatgccatgtacatcttgggcaaccctgtccgagctggcttggccggaggtttgggcgactaccctcacgcctggtgtcgatggcctctctag

SEQ ID NO: 2698 - DNA, 450 bp, Unknown
  Stenotrophomonas sp. multi
atggcttccccgcgcctgcgctacggtcgctactcgcgcaccggaaatgtctattccctgaccactaccacacatgggcgggagccgttcttcagcgatgcggggaatgttgcagtgttggtggacgccctccgcttcgtggaacgttctggcatctcacacagtctcgcgtgggtcgtcatgcctgaccatctccactggttgatggaacttcaaaagggaacgttggctcagtgcatggccctgctcaaatcgagatcgtccaggcagcttaacagaatctcgggtcggaagggccctctctggcagcatggctaccacgaccacgcagtgagaaccgacgagtcgttacacgataacgctatgtacattcttggcaaccctgtaagagctggactggcgggtgggctcggcgattaccctcatgcctggtgtcgatggccactatag

SEQ ID NO: 2699 - DNA, 450 bp, Unknown
  Stenotrophomonas sp. multi
atggcgtcgccgaggcttcgttacggccgctactccaggacgggcaatgtgtacagtctcacaactacaacccacggccgagagccattcttcagtgatgcggggaacgtcgcggttctagtggatgccctgaggttcgtcgaacggtctggcatcagccactcactcgcttgggtcgtgatgccggaccatcttcactggctcatggaacttcaaaagggcactctcgcacagtgcatggcactcctgaaatcgaggtcgagtcgccaactcaatcggataagcgggaggaaaggcccgctgtggcagcatggttatcacgatcatgcggtcagaaccgacgagtcactccatgacaacgccatgtacatactgggaaaccccgttcgagccggattggctggtgggctcggtgactaccctcatgcctggtgcagatggccgctgtaa

SEQ ID NO: 2700 - DNA, 1356 bp, Unknown
  Bacillus sp. multi
cttggcgtcaccatcaagatcatgaagtaccagattctctgccccatgaacgttgactggatcatcttcgagaaacacctcagaaacctcacctaccagatcagaaccatctcgaatcgaaccattcagcagttatgggagttcgacgccctctccttcgactacttcaaggagcgcgggacgtatcctactgtccaagacctctatggttgtacgcagaagaaaatcgacgggtacatctaccacacactccaaagtaagtaccccgacatccacaagggcaatatgagcactacccttcagaagattattaagacatggaaaagccgccggaacgaaattcgcaagggcgaaatgagcatccccagtttcagaaaccgcattccaatagacctccataacaactccgttgacataactaaggaaaaaaatggggactatatcgctgggatctccctattctcccgtgacttccacaaggaaaacgacgacgtgccgaaaggcaaaatcttcgtaaaacttgctactcagaagcagaagtccatgaaggtcatcctcgaccgactcatcaatcagacatattctaagggcgcgtgcatgattcacaagtacaagaacaagtggtacttgtcaattacctacaagttcaacgcgattaaggagaagaagtttgacaaggagttgataatgggcatcgacatgggcggtatcaacaccgtgtacttcgcattcaacgagggcttcattcgcagcaacattaagtcagatgagatcaaggagtttaacgagcgcatccgtcaaaggcgcatcaacctcctgaatcagtccaagtattgctccaacagcagaacgggaaaagggcgcaccaagaggctccagcctatagacgtcctgagtaacaagattgccaagttccgcaacagtaccaaccacaagtacgcgaactacatcatcaagcaatgcttaaagtacaactgcgggaggatacaaatggaattgctcaaggggatctccaagaatgataaggtgctcaaggactggacctacttcgatctccaggaaaaaatcaagaaccaggccgagattcacggtatcgaggtcattaaggtcgcgcccgcatacaccagccagagatgctctcagtgcgggtacatctgtaaggagaaccgatgcacccaggcaatgttcgagtgcaagcagtgcggctacaaaacccacgccgactacaacgccgccaagaacatcgccacatacgacattgagaacatcatcaacaagcagcttgcggcccagtccaagctccactccaaaaaatgcatggaggagtatatcgaggaactgggctacctcgactag

SEQ ID NO: 2701 - DNA, 1356 bp, Unknown
  Bacillus sp. multi
ctcggggtcaccatcaagattatgaagtaccagattctctgccccatgaacgtggattggatcatattcgagaaacaccttcggaacctaacctaccagatccgaacgatctccaacagaaccatacagcagttatgggagttcgatgccctgagcttcgactacttcaaggagcgcggcacctacccgaccgtccaagacctctatggctgcacccagaagaaaatcgacgggtacatataccacacgctccagagtaagtatccggacatccacaagggcaatatgtccactactttgcaaaaaatcatcaagacatggaaatcacgccgcaacgagatccgtaagggcgagatgtcaattcccagcttccgtaaccgcatcccaattgacctgcataacaactcggttgacattacaaaggagaagaatggcgactacatcgctggaatatccctgttctcaagggacttccacaaggagaacgacgacgtaccgaagggcaagatattcgtgaagctggccactcaaaagcagaagtctatgaaggtgatacttgaccggctcatcaatcagacctatagcaagggtgcctgcatgatccacaagtacaagaacaagtggtatttgagtatcacgtacaagttcaacgctattaaggaaaaaaagttcgacaaggagctgattatgggaatcgacatgggcggcatcaacacagtgtacttcgcattcaacgagggattcattcgctccaacatcaagagcgacgagattaaggagttcaacgagcgcatccgacagcgccggataaacctactcaatcagtccaagtactgctcaaacagccgtaccgggaagggccgaacaaagaggcttcaacctattgacgttctaagtaacaagatcgccaaattccggaacagcactaaccacaagtacgccaactacattatcaagcagtgcctaaagtacaattgcgggcggattcaaatggagctattgaagggaatctccaagaacgataaggtgttgaaggactggacctactttgacctccaggagaagatcaaaaaccaggccgagatccacgggatcgaggtcatcaaggtcgcgcctgcatacacatcgcagaggtgctcacagtgcggctacatctgtaaggagaaccgctgcacccaggcgatgttcgagtgcaagcagtgcggttacaagacgcacgccgactacaacgccgccaagaacattgcgacttacgatattgaaaacatcatcaacaagcagctcgccgcacagagcaagttacactccaagaaatgcatggaggagtacatcgaggaacttggatacctggactag

SEQ ID NO: 2702 - DNA, 1356 bp, Unknown
  Bacillus sp. multi
cttggggttactatcaagatcatgaagtaccagatcctctgccccatgaacgtggactggatcatcttcgagaagcacctccggaacctgacctatcagataaggacaatctccaaccggacgattcagcagctttgggagttcgacgcactgagcttcgactacttcaaggaacgcggcacttacccgaccgttcaagacttgtacggctgcacgcagaagaagatcgacggctatatctatcacactctccaaagtaagtaccccgacatccacaagggaaacatgagcactacgcttcaaaaaatcatcaagacttggaaaagccgccgcaacgagatcagaaaaggtgagatgtcgatcccttcctttcgtaaccggataccaattgaccttcacaacaactctgtggacattacgaaggagaagaatggcgactacatcgccgggatctccctctttagtagagatttccacaaggagaacgacgacgtgccgaagggaaagatattcgtcaaattggccacccagaagcagaagtcgatgaaggtgatccttgaccgactgattaaccagacctactctaagggcgcgtgcatgatacacaagtacaaaaacaagtggtacttgagcatcacatacaagttcaacgccattaaggaaaaaaagttcgacaaggagttaatcatgggcattgacatgggcggtatcaacaccgtttactttgccttcaacgaggggtttatccgctcaaacatcaagtcggacgagattaaggagtttaacgagcgaatcaggcaacgtcggattaacctgctgaaccagtctaagtattgctccaactcacggactgggaagggacggaccaagcggttgcagcctatcgacgtgctgtccaacaagatagccaaattccgtaactctaccaaccacaagtacgcaaactacatcattaagcagtgcttaaagtacaattgcgggcgtattcaaatggagttattgaaggggatctccaagaatgacaaggtgctcaaggactggacctacttcgacctacaggaaaaaatcaagaaccaggccgaaatccacgggatcgaagtgattaaggtggctcccgcctatacctcccagcggtgctctcagtgcgggtacatctgcaaggaaaaccgctgtacccaggccatgttcgagtgcaaacagtgcggctacaagacccacgccgactacaacgcggccaagaacatcgccacctacgacatcgagaacatcatcaacaaacagttggccgcccagagcaaacttcactccaagaaatgcatggaggagtacatcgaggaactggggtatctcgactaa

SEQ ID NO: 2703 - DNA, 1356 bp, Unknown
  Bacillus sp. multi
ctgggcgtgaccatcaagatcatgaagtaccagatactctgccctatgaacgttgactggatcatattcgagaagcacctccgtaacttaacatatcagatccgcacgatcagcaaccggacgatacagcaattgtgggagttcgacgccctgagcttcgactacttcaaggagcgaggcacatatcctaccgtccaagacctatacgggtgcacgcagaagaagatcgacggctatatctatcacactctccagtccaagtaccctgacattcacaaaggcaatatgtccaccaccctccagaagatcattaagacttggaagtcgcgccgaaacgagatccgcaagggcgagatgtcgatcccttccttccggaaccgcattccaatcgacttgcacaacaactccgttgacattactaaggagaagaacggtgactacatcgccgggatctccctgttctctagggatttccacaaggaaaacgatgacgttccgaagggcaaaatcttcgtaaagctcgccactcagaagcagaagtccatgaaggtgatcctggatcgcctcatcaatcagacctacagcaagggagcctgcatgattcacaagtacaagaacaagtggtatctgtccataacatacaagttcaacgccatcaaggagaagaaattcgacaaggagctgattatggggatagacatgggcgggataaacacagtgtacttcgctttcaacgagggcttcataaggagcaatatcaagtctgacgagattaaggagttcaatgagcggattcggcagaggcgcatcaacctgcttaaccagtccaagtattgcagtaactccaggaccggaaaagggaggacaaaacgcttgcagccgattgacgtgctctccaataagatcgctaagttccgaaactccacaaaccacaagtatgcgaattacatcatcaagcagtgcctcaagtacaactgcggacgcatacagatggagctgctcaagggcatctccaagaacgacaaggtgctgaaagactggacctacttcgacctacaggaaaaaatcaagaatcaggccgagatccacgggatagaggtgattaaggtggcaccagcatataccagccaacgttgctcccagtgcggctacatctgcaaggagaacagatgcactcaagctatgttcgagtgcaagcagtgtggatacaaaacacacgcggactacaacgcagccaagaacattgccacatacgacattgagaacatcatcaacaagcagctcgccgctcagagcaagctccacagcaaaaaatgcatggaggagtacattgaggaactcggttacctcgactaa

SEQ ID NO: 2704 - DNA, 1356 bp, Unknown
  Bacillus sp. multi
ttgggcgtgaccattaagatcatgaagtaccagatcctctgcccgatgaacgtcgattggatcatcttcgagaagcacctccgcaacctcacgtaccagatccgcactatcagcaatcgtaccatccagcagttgtgggagtttgacgcactctccttcgactacttcaaggaacgtggcacctaccccacggtccaagacctctacggctgcacacagaagaagatcgacgggtacatctaccacaccctccaaagcaagtatcccgacattcacaaggggaatatgagcacaaccctccagaagatcatcaagacttggaaatcacgtcgcaacgagatccgcaagggagagatgtccatcccttccttccgtaatcgcatcccgattgacttgcacaacaattccgtggacattactaaggagaagaacggagattacatcgctgggatcagcctcttcagtagagacttccacaaggagaacgacgacgtgcctaagggcaaaatcttcgttaagctcgctactcaaaagcagaagtccatgaaggttatcctcgaccgacttatcaaccagacctactctaagggtgcttgcatgatccacaagtacaagaacaaatggtacttgagcatcacctacaaattcaacgctattaaggaaaaaaagttcgacaaggaactcataatgggaattgacatgggcggcatcaacaccgtttacttcgccttcaacgagggcttcataaggtcaaacatcaagagcgatgagatcaaggagtttaacgagcgcataaggcagaggaggatcaacctgcttaaccagagcaaatactgctccaactcccgaaccgggaagggtcgcacgaagcgcttgcagccgattgacgtcctgtccaacaagatcgccaagttccgcaacagcacaaaccacaagtacgcgaactacatcatcaagcagtgcctcaagtacaactgcggccgtatccaaatggagctgttgaagggcatcagcaagaacgacaaggtgttgaaagactggacgtatttcgacctccaggaaaaaatcaagaatcaggccgagatccacggcatcgaggtcattaaggtggctccggcatacaccagccaacggtgttcccagtgcgggtacatctgcaaggagaaccgatgcacccaggctatgttcgagtgcaagcagtgcgggtacaagacccatgcagattacaacgccgctaagaacatcgcaacgtacgatattgagaacatcatcaacaaacaacttgccgcgcagtcaaagctgcacagcaaaaagtgtatggaggagtacattgaggagctgggatacctcgactga

SEQ ID NO: 2705 - DNA, 1356 bp, Unknown
  Bacillus sp. multi
ctcggcgtgactatcaagatcatgaagtaccagatcctctgccccatgaacgtggactggacaatcttcgagaagcacttgaggaatctcacgtaccaagtgaggactattagcaaccggaccatccaacaactctgggagtttgacgcgctctccttcgactactttaaggaacggggcacatatcccactgtccaagacctctatggctgcactcaaaaaaaaatcgacgggtatatctaccacacattgcagagcaagtacccagacatccacaaggggaatatgagtaccacgcttcagaagatcatcaagacttggaaaagcagaaggaacgaaatccgaaagggagagatgagtatcccctcgttccgcaaccgtatccctatagaccttcacaacaattcagttgacattactaaggagaagaacggcgactacatcgccgggatctcactgtttagccgagatttccacaaggagaacgacgacgtgccaaaaggcaagatattcgttaagctggcaacccagaagcagaagtcgatgaaggtcatattggaccggcttatcaaccagacctattctaagggtgcctgcatgatccacaagtacaagaacaagtggtacttgtctatcacctacaagttcaacgccattaaggagaagaagtttgacaaggagcttatcatgggcatcgacatgggcggtatcaatactgtgtacttcgccttcaacgaggggttcatccgttccaacatcaagagcgacgagattaaggagtttaacgagcgcatacggcaaagacgcatcaaccttctcaatcagtccaagtactgctccaactcacggacagggaaaggtcgcaccaagcgtcttcagccgattgatgtcctgtccaacaagatcgctaagttcagaaactcgactaaccacaagtacgctaactacatcatcaagcagtgcctcaagtacaactgcggacgcattcagatggagctattgaagggcatctctaagaacgacaaggtgctcaaggactggacctacttcgacctccaggaaaaaattaagaaccaggctgagatccacgggatcgaggtcatcaaggtggctcctgcctatacgtcccagcgttgctctcagtgcggctacatctgcaaggagaaccggtgcacccaagctatgttcgagtgcaagcagtgtggctacaaaacccacgccgactacaatgccgccaagaacatcgccacctatgacatcgaaaacatcatcaacaagcagctcgcagcgcagtccaagctgcattccaaaaagtgtatggaggagtacatcgaggagttgggctacctggactga

SEQ ID NO: 2706 - DNA, 1356 bp, Unknown
  Bacillus sp. multi
ctgggagtaaccatcaagatcatgaagtaccagatcctctgccccatgaacgtggattggactatcttcgagaaacacctgaggaacttgacctaccaagtcaggaccatctccaaccgaaccatccagcagctctgggagttcgacgcgctgtcctttgactacttcaaggaacgcgggacttacccgacggtgcaagacctatatggctgcacccagaagaagattgacggctatatctaccacactctccaaagcaagtaccccgacatccacaaggggaatatgtccaccacactccagaagatcattaagacgtggaagtctaggcgaaatgagatccgaaagggagaaatgtccatcccttccttccgaaaccggatacctatcgaccttcacaacaactctgtggacatcactaaggagaagaatggcgactacatcgccggtatcagcttgttcagccgcgatttccacaaggagaacgacgacgtgcctaagggcaaaatcttcgtaaagctcgcaacacagaagcagaagtctatgaaggtgattctcgaccgcctcatcaaccagacgtactcgaagggtgcgtgcatgatccacaagtacaagaataagtggtacttgtcaatcacctacaagttcaatgctatcaaggaaaaaaaattcgacaaggagctgattatggggatcgacatgggcgggataaacacagtgtacttcgccttcaacgaggggttcattagatccaacatcaagagcgacgagattaaggagttcaacgagcgaatcagacagcgccggataaacctcctcaaccagagcaaatattgcagcaacagtcgcacgggcaagggacgtacaaaacgactacagcctatcgacgtcctgtcaaacaagatagccaaattccgcaattctactaaccacaaatacgccaactacatcatcaagcagtgccttaagtacaattgcggtcgaatccaaatggaactattgaagggtatcagcaagaatgacaaggtgctcaaggactggacctacttcgatctccaggagaagatcaaaaaccaggccgagatccacggcattgaagtgattaaggtcgccccagcctacacgagtcagaggtgctcgcagtgcggttacatctgcaaggagaaccgttgcacccaagccatgttcgagtgcaagcagtgcggctacaagacgcacgccgattacaacgccgccaagaacattgctacttacgacattgagaacattatcaataagcagctcgcagctcagagcaagctccatagcaaaaaatgcatggaggagtacatcgaggaactgggctacttggactga

SEQ ID NO: 2707 - DNA, 1356 bp, Unknown
  Bacillus sp. multi
ctaggtgtaaccatcaagatcatgaagtaccaaatcctgtgccccatgaacgtcgattggaccatcttcgagaagcacctccgcaacctgacataccaagtgcgtaccatctccaatcgcaccatccagcagttgtgggagttcgacgccctgtccttcgactacttcaaggaacgtggcacctaccccacggtacaagacctttacggttgcacccagaagaagatcgacgggtacatctaccacactctacaaagcaagtacccggacatccacaaggggaacatgagcactacactccagaagatcatcaagacatggaagtccaggcgcaacgagatccgcaagggcgagatgtccattccatcctttcgcaaccgcattccaattgatctacacaacaattcagtggatattacaaaggaaaaaaatggggactacatcgctggaatttcgctctttagccgtgactttcacaaggagaacgatgacgtgccgaaggggaaaatcttcgtaaagctggctacgcagaagcagaagtctatgaaggtgatactggatcgccttatcaatcagacctacagcaagggagcgtgcatgatccacaagtacaagaacaagtggtacttgtccatcacatacaagttcaacgctatcaaggaaaaaaagttcgacaaagagcttatcatgggcatcgacatgggtgggattaacacagtttactttgcgttcaacgaggggttcatacgttccaacatcaagagcgacgagatcaaggagtttaacgagcgtattcgtcagaggcgcattaaccttctcaatcagagcaaatattgctcaaacagtcgcactggaaagggacgtaccaagaggttgcagcctattgacgtgctcagcaacaagatagccaaattccgcaacagcaccaaccacaagtacgcgaactacatcatcaagcagtgcctcaagtacaactgcgggcgtatccagatggagcttctcaagggaatctctaagaacgacaaggtgttgaaagactggacctacttcgacttacaggagaagatcaaaaaccaggccgagatccacgggattgaggtcatcaaggttgccccggcttacacttcccagaggtgcagtcagtgtggctacatctgtaaggaaaaccgctgcactcaagccatgttcgaatgcaagcagtgcggatacaaaacccacgctgactacaacgctgccaagaatatcgcaacctacgacatcgagaacatcatcaacaagcagttggccgctcagagcaagctccacagcaaaaaatgcatggaggagtacattgaggagcttggctaccttgactga

SEQ ID NO: 2708 - DNA, 1356 bp, Unknown
  Bacillus sp. multi
cttggagtgacgatcaagatcatgaagtaccagatactgtgccccatgaacgtggactggaccatcttcgagaagcacctccgcaacctcacgtaccaagtccgcacgatctccaaccggaccatacagcaattgtgggagttcgacgcactatccttcgactacttcaaggagcgtggcacttaccccaccgtacaggacttgtacggctgcacccaaaaaaaaatcgacgggtacatctaccacacgctgcaatccaagtacccagacattcacaaggggaacatgagcaccactttgcagaagatcatcaagacctggaaaagccgtcgtaacgagatacgcaaaggcgagatgagcatccccagcttccgcaatcgaatccccattgacctgcacaacaattcagtggacatcacaaaggagaagaacggcgactacattgccggaatttcactgttcagccgggacttccacaaggaaaacgacgacgtgccgaagggcaagatattcgtgaagctggccacacagaagcaaaagtcgatgaaggtgatccttgaccgcctcatcaaccagacatacagtaaaggtgcctgcatgattcacaagtacaagaacaaatggtatctctcaattacatacaaattcaacgccattaaggagaagaaattcgataaggagcttatcatgggaattgacatgggcggtatcaacacagtttactttgcgttcaacgaggggttcatccggagtaacatcaagtctgacgagatcaaggagtttaacgagcggattcggcagcgtcggataaacctgctgaaccagtccaagtactgctctaattccaggacaggaaagggtcggacgaagcggcttcagcccatcgacgtgcttagtaacaagatcgccaagttccgaaacagtaccaaccacaaatacgccaactacatcatcaagcagtgccttaagtacaactgcggacgtatccagatggagctgcttaaagggatcagcaagaacgacaaggtgctaaaggactggacctacttcgacctccaggagaagatcaaaaaccaggcggagatacacgggattgaggtcatcaaggtggctcccgcctataccagccagagatgctctcagtgcgggtatatctgtaaggagaatcgttgtacccaggctatgttcgagtgtaagcagtgcggctacaaaacccatgctgactacaacgcagccaagaacattgctacttacgacatcgagaacatcattaacaagcagcttgcggcccagtcgaagttacactccaagaagtgtatggaggagtacatcgaggagctgggttacttggattag

SEQ ID NO: 2709 - DNA, 1356 bp, Unknown
  Bacillus sp. multi
ctcggagttaccatcaagattatgaagtaccaaattctctgcccgatgaacgttgactggaccatattcgagaaacaccttcgcaaccttacttaccaagtacggacaatctcgaaccgcactattcaacagctctgggagtttgacgccctgtcgttcgactatttcaaggagcgcgggacgtaccccactgtacaggacttgtacggatgcacacagaagaagatagacgggtacatctaccacaccttgcagtccaagtacccggacatccacaagggaaacatgagtaccacactccaaaaaatcatcaagacttggaagtcacgtcgaaacgagatccgcaaaggtgagatgagcatccccagtttccgcaaccggataccaattgacctgcacaacaattccgttgacatcacgaaggagaagaacggcgactacatcgctggtatttcgttattctcgcgcgatttccacaaggagaatgatgatgtgccaaagggcaaaatcttcgttaaactggctacacagaagcagaagtctatgaaggtgatcctcgaccgccttatcaaccagacttacagcaaaggggcctgcatgatccataagtacaagaacaagtggtatcttagtatcacctacaagttcaatgccattaaggaaaaaaagttcgacaaggaactcattatggggatcgacatgggtggtatcaacactgtgtacttcgctttcaacgagggattcatccgcagcaatatcaagtccgacgagatcaaggagttcaacgagcgcatacggcagcggcggatcaacctcctcaatcagagcaaatactgctccaactcccgtaccggaaagggacgaacgaagcggctacagcctattgacgtactcagcaacaagatcgccaaattccgtaactctacgaaccacaagtacgccaactacatcatcaagcaatgcttgaagtacaactgtgggcgtatccagatggagctgttgaagggcattagcaagaacgacaaggtgcttaaggactggacctacttcgacctacaggagaagatcaaaaaccaggccgagatccacggcatcgaggtgattaaggttgcccctgcctacacctcgcaaaggtgctcgcaatgcggctatatctgtaaggagaaccgctgcacacaggctatgttcgaatgcaagcagtgcgggtacaagacccacgccgactacaacgccgccaagaacatcgcaacctacgacatcgagaacatcattaacaagcagctcgccgcccaatccaaactccactccaagaagtgtatggaggagtacatcgaggaactgggttacttagactga

SEQ ID NO: 2710 - DNA, 1356 bp, Unknown
  Bacillus sp. multi
ctcggggtcactatcaagattatgaagtaccaaatcctctgcccgatgaacgttgactggaccatattcgagaagcacctccggaacctaacctaccaagtaaggacaatcagcaaccggaccattcagcagctctgggagttcgatgctctgtcgttcgattacttcaaggaacgaggaacttaccccacagtacaggatctctacggctgcactcaaaaaaaaatcgacggctatatctaccatactctccaatctaagtaccccgacatccacaagggcaacatgagcacgacccttcagaagatcattaagacgtggaaaagtaggcgcaacgagatcaggaagggagagatgtccatcccctccttccgtaaccgcatacccatcgacctccacaacaactccgtggacattactaaggagaagaatggggactacattgcggggatcagcctgttcagccgggacttccataaggagaacgacgacgtgccgaaggggaaaatcttcgtgaagctcgcaactcagaagcagaagtctatgaaggtgattcttgaccgcctgatgaaccagacgtacagcaagggcgcttgcatgatccacaagtacaagaacaagtggtatctaagtattacatacaaattcaacgccatcaaggagaagaaattcgacaaggagcttatcatggggattgacatgggcggcattaacaccgtgtacttcgccttcaatgagggcttcatacgttccaatatcaagtccgacgagatcaaggagttcaacgagcgcattcgacaaaggcgcatcaacctgctgaaccagtctaagtattgcagcaactcaagaactggcaagggccgcaccaagcgacttcaacccatcgacgtgctcagcaacaagattgccaagttccgtaacagtacgaaccacaagtacgcgaactacatcatcaagcagtgcttgaagtacaactgcgggcgaatccaaatggagttactcaagggcatcagcaagaacgataaggtgctcaaggactggacatacttcgatctacaggagaagatcaaaaaccaggccgagattcacggtatcgaggtcattaaggtggctcctgcttacactagccagaggtgttcacagtgtggctatatctgcaaggaaaatcggtgtacccaggcaatgttcgaatgcaagcagtgcgggtacaagacccacgccgactacaacgcggccaagaatatcgctacctacgatattgagaacattatcaacaagcaattggccgttcagtccaaactgcactccaagaagtgtatggaggagtacatcgaggagttgggctacctggactga

SEQ ID NO: 2711 - DNA, 1356 bp, Unknown
  Bacillus sp. multi
ctcggcgtcactatcaagatcatgaagtaccagatcctttgccccatgaacgttgactggacaatcttcgagaagcacctccgcaacctcacgtaccaagtcaggacaatctcaaaccgcacgatccagcaattgtgggagttcgatgctctatcgttcgactatttcaaagagcgtgggacttatcctacagtgcaagacctatatggatgcacacaaaaaaagatagacggctacatctatcataccctgcaatccaagtaccccgacatccacaagggcaatatgtccactaccttgcaaaaaatcatcaagacatggaaatcccgccgcaacgagatccggaagggcgagatgtccatcccgtccttccgtaatcggattcctattgatctccacaacaacagcgttgacataacgaaggagaagaatggggactatatcgctgggatttcgctattcagccgcgacttccacaaggagaacgacgatgtgccgaagggcaagatattcgttaagctcgccacacagaagcagaagtccatgaaggtgatcctggaccgtctcatgaaccagacctactcaaagggagcctgcatgatccacaagtacaagaacaagtggtacttatccatcacctacaagttcaacgcgatcaaggagaagaaattcgacaaggagctgattatgggaatagacatgggtggcatcaacaccgtttactttgccttcaacgaggggttcatacggtcaaacatcaagagcgacgagatcaaggagttcaacgaacggataaggcagagacggatcaaccttctcaatcagtccaagtactgttccaattcgcgcaccggcaagggaaggaccaagcggttgcagcccattgacgtcctcagcaacaagatcgccaaattccgcaactctaccaaccacaaatacgcgaactacatcatcaagcagtgccttaagtacaattgcgggcgcatccagatggagctgttgaaggggatctccaagaacgataaggtgctcaaggactggacttacttcgatctccaggagaagatcaaaaaccaggcagagatccacgggatcgaggtcatcaaggtggcacccgcatacaccagccagaggtgttcccagtgcgggtacatctgcaaggagaaccgctgcacccaggccatgttcgagtgcaagcaatgcggatacaaaacgcacgccgactacaatgcagccaagaacatcgctacttacgatattgagaacatcattaacaagcagcttgcagtgcagtctaaactccacagcaagaaatgcatggaggagtatatcgaggagctggggtatttggactaa

SEQ ID NO: 2712 - DNA, 1356 bp, Unknown
  Bacillus sp. multi
ctcggggttacgattaagatcatgaagtaccagatactctgccctatgaacgtggactggacgatcttcgagaaacacctgaggaatctgacgtaccaagtaaggacgatctcgaacaggaccatccagcagctctgggagttcgacgccctctccttcgactacttcaaggagcgcggaacgtaccccaccgtacaagacctttacgggtgcacacagaagaaaatcgacggctacatctatcacacccttcaatctaagtaccccgatattcacaagggcaacatgagtacaacgctccagaagattatcaagacatggaaatcccgtaggaacgagatcaggaagggcgagatgagcatcccctcattccggaaccgcatccctattgacctccataacaactccgtggacatcacaaaggaaaaaaacggggactacatcgccggaatatccctgttcagccgagacttccacaaggagaacgacgacgtacctaagggcaagatattcgtcaaactcgcaacccagaaacagaagtccatgaaggtgattcttgaccgcctcatgaaccagacatactcaaagggcgcttgcatgatccataagtacaagaacaagtggtacttgtctattacctacaagttcaatgctatcaaggagaagaaattcgacaaggagcttatcatggggattgacatgggtggcatcaatacggtgtactttgctttcaacgaggggttcatcaggagcaacatcaagagcgacgagatcaaggagttcaacgagcgtattcggcagaggaggatcaacttgctaaaccagtccaagtattgttccaattcccgcacagggaaggggcggaccaagcgcctccagcccatcgacgtgctgtcaaacaagattgccaaattccgtaacagcacaaatcacaagtacgccaactacattatcaagcagtgcttaaagtacaactgcgggcgtatccagatggagctgctaaagggcatctccaagaatgataaggtgcttaaagactggacttacttcgatctccaggaaaaaatcaagaatcaggcagagatccacggcatcgaggtcatcaaggtcgcaccagcctacactagccagaggtgctctcagtgcggctatatctgtaaggagaatcggtgcacccaggcaatgttcgaatgcaagcagtgcggctacaagacccacgccgactacaacgctgccaagaacatcgcaacatacgacatcgagaacatcatcaacaagcagttggcggttcagtcgaagctccacagcaaaaagtgtatggaggagtacatcgaggagttgggctatttggactag

SEQ ID NO: 2713 - DNA, 1356 bp, Unknown
  Bacillus sp. multi
ctcggggtgactattaagatcatgaagtaccagatcctctgccctatgaacgtcgattggaccatcttcgagaagcacctccgaaacctcacctaccaagtgagaaccataagtaaccgtactatccagcaactctgggagttcgacgcgctgtccttcgactacttcaaggagcgcgggacataccccacggtccaggacttgtacggctgcactcagaagaagattgacggctatatctaccataccctgcaaagtaagtatcccgacatccacaagggcaatatgagcacaactctccaaaaaatcatcaagacttggaaatcacgtcgtaatgagatccgcaaaggcgagatgtccatcccgagcttccgcaaccgcatacccatcgacctacacaacaattccgttgatattactaaggagaagaatggggactacatcgcggggatttcactctttagccgagacttccacaaggagaacgatgatgttcctaaaggcaaaatcttcgttaagctcgctactcagaagcagaagtccatgaaggtcattcttgaccgactgatgaaccagacgtacagtaagggagcgtgcatgatacacaagtacaagaacaagtggtatttgagcattacctacaagttcaacgcgatcaaggaaaaaaagttcgacaaggagttgataatggggatcgacatgggtgggatcaacacggtgtacttcgcgttcaacgagggattcataaggagcaacattaagtcggacgagatcaaggagttcaacgaacgaatcagacaacgacgcatcaatttgctgaaccagtccaaatattgcagtaactcccgcacaggcaaggggaggactaagcgcctccagcccattgacgtcctgtccaataagatcgccaaattccggaactccacaaaccacaagtacgccaactacatcattaagcagtgcctaaagtacaattgcgggcgcatccaaatggagctgctaaaggggataagcaagaacgataaggtgctaaaggactggacgtacttcgacctacaggagaagatcaaaaaccaggcggagatccacggcatcgaggtgattaaggtggccccagcatacacctcgcagaggtgctcccagtgcgggtacatctgcaaggaaaatcggtgcactcaggcaatgttcgagtgcaagcagtgcggatacaaaactcatgccgactacaacgctgccaagaatatcgccacgtacgacattgagaacatcatcaacaagcaattggcggtgcagagtaagctccacagcaaaaaatgcatggaggagtacatcgaggaactcggttatctcgattag

SEQ ID NO: 2714 - DNA, 1356 bp, Unknown
  Bacillus sp. multi
ctcggggtgaccatcaagattatgaagtaccagatcctctgccccatgaacgttgactggacgatcttcgagaagcacctccgtaacctgacctaccaagtccgcactatcagcaaccgaaccatccagcagctttgggagttcgacgcccttagtttcgactacttcaaggagcgcggcacctatccgacggttcaagacctatacggctgcacccagaagaagatcgacgggtacatctatcataccttgcagtccaaatacccggacatacacaagggcaatatgtccaccaccctacagaagatcatcaagacatggaaaagtcgtcggaacgagatcaggaagggtgagatgtcgataccctccttccggaaccgaatccccatcgacctgcacaataactccgttgacattactaaggaaaaaaatggagactacatcgctggtatctccctattctctagggacttccataaggaaaacgacgacgtgccaaagggcaaaatcttcgtcaagttggccacccagaagcagaaatctatgaaggtgatcttggatcgccttatgaaccagacctacagcaaaggagcctgcatgatccacaagtacaaaaacaaatggtatcttagtatcacctacaaattcaacgctatcaaggagaagaagtttgacaaggagctgattatggggatcgacatgggtggcatcaacaccgtttacttcgcctttaacgagggcttcatacgctcaaacatcaagagcgacgagatcaaggagttcaatgagcgaatcagacagaggcgtatcaacttgcttaaccagagcaagtactgctccaactcgcggacaggaaagggccgcacgaagcgcttgcagccaattgacgtattgagtaacaagatcgccaagttccgaaactccaccaaccacaagtacgcaaattacatcatcaagcagtgccttaagtacaactgcggcagaatccagatggagctattgaagggcatctccaagaacgacaaggtgcttaaagactggacctacttcgatctacaggagaagatcaaaaaccaggctgagatccacggtattgaggtcatcaaggtcgctcccgcctacaccagtcagcggtgcagtcagtgcggctacatctgcaaggagaacagatgcactcaggcgatgttcgagtgcaagcagtgcgggtacaagacccacgctgactacaacgccgccaagaacattgccacctacgacattgaaaacatcatcaacaaacaactcgccgtccaaagtaaactgcacagcaaaaaatgcatggaggagtacatcgaggagttgggctacctcgactga

SEQ ID NO: 2715 - DNA, 1356 bp, Unknown
  Bacillus sp. multi
ttgggtgtaaccatcaagatcatgaagtaccagatactgtgccccatgaacgtggactggactatcttcgagaaacacctccggaacctcacataccaagtgaggaccatcagtaaccgcacgatccagcaactctgggagttcgacgctctctccttcgactacttcaaggagcgaggcacataccccactgtccaggacttgtacggatgcacgcaaaaaaaaatcgacggctacatctaccacacattacagtccaagtacccagacatccacaagggcaacatgagtacaaccctccagaagatcatcaagacctggaagtcgagaaggaatgagatacgaaagggcgagatgagcatcccgtccttcagaaaccgcattccaatagacctccacaacaactccgtggacatcattaaggagaagaacggggactacatcgcgggtatctcccttttcagtagggatttccacaaggagaacggcgacgtcccgaagggcaaaatcttcgtgaagctcggcacccagaagcagaagtctatgaaggttatcttggaccgtcttatcaaccagacctactcaaaaggagcttgcatgatacacaagtacaagaataagtggtacttgagcataacgtacaaattcaacgccatcaaggagaacaagttcgacaaggaacttatcatgggcattgacatgggtggcatcaacacagtttacttcgctttcaacgagggcttcattcggagcaacattaagagtgacgagatcaagatgttcaacgagcgaatccgtcagcggcgcatcaacctcctcaagcagtccaaatattgttccaactcccgcaccggcaaggggcggaccaagaggctacagcccattgatgtcctctccaacaagatagccaagttccgaaattctacgaatcacaagtacgccaactacatcatcaagcaatgcctaaaacacaactgcggtcgtatccagatggagctactcaagggcatctctaagaacgacaaggtgcttaaggactggacttacttcgacctacaggagaagatcaaaaaccaggccgagattcatgggatagaggttattaaggtggcccctgcctacacaagccagcgctgctcgcagtgcggctacatctgcaaggaaaatcgctgcacccaggccatgttcgagtgcaagcagtgcggttacaagacccacgcggactacaacgcggctaagaacatcgcaacctacgacattgaaaacattatcaacaaacagctcgccgtgcagtccaagctgcactccaagaaatgcatggaggagtacatcgaggaactcggttacctcgactga

SEQ ID NO: 2716 - DNA, 1356 bp, Unknown
  Bacillus sp. multi
ttgggagtcactatcaagatcatgaagtaccagatcctctgcccgatgaacgtggattggaccatcttcgagaaacacctgaggaacctgacctaccaagtccggacaatttcaaaccgcaccatccaacagttgtgggagttcgacgcgctctcattcgactacttcaaggaacgtggcacgtacccgacggtccaagacctgtacggttgcacccagaagaagatcgacggctatatctaccacacgctccagagtaagtatcccgacatccacaaggggaatatgtcaactacgctccagaagatcatcaagacgtggaaatcacgccgaaacgagatcaggaaaggagagatgagcatcccatccttccggaaccgcattcctatcgacctccacaacaacagcgtggacattatcaaggaaaaaaatggggactacattgccgggatctcactattctctcgggacttccacaaggagaacggagatgtgcctaaaggcaaaatcttcgtgaaactgggaacccagaagcagaagtctatgaaggtcatactggatcgccttatcaaccagacctacagtaaaggtgcgtgcatgatacacaagtacaagaacaagtggtatctatccataacctacaaattcaacgctatcaaggagaacaagttcgacaaggagcttatcatgggcattgacatgggcggcatcaacacggtgtactttgccttcaacgaggggttcatccgctccaatatcaagagcgacgagatcaagatgttcaacgaacgaatacgacagcggcgcatcaacttgctcaagcagtccaaatattgctcaaactccaggactggcaagggccgcactaaacgcctccagcctatcgacgtgctgtccaacaagatagccaaattcagaaatagcacaaaccacaagtacgcgaactacatcatcaagcagtgtttaaaacacaactgcgggcgcatacaaatggaattgctgaaagggatctccaagaacgataaggtgctcaaggactggacctacttcgacctccaggagaagatcaaaaaccaggccgagattcacgggatcgaggtcattaaggtcgcccctgcctacacaagccagaggtgctcccagtgtggctacatctgcaaggagaatcggtgcactcaagcaatgttcgagtgcaaacagtgcgggtacaagacacacgctgactacaatgccgccaagaacatcgctacctacgatattgagaacatcatcaacaagcagttggcagttcagagtaagctccattccaagaagtgtatggaggagtacatcgaggagcttggctacctggactag

SEQ ID NO: 2717 - DNA, 1356 bp, Unknown
  Bacillus sp. multi
ctcggcgtcactatcaagattatgaagtaccagatcctgtgccccatgaacgtggattggaccatcttcgaaaagcacctccggaaccttacctaccaagtgcggaccatatcgaaccggaccatccagcagctctgggagttcgacgcgctgtctttcgactacttcaaggaacgcggaacgtaccctaccgtccaagacctttacggatgcacccaaaaaaagatcgacggctacatctatcatacccttcaaagtaagtacccagacatccacaagggcaatatgtcaaccaccctccagaagatcattaagacctggaaatcacgtcggaacgagatacgcaagggtgaaatgtccatcccgtccttccggaaccgcattccgattgacctccacaacaactctgtggacattatcaaggagaagaacggggactacatcgccgggatctcgttgttctccagggacttccacaaggagaacggagatgtgcctaagggcaagatattcgtgaaactcggaacacagaagcagaaaagtatgaaggtgatcctggatcgtcttatcaaccagacttactcaaaaggagcttgcatgatccacaagtacaagaataagtggtacttgtccatcacctacaagttcaacgccatcaaggaaaacaagttcgacaaggagcttatcatggggattgacatgggtgggatcaataccgtgtacttcgcattcaacgagggcttcatccgcagtaacatcaagtctgacgagatcaagatgtttaacgagcgcatccggcaaaggcgcatcaacctcttgaaacaaagcaagtattgctcaaattcacgcactggaaaggggcgcaccaaacgactccagccaatcgacgtgctgtcaaacaagatagccaagttccgtaacagcactaaccacaagtatgctaactacattatcaagcagtgcctcaagcacaactgcgggcgcatccagatggagttactaaaggggataagcaagaacgataaggttctcaaagactggacctacttcgacctacaggaaaaaatcaagaatcaggccgagatacacggcatcgaggtcatcaaggtggcaccagcctacacctcccagcgatgcagccagtgcggctatatctgtaaggagaaccgctgcacccaagccatgttcgaatgtaagcagtgcgggtacaagacgcacgctgactacaacgcggccaagaacatcgcaacctacgacatcgagaacatcatcaacaaacaactcgcagtccagtcaaaactgcacagcaaaaagtgtatggaggagtacatcgaggagcttggctacctcgattga

SEQ ID NO: 2718 - DNA, 1356 bp, Unknown
  Bacillus sp. multi
ctcggggtgacgatcaagatcatgaagtaccagatcctctgccccatgaacgtggactggaccatcttcgagaagcacttgcggaacctcacgtaccaagtacggacaatctccaatcggactatccagcagctctgggagttcgatgcgctctccttcgactacttcaaggagcgaggcacctaccctaccgtccaggatctatacggatgcacacagaagaaaatcgacggctacatctatcacactttgcagtcaaagtaccctgacatccacaagggcaatatgagtaccacccttcagaagatcattaagacttggaaatcacggcgtaacgagatacgaaagggagagatgagcatccccagtttccgcaacagaatacccatcgacctccacaacaacagcgtggacattatcaaggagaagaatggggactatatcgcgggcatctcattgttctctcgggacttccacaaggagaatggcgacgttccgaagggcaagatattcgtaaagctcgggacacagaagcagaagtctatgaaggtgatccttgaccgcctcatcaaccagacctatagcaaaggcgcgtgcatgatccacaagtacaaaaacaagtggtacttgagtatcacgtacaagttcaacgcgatcaaggagaacaagttcgataaggagcttatcatgggcattgacatgggcggcattaacaccgtgtacttcgccttcaacgaggggttcattcggtccaacatcaagtcggacgagattaagatgttcaacgaacgcatcaggcaacgccggatcaacttacttaaacagtccaaatattgttcaaattcgcgtacaggcaagggtcggactaaacgacttcagcccattgacgtgctctccaacaagatcgccaaattccgtaacagcacaaaccacaagtacgccaactacatcattaagcagtgtctcaagcacaactgcgggcgtatccagatggagctacttaagggtatcagcaagaacgacaaggtgcttaaagattggacttacttcgacctccaggaaaaaatcaagaatcaggccgagattcacgggattgaggtgattaaggttgctccagcttacacctcacagaggtgctcccagtgcgggtacatctgtaaggagaaccggtgtacccaagctatgttcgaatgcaagcagtgcggttacaagacccacgccgactacaacgctgccaagaacattgcaacctacgacatcgaaaacatcattaacaagcaattggcagttcagagcaaactgcattccaaaaagtgtatggaggagtacatcgaggaacttggctatcttgactga

SEQ ID NO: 2719 - DNA, 1356 bp, Unknown
  Bacillus sp. multi
ctgggtgttacgatcaagatcatgaagtaccagatcctttgccctatgaacgtggactggaccatattcgagaagcacctcaggaacctgacctaccaagtcaggactatctccaaccgcacgatccagcagctctgggagttcgacgcactctcattcgattacttcaaggaacgtggcacttaccccaccgtccaagacctctacggctgcacccagaagaagattgacggctacatataccacactcttcagtccaagtacccggatattcataagggcaatatgtcaacgacgctccaaaaaatcatcaagacttggaaatcccggaggaacgagatccggaaaggtgaaatgagcatcccatccttccgaaacaggataccaattgatctacacaacaactcagtggacatcatcaaggagaagaacggcgactacatcgcgggcatctcgttattcagtcgagacttccacaaggaaaacggtgacgtgccgaagggcaagatattcgttaaactcggtacgcaaaagcagaagtccatgaaggtgatccttgacaggctcattaaccagacgtacagcaaaggtgcttgcatgatccacaagtacaagaataagtggtacttgagcatcacctacaaattcaacgctatcaaggaaaacaaattcgacaaggagcttatcatggggatcgacatgggagggatcaacaccgtgtactttgccttcaacgaggggttcattcggagtaacatcaagtccgacgagatcaagatgttcaacgagcgaatccgccagaggcgcatcaacctattgaagcagtccaagtattgctccaactctcgcaccggcaaggggcggactaaacgtcttcagcccattgacgtgcttagcaacaagatagccaaattccggaactctaccaaccacaagtacgccaactacatcatcaagcagtgccttaaacacaactgcggaaggatacagatggaattgctcaagggtatttccaagaacgacaaggtgttgaaagactggacctacttcgatctacaggagaagatcaaaaaccaggcggagattcacgggatcgaggtcattaaggtggctcccgcatacacctcccagcgttgcagccagtgcgggtatatctgtaaggagaaccgctgcacccaggcgatgttcgagtgcaagcagtgcggatacaagacgcacgcagactacaacgccgccaagaatatcgccacctatgatattgagaacattatcaataagcagctcgccgtgcagagcaaactccactccaagaagtgtatggaggagtacatcgaggagttgggttacctcgactag

SEQ ID NO: 2720 - DNA, 1356 bp, Unknown
  Bacillus sp. multi
cttggggtgactatcaagatcatgaagtaccagatcctgtgtcctatgaacgtggactggactatcttcgagaagcacctccgtaacttgacctaccaagtgcgaaccatctccaaccgcactatccagcagctctgggagttcgacgccctcagcttcgactactttaaggagcgaggcacctacccgaccgtccaagacctctatggctgcacgcagaagaaaatcgacggttacatctaccacacccttcagtcgaagtaccccgacatccacaagggcaacatgagcaccaccttgcagaagattattaagacttggaaatctcggcgcaatgagatccgcaagggagagatgagtatcccctccttccgaaaccgtatccctattgatctgcacaacaattccgtggacatcatcaaggagaagaacggcgactacatcgccgggattagcctgttcctacgagacttccacaaggagaacggggacgtgccgaaaggcaagatattcgtcaagctcggaacacagaagcagaagtcgatgaaggtgatcctcgacaggctgataaaccagacctacagcaaaggtgcctgcatgattcacaagtacaagaataagtggtatctgtcaatcacctacaagttcaacgccatcaaggagaacaaattcgacaaggagttaatcatggggatagacatgggcgggataaacacggtgtacttcgctttcaatgaggggttcatacgcagtaacatcaagagcgacgagatcaagatgttcaacgaacgtattcgccagaggcgtatcaacctcctcaagcagtccaagtactgttccaattcacgcaccggcaaaggccggacaaaacgccttcagccaatagacgtgctctcgaacaagatcgccaaattccgaaactccacgaaccacaagtacgctaactatatcatcaagcagtgcttgaaacacaactgcggacggattcaaatggagttgctcaaggggatctccaagaacgacaaggtgttgaaagactggacttacttcgacctacaggagaagatcaaaaaccaggccgagattcacgggatcgaggtcatcaaggttgctccggcatacacctcgcagaggtgctcacagtgcggctacatctgcaaggaaaatcgctgcacccaagccatgttcgaatgtaagcaatgcgggtacaagactcacgccgactacaacgcggctaagaacatcgcaacctatgacattgagaacatcatcaataagcagttagccgtgcagagtaagttgcactccaagaagtgtatggaggagtacattgaggaacttggatacctcgactag

SEQ ID NO: 2721 - DNA, 1356 bp, Unknown
  Bacillus sp. multi
ctgggagtgactatcaagatcatgaagtaccaaatcctatgccccatgaacgtggattggaccatcttcgagaagcacctcaggaacctcacgtaccaagtgcgtaccatcagcaaccggaccatccagcagctctgggagtttgacgccctttcgttcgactacttcaaggagcgcggcacgtaccctacggtacaagacctttatgggtgtacccaaaaaaagattgacgggtacatctaccacaccctccagtccaagtatcctgacatccataagggcaatatgtccaccacactccagaagatcatcaagacttggaaatctcgccgcaacgagatacgaaaaggcgaaatgtcgatacccagtttccggaacagaataccgattgacttgcacaacaattccgttgacatcatcaaggagaagaacggcgactacattgctggaatctcactgttcctacgcgacttccacaaggagaacggcgatgtgccaaaggggaaaatcttcgtgaagctcggtacgcagaaacaaaagtcgatgaaggtcatcttggatcgcttgataaaccagacgtactcaaaaggtgcgtgcatgatccacaagtacaagaataagtggtatctctcaattacctacaaattcaacgcgatcaaggagaacaagttcgacaaggagcttatcatggggatcgacatgggcggtatcaatactgtgtacttcgccttcaacgagggcttcatccggtccaacattaagtccgacgagatcaagatgttcaacgagcgcataaggcaacgccgcattaacctcctcaagcagagcaagtactgctccaactctcgcaccgggaaagggcgtaccaagaggcttcagcccattgacgtgctcagcaacaagatcgccaagttccgcaactctacgaaccataagtatgccaactacatcatcaagcagtgcttaaagcacaactgcgggcgcatccagatggagctattgaaggggatctctaagaacgacaaggtgctgaaagactggacctatttcgacctccaggagaagatcaaaaaccaggccgagatccacgggattgaagtcattaaggtggctccagcttacaccagtcagcggtgctcccagtgcgggtacatctgtaaggaaaaccgctgtacccaggccatgttcgagtgcaagcaatgcggatacaagacccacgccgactacaacgccgctaagaatatcgcaacttacgacattgagaacatcatcaacaagcaactcgctgtacagtctaagctacactccaaaaagtgtatggaggagtacattgaggaactgggctaccttgactag

SEQ ID NO: 2722 - DNA, 1356 bp, Unknown
  Bacillus sp. multi
ctaggggtgaccatcaagatcatgaagtaccagatattgtgccccatgaacgtggactggaccatattcgagaagcacctgagaaacctaacttatcaagtcagaactatatccaaccgaaccatccagcagctctgggagttcgacgccctgagcttcgactacttcaaggaacgaggcacctacccgaccgtccaggacttgtacggctgcacccagaagaaaatcgacggctacatctaccacaccctacagtccaagtaccccgacatccacaagggcaatatgtcaaccaccttgcaaaaaatcatcaagacttggaaatctaggaggaacgagatcaggaagggcgagatgtctattccatcctttcgtaatcgcatccctatagacctccacaacaacagtgtggacatcatcaaggagaagaatggggattacatcgctgggatctcacttttcctgcgagacttccacaaggagaacggcgacgtgccaaaggggaagatattcgtaaagttggggactcaaaagcagaagtccatgaaggtgatccttgaccgccttattaaccagacctactctaaaggggcttgcatgattcacaagtacaagaacaagtggtatctctctattacatacaagttcaatgctattaaggagaacaaattcgacaaggagctaatcatgggaattgacatgggagggatcaacacggtgtacttcgccttcaacgaggggttcataaggtcgaacatcaagagcgacgagatcaagatgttcaacgagcgaatccggcagaggcgtatcaaccttctcaagcagtcgaaatactgttccaactccaggaccggaaaaggccggactaagcgtctccagccaatcgacgtgctaagcaacaagatcgccaaattccgcaatagcaccaaccacaagtatgcgaactacatcatcaagcagtgcctaaagcacaactgcggccgtatccagatggaactactcaagggtatatctaagaatgacaaggtgctcaaggactggacctacttcgacctccaggagaagatcaaaaaccaggcggagatccacggcatcgaagtcatcaaggttgctccagcatacacgagccagcggtgctcacaatgcgggtatatctgcaaggagaaccggtgcacccaggccatgttcgaatgcaagcagtgcgggtacaagacccatgcagactacaacgcggccaagaatatcgccacctacgatattgagaacatcatcaacaagcagttggcggtgcagtccaagctacactccaaaaagtgtatggaggagtacatcgaggaattgggctacttggactaa

SEQ ID NO: 2723 - DNA, 1356 bp, Unknown
  Bacillus sp. multi
ctaggcgtcacgattaagatcatgaagtaccagatcctgtgcccgatgaacgtggattggacgatattcgagaaacacctccgcaatctcacataccaagtccggaccatctccaaccgaaccatccagcagctctgggagttcgacgcactgagcttcgactacttcaaggagcgtggaacataccccacagtccaagacctctacggatgcactcagaagaaaatcgacggctatatctatcacacgcttcagtctaagtaccccgacattcacaaggggaatatgtccacaaccctacagaagatcatcaagacttggaaaagtaggaggaacgagattcggaaaggagaaatgagcattccctcctttcggaaccggattcctatcgaccttcacaacaactccgtggacatcatcaaggaaaaaaacggggactacatcgcgggtatctcactgttcctcagggacttccacaaggagaacggggacgtgcctaaggggaaaatcttcgtcaagctcggaactcagaagcagaagtccatgaaggtgatcttggaccgccttatcaaccagacctacagcaagggcgcttgcatgattcacaagtacaagaacaagtggtacttgtctatcacgtacaaattcaacgctatcaaggagaacaaattcgacaaggaacttatcatgggcatcgacatgggcgggataaacaccgtttacttcgcgttcaacgaagggttcatacgctccaacatcaagtccgacgagattaagatgttcaacgaacgaatacggcagcgccgtatcaacttgctcaagcagtccaaatattgctcaaactcccgaacgggaaaaggccgcactaaaaggttgcagccaattgacgtcctttccaacaagatcgccaagttccgtaatagcacgaatcacaagtacgccaactacatcatcaagcagtgcttgaaacacaactgtggccgtatccaaatggagctgctaaaagggatcagcaagaacgacaaggtgctcaaggactggacctacttcgacctccaggaaaaaatcaagaaccaggcggagattcatggcatcgaggtgattaaggtggcaccagcatatacctcacagcgatgctcgcagtgcggttacatctgcaaggagaaccgctgcacccaagctatgttcgagtgtaagcagtgcgggtacaagacccacgccgactacaacgccgccaagaacatcgccacgtatgacatcgagaacatcattaacaagcagctcgccgtacagtcgaaactccactccaagaaatgcatggaggagtatatcgaggaactgggctacttagactga

SEQ ID NO: 2724 - DNA, 1356 bp, Unknown
  Bacillus sp. multi
cttggagtgacgattaagatcatgaagtaccagatcctctgccccatgaacgttgactggacgatcttcgagaagcacctccgcaacctcacctaccaagtccgcacaatctccaaccggacgatccagcagctttgggagttcgacgccctgagcttcgactatttcaaagagcgcggtacttatcccactgtccaagacctttacggctgcacccaaaaaaaaatcgacggctacatctaccacaccctccagtccaagtaccccgacatccacaaggggaatatgagcaccaccctacagaagattattaagacttggaagtcacgcagaaatgagatccgcaaaggagaaatgtcaatcccctccttccgcaaccggattcccatcgaccttcacaacaactccgtggacatcatcaaggagaagaatggagactacattgctggtatctccctgttcctgagggactttcacaaggaaaacggtgatgtcccgaagggcaaaatcttcgtgaagctcgggactcagaagcagaagtccatgaaggtgattctggacaggcttatcaaccagacctactcgaaaggtgcctgcatgatccacaagtacaagaacaaatggtacttgagtatcacgtacaaattcaacgctatcaaggagaacaaattcgacaaggagttaatcatgggaattgacatgggagggatcaacactgtgtacttcgccttcaacgaggggttcatccgctccaacatcaagtccgacgagatcaagatgttcaacgagcgaatacgccaacgccggatcaatctccttaaacagtccaagtattgcagcaactcacgcactggcaagggaaggaccaagcgacttcaacctattgacgtcttgagcaataagatcgcaaagttccgcaacagcacaaaccacaagtacgcgaactacatcatcaagcagtgcttgaagcacaactgtgggaggatacagatggagttgttaaagggtatctccaagaatgacaaagttcttaaagactggacctacttcgacctccaggagaagatcaaaaaccaggcagagattcacggcatcgaggtgattaaggtggcacccgcctacacgagccagcgttgctcacagtgcggctacatctgtaaggagaaccgctgcacacaggctatgttcgaatgcaagcagtgtggctacaaaacgcacgcggactacaatgccgctaagaatatcgccacttacgacattgagaacatcatcaacaagcaactcgctgtacagtccaagttacactccaagaagtgtatggaggagtacatcgaggagctgggatacctcgactga

SEQ ID NO: 2725 - DNA, 1356 bp, Unknown
  Bacillus sp. multi
ctcggggtgaccatcaagatcatgaagtaccagattctgtgccccatgaacgtggactggacaatcttcgagaagcacctccgcaacctcacataccaagttagaacaatcagcaaccgcacgatccagcagctctgggagttcgacgccctctccttcgactacttcaaggagcgcgggacatacccaaccgtccaagacctgtacggctgcacccagaagaagatcgacgggtacatctaccacacgctccaatccaagtaccccgacatccacaagggaaacatgagcacgaccttgcaaaaaatcattaagacgtggaaatcacgtcgcaacgagatccgcaaaggagaaatgtccatcccctctttccggaaccgcatccctatcgacctccataacaactccgtggacatcattaaggagaagaacggcgactacatcgcggggatctccctattctccagggacttccacaaggagaacggtgacgttccaaagggcaaaatcttcgttaagctcggtactcagaagcagaagtcgatgaaggtcattctggatcgcctcattaaccagacatactccaaaggagcttgcatgatccacaagtacaagaacaagtggtatctaagtatcacttacaagttcaacgccattaaggagaacaaattcgacaaggagttaatcatgggcatcgacatgggcggtatcaacaccgtttacttcgctttcaacgaggggttcattcgatccaacatcaagtcagatgagattaagatgttcaacgagcgcatcaggcagcggcggatcaacctgcttaaacaatccaagtactactcaaactctcgtaccggaaagggccgcactaagcgactacagcccattgacgtgctctcaaacaaaatcgctaagttccgaaactctaccaaccataagtacgcaaactacatcatcaagcaatgtctcaagcacaactgtggtcgtattcagatggagctacttaaggggataagcaagaacgacaaggtgctcaaagactggacctacttcgacctacaggaaaaaatcaagaatcaggctgagatccacgggatagaggttattaaggtggcccctgcctacacatcacagaggtgtagccagtgcgggtacatctgcaaggaaaaccggtgcacccaggccatgttcgaatgcaagcagtgcggctacaagacccacgccgactacaacgccgctaagaacatcgccacctacgacatcgagaacatcattaacaagcaacttgccgtgcagtcaaagctgcacagcaaaaaatgcatggaggagtacattgaggagttgggctacctcgattag

SEQ ID NO: 2726 - DNA, 1356 bp, Unknown
  Bacillus sp. multi
ctgggcgtcactatcaagattatgaagtaccagatcctctgccccatgaacgtcgattggaccatcttcgagaagcacctccgcaacttgacctaccaagttcggaccatctccaacaggactatccaacagctttgggagttcgacgccttgtccttcgactatttcaaggagcgcggaacctatcctaccgtgcaagacctgtacgggtgcacacagaagaaaatcgacgggtatatctatcacaccctccaatccaagtaccccgacatccacaagggcaatatgagcaccaccctccagaaaatcatcaagacctggaaatcccgccgcaacgagatacgaaaaggtgaaatgtccatcccctcgttccgaaaccgcatccccatcgacttgcacaataacagcgtggacattatcaaggagaagaacggagattacatcgctggaatctcacttttcagtagagacttccacaaggagaatggcgacgtgcctaaggggaagatattcgtgaaattgggcacacagaagcagaagtctatgaaggtgatcctcgacaggctcatcaaccagacgtacagcaaaggcgcttgcatgatccacaagtacaaaaacaagtggtacttgtcgataacatacaaattcaacgccattaaggaaaacaaattcgacaaggaacttatcatgggcattgacatgggtggcattaacacggtgtactttgcgttcaacgagggcttcatccgttccaacatcaagtccgatgagattaagatgttcaacgagcgtatccgccagcgtcggatcaacctccttaagcagtccaagtactacagtaactcccggacagggaagggccgcaccaaacgcttgcagcctattgatgtgctttccaacaagattgcaaagttccgaaactctactaaccataagtacgcaaactacatcattaagcagtgcttgaagcacaactgtggcagaatccagatggaactcctcaaggggatcagtaagaacgacaaggtgctcaaggactggacttacttcgacctccaggagaagatcaaaaaccaggccgagatacacggaattgaggtcatcaaggtggctccagcatacacatcccagcgctgtagccagtgcggctacatctgcaaggagaaccgttgcacccaggccatgttcgagtgtaagcagtgcggctacaagactcacgccgactacaacgccgccaagaacatcgccacctacgacatcgagaacattatcaataagcagcttgcggtgcagtccaaattacattccaaaaagtgtatggaggagtacatcgaggaattgggctacctcgactag

SEQ ID NO: 2727 - DNA, 1356 bp, Unknown
  Bacillus sp. multi
ctaggagtgactatcaagatcatgaagtaccagatactgtgcccgatgaacgtggactggacgatcttcgagaagcacctcagaaacctcacgtaccaagttcggactatttccaacagaactatccagcagctatgggagttcgacgccttgagcttcgactacttcaaagagcgcggaacctacccgaccgtgcaagacctctacggttgcacccagaagaagatcgacgggtacatctaccacacccttcaatcgaagtaccccgacatacacaaaggcaatatgagcacgaccctccagaaaatcatcaagacctggaagtcccggcggaacgagattcgcaagggcgaaatgtcgatcccgtccttccgcaacaggatacctatcgacctacacaataactctgttgacattatcaaggaaaaaaacggcgactacatcgccgggatcagcctgttctccagagacttccacaaggagaacggggatgtgcctaagggcaagatattcgtaaagctcggaactcagaagcagaagtccatgaaggtgatccttgaccgcctcatcaatcagacctacagtaagggtgcctgcatgatccacaagtacaagaacaagtggtatctatcaatcacctacaagttcaacgctattaaggagaacaagttcgacaaggaactaatcatgggcatcgacatgggtgggataaacacagtttacttcgccttcaacgagggcttcattcggtcaaacatcaagtccgacgagattaagatgttcaacgagcgcatcagacagaggcgtatcaacctcctcaagcagtccaaatattattcaaattctcgtaccgggaaggggagaacaaaacgtctccagcctattgacgtccttagtaacaagattgccaaattccgtaacagcaccaaccacaagtatgccaactacatcatcaagcagtgcctaaagcacaactgtggccgcattcaaatggagcttctcaagggaatcagcaagaacgacaaggttctcaaggactggacctacttcgacctccaggagaagatcaaaaaccaggctgagatccacggtattgaggtcattaaggtcgcccctgcatatacttcccagcggtgctcccagtgcggctacatctgcaaggaaaaccggtgcacacaggccatgttcgaatgtaaacagtgcggatacaaaacccacgccgattacaacgctgccaagaatatcgcaacctacgacatcgagaacatcatcaacaagcagctcgcagtgcagagcaaactacactccaagaaatgcatggaggagtatatcgaggaattgggctatctcgactga

SEQ ID NO: 2728 - DNA, 1356 bp, Unknown
  Bacillus sp. multi
ctcggggtgactatcaagatcatgaagtaccagatcctctgcccgatgaacgtggattggactatcttcgagaagcacctccggaacctgacctatcaagtccgcaccatcagtaatcgcaccattcagcagctatgggagttcgacgccctgagtttcgactacttcaaggaaagaggaacataccccaccgtccaagacctgtacggctgcacgcagaagaaaatcgacggctacatctaccacaccttgcaatcgaagtatccagacatacacaaggggaatatgagtaccacgctccagaagatcattaagacatggaaatcgaggaggaacgagatccgaaagggcgagatgagcatacccagtttccgtaaccggattcctatcgacttgcacaacaactcggtggacatcattaaggagaagaacggggactacattgctggcatatccttgttctcgcgggacttccacaaggagaacggcgacgtcccgaagggcaagatattcgtaaagctgggcacccagaagcagaagtctatgaaggtgattctcgaccgactgattaaccagacctactcgaaaggagcgtgcatgatccacaagtacaagaataagtggtacttgagtatcacgtacaagttcaacgctattaaggaaaacaaattcgacaaggagctgataatgggaatagacatgggtgggatcaatactgtgtacttcgcattcaacgaagggttcatccgctccaacatcaagtcggacgagattaagatgttcaacgaacgcatacgccaacggaggatcaacttgcttaaacagtccaaatattactcaaatagtagaacagggaaggggcggaccaagcggctacagcctatagacgtgctgtccaacaagattgccaagttccgcaacagcactaatcacaagtacgccaactacatcatcaagcagtgcctcaagcacaactgcggtcggattcagatggagttactcaagggaatcagtaagaacgacaaggtgcttaaagactggacgtacttcgacctccaggagaagatcaaaaaccaggctgagatccacggcatcgaagttatcaaggtcgctcctgcatacacctcacagcgctgctcgcagtgtggttacatctgcaaggagaataggtgtacccaagctatgttcgagtgtaagcagtgcgggtacaaaacacacgccgactacaatgccgccaagaacattgccacatacgacatcgagaacatcatcaacaagcagcttgccgtgcagagcaagctccacagcaaaaagtgtatggaggagtacatcgaggagctgggttaccttgactga

SEQ ID NO: 2729 - DNA, 1356 bp, Unknown
  Bacillus sp. multi
ctcggcgtgaccatcaagatcatgaagtaccagatcctgtgcccgatgaacgtggactggactatcttcgagaagcacctccgcaacttgacttatcaagtacgaaccatcagcaaccggacgatccagcagctctgggagttcgacgctctgagctttgactacttcaaggagcggggcacctaccccactgtgcaagacctctacggttgcacccaaaaaaagatcgacggctacatctaccacacgctccagtcgaagtaccccgacatacacaagggcaatatgtcaaccaccttgcagaagattatcaagacctggaaatcacgcagaaacgagatccgtaagggagagatgagcatcccgagctttcggaaccgcatacctattgacttgcacaacaactcagttgacatcattaaggagaagaacggggactacatcgcgggtatctcacttttcagccgcgacttccacaaggagaacggggacgtgcctaagggcaaaatcttcgtcaaactcggaacgcagaagcagaaatctatgaaggtgattcttgaccggctgattaaccagacctactctaaaggggcttgcatgattcacaagtacaaaaacaaatggtatctgtccattacctacaagttcaatgcgatcaaggagaacaagttcgacaaggagctgattatgggaattgacatgggcgggattaacacagtgtactttgctttcaacgagggcttcatccggtccaatatcaagagcgacgagatcaagatgttcaacgagcgtatccgtcaaaggaggatcaacctgctcaagcagagcaaatattattccaattcacgcaccggcaaggggcgaacgaaacgtctccaacctattgacgtcctctcgaacaagattgcgaaattccgcaattcgaccaatcacaagtacgccaactacatcattaagcagtgccttaagcacaactgcggtcgtattcagatggaattacttaaggggatcagcaagaacgacaaggtgttgaaagactggacgtacttcgacctacaggaaaaaatcaagaatcaggcagagatccacggtattgaggttatcaaggtcgctccagcatacacctcgcagaggtgcagccagtgcggctacatctgcaaggagaaccggtgtacccaggcgatgttcgagtgcaagcagtgcgggtacaagactcacgcagactacaacgctgctaagaatatcgccacatacgacatcgagaacatcatcaacaagcaattggcagtccagagcaagctgcactccaagaaatgcatggaggagtacatcgaggagctggggtatctggactag

SEQ ID NO: 2730 - DNA, 1356 bp, Unknown
  Bacillus sp. multi
ctcggcgtcacgatcaagattatgaagtaccagatcctgtgccccatgaacgtggactggacgatcttcgagaaacacctccgcaacttaacgtaccaagttcgcaccatcagcaaccgaaccatccagcaactctgggagttcgatgccctgagcttcgattactttaaggaacgtggcacatatcctaccgtgcaagacctctacggctgcacgcagaagaaaatcgacgggtacatctaccacaccttgcagtccaaataccccgacatccacaagggcaatatgagcacaactctccaaaaaatcatcaagacatggaaatcccgccgcaacgagatacgcaagggcgaaatgagcatccccagcttccgcaacagaatacctatcgacctccacaacaactccgtggacatcatcaaggagaagaatggggactacatcgccgggatctcattgttctcaagggacttccataaggaaaatggggacgttccaaaggggaaaatcttcgttaagctcggaacgcagaagcagaagtctatgaaggtcatcttggacagactcatcaatcagacctacagtaaaggagcctgcatgatccacaagtacaagaacaagtggtatctcagtatcacttacaagttcaacgccattaaggagaacaaattcgacaaggagctgataatggggatcgacatgggcgggatcaataccgtgtactttgcattcaacgagggcttcattcgatccaacatcaagtctgacgagatcaagatgttcaacgagcggattcggcagagacgtatcaacctcttgaaacagtccaaatattgctcaaactcaagaactggcaagggacgaacaaagcgccttcagccaattgatgtgctctccaacaagatagctaagttcagaaactccaccaaccacaaatacgcgaactacatcattaagcagtgcctcaagcacaattgcggacgcatccagatggagttacttaaagggatttccaagaacgacaaggtgctcaaggactggacgtacttcgacctacaggaaaaaatcaagaatcaggcagagatacaccgcatcgaagttattaaggtggctccggcatacacctcgcagcgttgctcgcagtgcggctacatctgcaaggaaaaccgctgcactcaggctatgttcgagtgcaagcagtgcgggtacaagacccatgccgactacaacgccgccaagaatatcgccacgtacgatattgagaacattatcaacaaacagttagccgtccaatcgaagctgcacagcaaaaaatgcatggaggagtacatcgaggagttgggttacctggattga

SEQ ID NO: 2731 - DNA, 1356 bp, Unknown
  Bacillus sp. multi
ttgggcgtgacgatcaagatcatgaagtaccagatcctctgcccgatgaacgtggattggacgatcttcgagaagcacctccgcaatctcacctaccaagtgcgtacgatctccaacaggacgatccagcagctctgggagttcgacgccctctcgttcgactacttcaaggagcggggcacttaccccaccgtgcaagacctctacgggtgcactcagaagaagatcgacgggtacatctaccatacacttcaaagtaagtatcccgacatccacaaggggaatatgagcactactctccaaaaaatcatcaagacctggaaatcccgccgtaacgagatcaggaagggcgagatgagcatcccttccttccggaaccgaatcccgattgacctccacaataactccgtggacattatcaaggaaaaaaatggcgactacatcgccgggatcagcctgttctcaagggacttccataaggaaaacggcgacgtgccaaagggcaaaatcttcgtaaagctagggacgcagaagcagaagtccatgaaggtgatattagacaggcttattaaccagacatactctaaaggagcctgcatgatccacaagtacaaaaacaaatggtatctcagcatcacatacaagttcaacgctatcaaggagaacaaattcgacaaggagctaatcatggggatcgacatgggcgggataaacaccgtgtactttgccttcaacgaggggttcatacggtccaacatcaagagcgacgagatcaagatgttcaacgagcgcatccggcagaggcggatcaatctcctcaagcagtcgaaatactgctctaattcaaggaccggcaagggccggaccaaacgtcttcagcctatcgacgtcctgtccaacaagattgccaagttccgtaacagtacaaaccacaagtacgccaactacatcatcaagcagtgcttaaagcacaactgcggtagaatccaaatggaattactcaagggtatctctaagaacgacaaggttctcaaagattggacgtacttcgatctccaggagaagatcaaaaaccaggccgagatccacagaatcgaagttatcaaggtggcccctgcctataccagtcaaagatgctctcagtgcgggtacatctgcaaggagaaccgttgcacccaagcaatgttcgagtgcaagcagtgcggctacaagacccacgccgactacaatgctgccaagaacatcgcaacatacgacattgagaacattatcaacaagcagttagcagtgcagtctaagctccacagcaagaagtgtatggaggagtacattgaggagttgggctatttggactag

SEQ ID NO: 2732 - DNA, 1356 bp, Unknown
  Bacillus sp. multi
ttgggagtcacgattaagatcatgaagtatcagattctgtgccctatgaacgtggactggacgatattcgagaagcacctccgtaacctcacctaccaagtcaggactatctccaaccgtaccatccagcagctctgggagttcgacgccttatccttcgactacttcaaggagcgcggcacatacccaaccgtccaggacttgtacggatgcactcaaaaaaagatcgacggttacatataccacaccctccagtcgaagtatccggacatccacaaggggaatatgagtacgaccttacagaagattatcaagacttggaaatcccggaggaacgagatacggaagggagagatgtccattccttccttccgcaatcgaatccctatcgacctccacaacaacagcgttgacatcattaaggagaagaatggcgactacatcgctgggatctccctattctcacgggacttccacaaggagaacggggacgtgcctaagggcaaaatcttcgttaagctcgggactcagaagcagaagtcgatgaaggttatcctcgaccggcttatcaaccagacttactcgaagggtgcctgcatgatccacaagtacaagaacaagtggtatctctctattacctacaagttcaacgccattaaggagaacaaattcgacaaggagttgataatgggaattgatatgggtgggataaacaccgtgtacttcgcgttcaacgagggattcatcaggagcaacatcaagtccgatgagatcaagatgttcaacgagcgcatcaggcagcggcggatcaacctcctcaaacagagcaagtactgtagcaactcccggactggaaagggtcgtacaaagcgtctccagcctatcgacgttctcagcaataagattgccaagttccgcaactcgaccaaccacaagtacgcgaactacatcatcaagcagtgcctcaagcacaactgcggtcgtattcaaatggaattgcttaaggggatcagtaagaacgacaaggtgctgaaagattggacatacttcgatctccaggagaagatcaaaaaccaggccgagatccacagaattgaagttattaaggtggccccagcatacacatcgcagaggtgctcccagtgcgggtacatctgcaaggagaatcgttgcactcaggcaatgttcgaatgcaagcagtgcggttacaagactcacgccgactacaacgccgccaagaacatcgccacatacgacatcgagaacattatcaataagcagcttgcggtgcagagcaaactgcacagcaagaaatgcatggaggagtacatcgaggaactgggctacctggactag

SEQ ID NO: 2733 - DNA, 1356 bp, Unknown
  Bacillus sp. multi
cttggcgtcaccatcaagatcatgaagtaccagatcctctgccccatgaacgtggactggacgatcttcgagaagcacctccgcaacctcacctaccaagtgaggactatctctaatcggacaatccagcaactctgggagttcgacgcgctgagcttcgactacttcaaggagcgcggcacctaccctacagtccaagacctctatggttgcacccagaagaagatagacgggtatatctaccacacactacagagcaagtaccccgacatccacaaggggaatatgagcaccaccctccaaaaaatcatcaagacatggaaatctcgacggaacgagattcgtaagggagagatgtccatcccctccttccgaaaccgcatccctatcgacctgcacaacaactctgtggacattatcaaggagaagaatggtgactacatcgcggggatctcactgttcagccgggacttccacaaggagaacggagacgttccgaagggcaagatattcgtcaaattggggacacaaaagcagaagtctatgaaggtgatccttgacaggctcatcaaccagacctactccaaaggggcttgcatgatccacaagtacaagaacaaatggtacttgtcaatcacctacaagttcaacgccatcaaggagaacaagttcgacaaggaactcataatggggatcgacatgggagggatcaacaccgtctatttcgccttcaacgagggcttcatccggtccaacatcaagagtgacgagattaagatgttcaacgaacggataaggcagaggaggatcaatctgcttaaacagagcaagtattgctctaattcccgaacgggaaaggggaggaccaaaaggttgcagcccattgatgtacttagcaacaagatagccaaattccgcaactcgaccaaccacaagtacgctaactacattatcaagcagtgcctcaaacataactgtggacgtattcagatggaactgttgaagggtattagcaagaatgacaaggtgctcaaggactggacatacttcgacctacaggagaagatcaaaaaccaggcggaaatccacagaatcgaagttattaaggtcgccccagcctacaccagccaacgatgctcccagtgcggctatatctgtaaggagaaccggtgcacccaggccatgttcgagtgtaagcagtgcgggtacaagacccacgctgactacaacgcggccaagaacattgctacctacgacattgagaacatcattaacaagcagctcgccgtccaaagcaagctacactccaagaagtgtatggaggagtacatcgaggagctgggttacttggactga

SEQ ID NO: 2734 - DNA, 1356 bp, Unknown
  Bacillus sp. multi
ctcggggtcaccatcaagatcatgaagtaccagatcctctgccccatgaacgtggactggaccatcttcgagaagcacctccgtaatctcacctatcaagttagaactatctctaatcggacgattcagcagctttgggagtttgacgctctgtcgttcgactacttcaaggagcgcggtacttaccccaccgttcaagacctctacggttgcactcagaagaaaatcgacggctacatctaccacacccttcagtctaagtaccccgacatccacaaggggaatatgagtaccacgctccaaaaaatcattaagacctggaaatccaggcgcaacgagattcgtaagggtgagatgtccatcccttcattccgtaatcgcattccaattgacctccacaacaactccgtggacatcatcaaggaaaaaaacggcgactacatcgcgggcatcagccttttcagtagggactttcacaaggaaaacggagatgtgcctaaaggcaagatattcgttaagctcggcactcagaagcagaagtccatgaaggtcatcttggaccggctcatcaatcagacctacagtaagggagcctgcatgatccacaagtacaagaataagtggtacttgagcattacatacaagttcaacgccatcaaggagaacaagttcgacaaggaacttatcatggggattgacatgggtgggatcaacactgtgtacttcgctttcaacgaggggttcatccgctccaacatcaagtcagacgagatcaagatgttcaacgaacgaatcagacagcggcggataaacttgctcaagcagagcaaatattgctccaactcgcgtaccgggaaggggaggaccaagcgtctccagccaatagacgttctcagtaacaagatcgccaaattccgcaactccaccaaccacaagtacgcaaactacatcatcaagcagtgcctcaagcacaactgcgggagaatccagatggaactgcttaagggcatcagtaagaacgacaaagtgctcaaggactggacatacttcgacctccaggagaagatcaaaaaccaggccgagatccacagaattgaagtcatcaaggttgctccggcatacacctctcagaggtgctcgcaatgcggctacatctgcaaggagaaccgctgcacccaggctatgttcgaatgcaagcagtgcggatacaagacccatgcagactacaacgcggccaagaacatcgcaacttacgacattgagaacattatcaacaaacagcttgcggtgcagagcaaactgcactccaagaagtgtatggaggagtatatcgaggagctgggatacttagactga

SEQ ID NO: 2735 - DNA, 1335 bp, Unknown
  Bacillus sp. multi
atgaagtaccagatcctgtgccccatgaacgtggactggaccatcttcgagaagcacctccgcaacctgacctaccaagtgcgtaccatcagtaaccggaccatccagcagctctgggagttcgacgctctgtccttcgactatttcaaggccagaggaacttaccccaccgtgcaagacctctacggctgcacccagaagaagattgacggctacatctaccacaccctccagagcaagtaccccgacatccacaagggcaatatgagcaccaccctacagaaaatcatcaagacctggaagtcccggaggaacgaaatccgcaagggagagatgagcataccttccttccgcaaccggattcctattgacctccacaacaacagcgtggacatcacgaaggaaaaaaacggagactacattgccgggatctccttattcagtcgtgacttccacaaggagaacgacgacgtgcctaagggcaaaatcttcattaagctggcgacacagaagcagaagtccatgaaggtgatcctggaccgtctcattaaccagacttactcgaagggtgcctgcatgatccacaagtacaagaataagtggtatctatcaattacttacaagttcaacgccatcaaggagaacaaattcgacaaggagctgattatggggattgacatgggcgggatcaataccgtttacttcgccttcaacgaaggcttcataagatccaacatcaagagcgacgagatcaagacgttcaacgaacgcattagacagcgacggatcaatctcctcaaacagtccaagtattgttcgaactcaagaactggaaagggccgtacgaagcgtttacagcctatcgacgtgctctccaacaagattgccaagttccgtaatagcacaaaccacaagtacgcgaactacattatcaagcagtgtctcaagtacaattgcggacgtattcagatggagttattgaagggaatatccaagaacgataaggtgttgaacgactggacgtacttcgacctacaggagaagatcaaaaaccaggcagagatacacgggattgaggtgattaagatagcgcccgcctacacaagtcagagatgcagccaatgtggctacatctgcaaggagaaccgctgcacacaggctatgttcgagtgcaagcagtgcgggtacaagactcacgcggactacaacgcggccaagaacatctcgacctacgacattgagaacattatcaacaagcaactggccgtgcagtctaagttacacagcaaaaaatgcatggcagagtacatggaggaactgggctacctggactag

SEQ ID NO: 2736 - DNA, 1335 bp, Unknown
  Bacillus sp. multi
atgaagtaccagatcctttgccccatgaacgtggactggactatcttcgagaagcacctgaggaacttgacctaccaagttcgtacaatatcgaaccgcaccatccagcaactctgggagttcgacgccctgtccttcgactatttcaaagcccgaggcacataccccacagtccaagacttgtacgggtgcactcaaaaaaaaatcgacggctatatctatcacacattgcaatccaagtaccctgacatccataagggcaatatgtcaacaacgctacagaagattatcaagacgtggaaaagccgacgcaacgagatccgcaaaggcgagatgtcgattccatcctttcgcaacagaatcccaatcgacctgcacaacaactcggtggacatcactaaggagaagaatggggactacatcgccgggatcagcctgtttagtcgtgacttccacaaggagaacgatgatgttcctaagggcaagatattcatcaagctggcaacccagaagcagaagtctatgaaggtgatcttggacagacttatcaaccagacctactccaaaggagcctgcatgatccacaagtacaagaataagtggtatctgtcaattacctacaagttcaacgcgatcaaggagaacaaattcgacaaggagcttatcatgggaatcgacatgggcgggattaacactgtgtacttcgctttcaacgaggggttcatccggagtaacattaagtccgacgagatcaagaccttcaacgagcgcattcgccaacgccggattaacttgctcaagcaatccaagtattgctctaattcccgcacggggaagggccggacaaagcgtcttcagcccattgacgtgctgtcgaacaagatcgcaaagttccgcaacagcactaaccacaagtacgctaactacatcattaagcagtgcctcaagtacaattgcggtcggatacagatggagttgctaaagggcatctccaagaacgacaaggtgcttaacgactggacctacttcgacctccaggagaagatcaaaaaccaggcggagattcatggcattgaagtgattaagatagccccagcatacacctctcagaggtgctcgcagtgcggctacatctgcaaggagaaccgctgcacccaggctatgttcgagtgcaagcagtgcggctacaagacccacgccgactacaacgcagccaagaatatcagcacctacgacatcgagaacatcatcaacaagcaactagctgtgcagtccaagttgcactccaagaagtgtatggccgagtatatggaggagttgggctaccttgactga

SEQ ID NO: 2737 - DNA, 1335 bp, Unknown
  Bacillus sp. multi
atgaagtaccagatcctctgtccgatgaacgtggactggaccatcttcgagaaacacctccgaaacttgacttaccaagtcagaaccataagcaatcgcaccatccagcagttgtgggagttcgacgctctgagcttcgactacttcaaggcgcgcgggacttaccccaccgtccaagacctctatggctgcacccagaagaagatcgacggttacatctaccacaccctgcaaagcaagtaccccgacatccacaagggcaatatgagtaccacgcttcagaaaatcatcaagacttggaagtcgcggaggaacgagatccgcaagggagagatgagcatcccctcgttcagaaaccggataccaattgatctccacaacaactcggttgacattacgaaggaaaaaaacggagactacatcgcggggatcagcctcttcagccgagacttccacaaggagaacgacgacgtgccgaagggcaagatattcatcaagctggctacgcagaagcaaaagtccatgaaggtcatcttggaccggcttatcaatcagacctactccaaaggagcctgcatgatccacaagtacaaaaacaagtggtatcttagtatcacttacaaattcaacgccattaaggagaacaaattcgataaggagcttatcatggggatagacatgggcgggatcaacacagtttactttgctttcaacgaggggttcatccgcagtaacattaagagcgacgagattaagaccttcaacgagcgcatcagacaaaggcggataaacctccttaaacagtccaaatattgttccaattcccgcaccggaaagggacggaccaagcgcctacagcctatcgacgtgctttcgaacaagattgccaagttccgaaactctaccaaccacaagtatgcgaactacatcatcaagcaatgcttaaagtacaactgcggtcgtattcagatggaattgctcaaagggatcagcaagaatgacaaggtgttgaacgactggacctacttcgacctccaggagaagatcaaaaaccaggccgagatacacggtatcgaggtcatcaagatcgctcccgcttacacctctcagaggtgctcccagtgcgggtatatctgtaaggaaaatcgttgcactcaagccatgttcgagtgcaagcagtgcggatacaagacccacgcggattacaacgctgccaagaacatatccacctacgacattgagaacatcatcaacaagcaactagccgtgcagagtaaactccatagcaaaaagtgtatggccgagtacatggaggagcttggatacttagactga

SEQ ID NO: 2738 - DNA, 1335 bp, Unknown
  Bacillus sp. multi
atgaagtaccagatcctgtgccctatgaacgttgactggaccatcttcgagaagcacctccgcaacctaacgtaccaagttcggaccatctccaacaggacaatccaacagttgtgggagttcgacgcattgtccttcgactactttaaggcgcgtggaacttatccgacggtgcaagacctttacgggtgcacgcagaagaaaatcgacgggtacatctaccacacccttcagagcaagtaccccgacatccacaaggggaacatgagcaccacacttcaaaaaatcatcaagacctggaaatctcgccgtaacgagatccgcaagggcgaaatgagcatcccgtcattccggaaccgtattccaattgacctgcacaacaactccgttgacattactaaggagaagaatggggactacatcgccggtatatccctattctcacgggacttccacaaggagaacgacgatgttcctaaggggaagatattcatcaagttagcaacacagaagcagaagtctatgaaggtcattcttgaccgcctgataaaccagacgtacagcaagggagcctgcatgatccacaagtacaaaaacaaatggtacttgagtattacatacaagttcaacgctatcaaggaaaacaaattcgacaaggagcttatcatggggatcgacatgggtggtatcaatacggtgtacttcgccttcaacgaggggttcattcgttccaacattaagtccgacgagatcaagaccttcaacgagcgaatacgccagcgccggatcaacctcttaaagcagtccaaatactgttccaactcacgcacggggaaagggagaactaaacgtctccagcccatcgacgtcttaagcaataagatcgccaagttccggaatagtaccaaccacaagtatgcgaactacattatcaagcagtgccttaagtacaactgtggacgtatccaaatggagttgttaaaggggatcagcaagaacgacaaggtgcttaacgactggacctacttcgacctacaggagaagatcaaaaaccaggcggagatccacgggatcgaggtgattaagatcgcgccagcctacacaagccagcggtgcagccagtgcgggtacatctgcaaggagaacagatgcacccaagcaatgttcgagtgcaaacaatgcgggtacaaaacccatgctgactacaacgctgccaagaacatcagcacgtacgacatcgagaacattatcaacaaacagttagccgtccagtccaagctgcactccaaaaaatgcatggcggagtatatggaggaactgggctacctcgactga

SEQ ID NO: 2739 - DNA, 1335 bp, Unknown
  Bacillus sp. multi
atgaagtaccaaatcttgtgcccgatgaacgttgactggaccatcttcgagaagcaccttcggaacttgacctaccaagtccgtacgatcagcaaccgcacgattcagcagctctgggagttcgacgccctatcattcgactacttcaaggcgaggggcacctaccccaccgtgcaagacctctatggctgcacgcaaaaaaaaatcgacggctacatataccacaccctccagtctaagtacccggacatccacaaggggaatatgagcactacgctccagaaaatcatcaagacctggaagtctcggcgtaacgagatcaggaagggcgagatgagcatcccgagcttccgcaaccgcatccctatcgaccttcacaacaattcagtggacattactaaggagaagaatggggactacattgccgggataagtctattcagtcgtgacttccacaaggagaacgatgacgtcccgaaggggaaaatcttcatcaagctggctacccagaagcagaagtccatgaaggtgatcctagaccgacttatcaaccagacgtacagcaaaggtgcctgcatgattcacaagtacaagaacaagtggtatctatcaattacctacaagttcaacgctattaaggaaaacaaattcgacaaggagctaatcatggggattgacatgggagggatcaacaccgtgtactttgcgttcaacgagggcttcatcagatccaacattaagtccgacgagattaagaccttcaacgagcgtatcagacaaaggaggatcaatctactcaaacagtccaagtactgctcaaactcacggacaggaaaggggagaacgaaacgccttcagccaattgacgtcctctcaaacaagatcgccaaattccgtaatagcacgaaccacaagtacgcaaactacatcattaagcaatgccttaagtacaactgcgggcgcatacagatggagttgctgaaagggatcagtaagaacgataaggtgctgaatgactggacgtacttcgacctccaggagaagatcaaaaaccaggccgagattcacgggatcgaagtcatcaagatagctccggcctacacctcacaaaggtgcagtcagtgcggttacatctgcaaggagaatcggtgcacccaggccatgttcgagtgcaagcagtgcggctacaagacgcacgcggactacaacgccgccaagaacatatctacttacgacatcgagaacatcatcaacaagcagttggccgtgcagtcaaagttgcacagcaagaagtgtatggcagagtacatggaggagctgggataccttgactga

SEQ ID NO: 2740 - DNA, 1335 bp, Unknown
  Bacillus sp. multi
atgaagtaccaaatactttgccccatgaacgttgactggaccatattcgagaagcaccttcggaacctcacctaccaagtcaggactatctccaaccgcaccatccagcagttgtgggagttcgacgccctgtctttcgactacttcaaggccagaggaacttacccgaccgtccaagacttgtacggctgtacccaaaaaaagatcgacggttacatctaccatactctccaaagtaagtatccggacatccacaagggcaatatgagcacaactctccagaagatcatcaagacctggaagtcgcgccgcaacgaaatcaggaaaggcgagatgtcgatcccctcgttccgtaaccgcattcccattgaccttcacaacaacagcgtcgatattactaaggagaagaacggggactacatcgctggaatcagcctgtttagtagggactttcacaaggagaatgacgacgtgcctaagggcaaaatcttcatcaagctggcaacccagaagcagaagtccatgaaggtgatactggaccgcctgattaaccagacctacagcaaaggtgcctgcatgatccataagtacaagaataagtggtatctgtccatcacctacaagttcaacgccattaaggagaacaaattcgacaaggagttgataatggggatagacatgggcggtatcaacactgtgtacttcgctttcaacgaggggttcatccgctccaacattaagtccgacgagatcaagaccttcaacgaacgtatccggcagaggcggataaacctgctcaagcagtccaaatattgttcaaactcccgtacaggcaaggggcgcactaagcgcttgcagccgatagacgtcttgtccaacaagatagccaaattccggaacagcaccaaccacaagtacgccaactacatcatcaagcagtgcctcaagcacaactgcgggcgcatccagatggaattacttaagggaatctccaagaatgacaaggtgttgaaagactggacctacttcgacctacaggaaaaaatcaagaatcaggcagagatacacggcatcgaggtcatcaagatcgctcccgcttacacctcgcaacggtgctcccagtgcgggtatatctgtaaggaaaatcgttgcacacaagccatgttcgaatgcaagcagtgcgggtacaagactcacgccgactacaacgccgccaagaacatctcaacctacgacatcgagaacatcatcaacaagcagctcgccgtccagagtaaactgcactccaagaagtgtatggccgagtacatggaggagcttggctatttggactga

SEQ ID NO: 2741 - DNA, 1335 bp, Unknown
  Bacillus sp. multi
atgaagtaccagattctatgccccatgaacgtggattggacaatcttcgagaagcacctcaggaacctcacataccaagttcgtactatctccaaccgcaccatccaacaattgtgggagttcgacgccctcagcttcgactatttcaaggctaggggtacttacccgacagtccaagacctatacggctgcacccagaagaagattgacggctacatctaccacaccctccagtccaagtatccggacatccacaagggcaatatgtccactacgctccaaaaaatcatcaagacttggaaaagccgccgtaacgagatccgcaaaggtgagatgagcatcccctcgttccgcaacagaatcccgatagacctccacaacaactccgtggacatcacgaaggaaaaaaacggagactacatcgctggtatttccctgtttagccgggacttccataaggagaacgacgatgtgcctaagggcaagatattcattaagctggcaacgcagaagcagaagtccatgaaggtcatattggatcgccttattaaccagacatacagcaaaggggcctgcatgattcacaagtacaagaacaagtggtatctgtcgattacatacaagttcaacgcgatcaaggaaaacaagttcgacaaggagttgataatggggattgacatgggtggtattaacacggtgtacttcgcgttcaacgagggcttcatacgttccaacatcaagagtgatgagatcaagaccttcaacgaacggatcaggcaacgtcggatcaaccttctcaagcagagcaaatattgttccaacagccgcacggggaaggggcggaccaagcggctccagcccattgacgtcctctccaacaagattgcaaagttccgcaactccaccaaccacaagtatgccaactacatcatcaagcagtgcttgaaacacaactgcgggcgcattcagatggagctactaaagggtatttccaagaacgacaaagtgcttaaagactggacatacttcgacctacaggagaagatcaaaaaccaggcagagatccacgggatcgaggttatcaagattgctccggcctataccagccagcgctgctcccagtgcgggtatatctgtaaggagaatcggtgcacccaggcaatgttcgagtgcaaacagtgcggctacaagacccacgccgactacaacgcggctaagaacatcagtacctacgacatcgagaatatcattaacaagcaacttgctgtacagagtaagttacactccaagaagtgtatggcggagtacatggaggaactgggctacctggactaa

SEQ ID NO: 2742 - DNA, 1335 bp, Unknown
  Bacillus sp. multi
atgaagtaccaaatcctttgccctatgaacgtggactggacgatcttcgagaagcacctccggaaccttacataccaagtccggacaatctcaaaccgtacgatccagcaactctgggagttcgacgccctgtcattcgactacttcaaggcgcggggcacgtaccccaccgtccaagacctttacggttgcacacagaagaaaatcgacggctacatctaccacaccttgcagtccaagtacccggacatccacaaggggaatatgtcaactaccctccaaaaaatcattaagacttggaaaagtcgtcgtaacgagatccggaaaggagaaatgagcatcccctccttccgcaatcgtatccctattgacctccacaacaactccgttgacattacgaaggagaagaatggtgactacatcgccggtatctctctgttcagccgtgacttccacaaggagaatgacgacgtgccaaaggggaaaatcttcattaagttggcgacgcagaagcagaagtcgatgaaggtgattctggaccggcttattaaccagacctactcgaaaggagcgtgcatgattcacaagtacaaaaacaagtggtatctatctatcacttacaagttcaacgctatcaaggaaaacaaattcgacaaggagctgattatgggaatcgacatgggcgggatcaacactgtgtacttcgccttcaatgaggggttcattcgctcgaacatcaagagtgacgagattaagaccttcaacgagcgcatccgtcagcgtcgtatcaacctcctaaagcaaagcaaatattgctcgaactcccgcaccggcaaggggaggacgaagcgacttcaacccattgatgtgcttagtaacaaaatcgccaagttccgtaacagcaccaatcacaagtacgccaactatatcattaagcagtgcctcaagcacaactgcggtcggattcaaatggagcttctcaaggggatctccaagaacgacaaggtgcttaaagactggacgtacttcgacctccaggagaagatcaaaaaccaggccgagatccacgggattgaagttatcaagatagcccctgcctatacttcccaaaggtgctctcagtgcgggtatatctgtaaggagaaccgctgcacccaagcaatgttcgaatgcaagcagtgcggctacaaaacccacgccgactacaacgccgccaagaacatctcaacctatgacatcgagaacatcatcaataagcagttagccgtgcagtccaagctccactccaagaagtgtatggccgagtacatggaggagttggggtatttggattag

SEQ ID NO: 2743 - DNA, 1335 bp, Unknown
  Bacillus sp. multi
atgaagtaccagatcctatgccccatgaacgtcgattggactatcttcgagaaacacctccggaatttgacctaccaagtccgaacaatctcaaaccgcactatccaacagctctgggagttcgacgccctctcgttcgactacttcaaggcacgcgggacgtaccccacggtccaagacctctacgggtgcactcagaagaagatcgacgggtatatctatcacacccttcagtctaagtatcctgacattcacaagggcaatatgagcacaactcttcagaagattatcaagacctggaagtccaggcgcaacgagatccggaagggcgagatgagcatcccgtccttccgcaaccgcattcccattgacctccataacaactccgtggacatcactaaggaaaaaaatggggactatatcgctgggatttccctgttctcgcgggactttcacaaggagaatgatgacgtgcctaaagggaaaatcttcatcaagctggctacccagaagcagaagtctatgaaggtcatcctggacaggctcattaaccagacttacagcaagggagcctgcatgattcacaagtacaagaacaaatggtatttgagcatcacctacaagttcaacgcgatcaaggagaacaaattcgacaaggagctaatcatggggatagacatgggagggatcaacacagtgtacttcgccttcaacgagggcttcatacggagcaacatcaagagcgacgagatcaagacattcaacgagcgtattcgtcagcggcggatcaacttgcttaaacagtccaagtattgctccaactcccgaactggaaaaggaaggactaagcgacttcaacctattgacgtgcttagcaacaagatagctaagttcagaaacagtaccaaccacaagtacgccaactacatcattaagcagtgcctcaaacacaactgcgggcgcatccagatggagctgctcaagggtatctctaagaatgacaaggtgctcaaagactggacctacttcgatctccaggaaaaaatcaagaaccaggcagagattcacggcatcgaggtcattaagattgcaccggcatatacttcccagaggtgcagccagtgcggctacatctgcaaggagaacagatgcactcaggcaatgttcgagtgcaagcagtgcggctacaagacccacgcggattacaacgccgctaagaacatctctacctacgacatcgagaacatcatcaacaagcagctcgccgtacagtctaaacttcacagcaagaaatgcatggcggagtatatggaggagctggggtacttggactga

SEQ ID NO: 2744 - DNA, 1335 bp, Unknown
  Bacillus sp. multi
atgaagtaccagatcctctgcccgatgaacgtggattggactatcttcgagaagcacctgaggaatctcacctaccaagtgcgtaccatctccaatcggactatccagcaattgtgggagttcgacgcactgtccttcgactacttcaaagctcgtggcacctaccccacagtgcaagacctctacggctgtacgcagaagaagattgacggctacatctatcacacccttcaaagcaagtaccctgacattcacaagggcaatatgagtaccacgttacagaagatcatcaagacctggaaaagtcgtcggaacgagatacggaagggcgagatgtctatcccctccttccgcaaccgaatccctatagacttacacaacaactcagtcgatattacaaaggagaagaacggcgactacatcgcggggatcagcctgttcagccgggacttccacaaggagaacgacgacgttccaaagggcaagatattcattaagctggccacccagaagcagaaatctatgaaggtgatccttgatcgactcattaaccagacctactcgaagggcgcgtgcatgatacacaagtacaagaataagtggtatcttagtatcacctacaagttcaacgcgattaaggagaacaaattcgacaaggagctaatcatgggcatcgacatgggtggtattaacaccgtttacttcgccttcaacgaggggttcattcggagtaacatcaagagcgacgagatcaagacattcaacgagcgcatcaggcagcgccgcatcaaccttctcaaacagtccaagtattgctccaattcacgcaccggcaagggtaggacgaagcgtctccaaccgatagacgtccttagcaacaagatcgccaaattccgaaattccaccaaccacaagtatgccaactacatcattaagcagtgcttgaagcacaactgcgggcgaatccagatggagttgcttaaggggatctccaagaacgacaaggttctaaaggactggacgtacttcgatctccaggaaaaaatcaagaatcaggcggagatccacggaatcgaggtgattaagatcgcacccgcatacacgagccagaggtgcagtcagtgcgggtacatctgcaaggagaacagatgcacccaggctatgttcgagtgcaagcagtgtggttacaagacccacgcggactacaacgcagctaagaacatctcaacctacgacatcgagaacatcatcaacaagcaattggcagtgcagagtaagctccacagcaagaagtgtatggccgagtacatggaggagctgggctatctggactga

SEQ ID NO: 2745 - DNA, 1335 bp, Unknown
  Bacillus sp. multi
atgaagtaccagatcctgtgccctatgaacgtggactggacgatcttcgagaagcacctcagaaacctgacctaccaagtccgtaccatctcaaaccgcactatccagcagctctgggagttcgacgctctgagcttcgactacttcaaggagcgcgggacataccccaccgtccaagacttgtacggctgcacacaaaaaaagatagacggttacatataccacaccctccaatcgaagtacccggacatccacaaagggaatatgagtacaaccctacagaagattatcaagacatggaaatcccgacgtaacgaaatccgcaagggagagatgtccataccatcctttcggaaccgcattcctattgacctccacaacaacagcgtggacattactaaggagaagaacggggactacatcgccgggatctccctattctcacgggacttccacaaggagaacgacgacgtgccaaagggcaaaatcttcgtaaagctcgccactcagaagcagaagtctatgaaggtgatcttggaccgtctcatcaaccagacctactcaaaaggagcgtgcatgatccacaagtacaagaacaagtggtatctctcaatcacttacaagttcaacgccatcaaggagaacaagttcgacaaagagctaatcatgggaatcgacttgggtggcatcaacaccgtgtacttcgcattcaacgaaggcttcattcgctcgaacatcaagagtgacgagattaagatgttcaacgaacggatacgccagaggcgtattaacttactcaaacaatccaaatattgttcgaactcgcgcaccggcaaaggccgcacaaaacgcttacagcctatagacgtcttgtccaataagatcgccaagttccggaatagcaccaaccacaagtacgccaactacatcgtgaaacagtgcctcaagcacaactgtgggcgcatacaaatggaactgttaaaggggatcagcaagaacgaccggattctcaaagattggacttacttcgacctccaggagaagatcaaaaaccaggccgagatccacgggatcgaagttatcaaggtcgctcctgcatacacctctcagaggtgctcccaatgcgggtacatctgcaaggagaaccgctgcactcaagccacattcgagtgcaagcagtgcgggtacaaaacgcacgccgactacaacgccgctaagaacatctcgacctatgatattgagaacatcatcaacaaacaacttgctgttcaaagtaagctgcacagcaagaagtgtatggaggagtacatcgaggagctggggtacttggactga

SEQ ID NO: 2746 - DNA, 1335 bp, Unknown
  Bacillus sp. multi
atgaagtaccaaattctgtgcccgatgaacgtggactggactatcttcgagaaacacttgaggaacctaacctaccaagtaagaactatctcgaatcgcacaatccaacagttgtgggagttcgacgccctttccttcgactacttcaaggagcgcggcacgtaccccaccgtccaggacttgtacggctgcacccaaaaaaaaatcgacggctacatctaccacaccctccagagtaagtacccggacatacacaaggggaacatgagcaccacactacagaagattatcaagacttggaaatcacgccggaatgagatcaggaagggtgaaatgtctatcccgtcattccgcaaccgcatcccgattgatctgcacaacaactccgtggacatcactaaggagaagaacggggactacatcgccggaatctccctattctcccgcgacttccacaaggagaacgacgacgtaccaaaggggaagatattcgtgaagctggcaacccagaagcagaagtctatgaaggtcatcctggataggctgataaaccagacctacagtaaaggagcttgcatgatccacaagtacaagaacaagtggtatctgtcaatcacatacaagttcaacgctattaaggagaacaaattcgacaaagagcttatcatggggattgacctcggcgggatcaacaccgtgtacttcgctttcaacgaggggttcatacggtcgaacatcaagtccgacgagattaagatgttcaacgagcggataagacagagacgcattaacctcttgaagcagagcaaatactgttccaattctcgaactggcaaaggccggacgaagcggcttcagcccatcgacgtcctgtccaacaagatcgccaagttccgtaacagtaccaatcataagtacgctaactacatcgtgaaacagtgcctcaagcacaactgtgggcggattcaaatggaattgctcaaagggatctctaagaacgacaggatacttaaggactggacgtatttcgatctccaggagaagatcaaaaaccaggccgagatacacgggatcgaggtcatcaaggtcgctccagcctacacctcacagaggtgcagccagtgcggctacatctgtaaggagaatcgttgcactcaagctaccttcgaatgcaagcagtgcggatacaagacccacgctgactacaacgcggccaagaatatctccacctacgacattgagaacatcatcaacaagcagctcgccgtccagagtaaactgcacagcaagaagtgtatggaggagtacatcgaggagcttggctatcttgactaa

SEQ ID NO: 2747 - DNA, 1335 bp, Unknown
  Bacillus sp. multi
atgaagtaccagattctgtgccctatgaacgtggattggacaatcttcgaaaagcacctcaggaacctcacttaccaagtgagaacgatctccaacaggactatccagcaattgtgggagttcgacgcgctgtccttcgactacttcaaggaaagaggaacgtatcccactgtccaagacctctacggctgcacgcagaagaaaatcgacgggtacatctatcatacactccagtccaagtatccggacattcacaagggcaatatgagcaccactcttcagaagatcatcaagacatggaaatcccggcggaatgagatccggaagggcgagatgtctatcccgtccttccgcaaccgcataccgattgacctgcacaacaattcggttgacattactaaggaaaaaaacggggactacatcgcgggaatcagcttgttcagtagggacttccacaaggagaacgacgacgtgccgaagggcaagatattcgtgaagctcgccacacagaagcagaagtctatgaaggtgatcctggatcgccttatcaaccagacttactcgaagggagcttgcatgatacacaagtacaagaacaaatggtacttgagcattacctacaagttcaatgcgatcaaggagaacaaattcgacaaggaacttatcatggggattgatcttggagggataaacacagtgtacttcgcgtttaacgagggattcatccgaagcaacattaagagcgatgagatcaagatgttcaacgagcgtatccgtcagcgccgcatcaacctgctcaagcagagcaagtattgcagcaactccaggacagggaagggacggactaaacgattgcagcctattgatgtcctttccaacaagattgccaaattccgtaatagcaccaaccacaagtacgcgaactacatcgtcaaacagtgccttaagcacaactgcggtcggattcagatggagctactcaaggggatcagcaagaacgacagaatcttaaaggactggacctacttcgatctccaggagaagatcaaaaaccaggccgagattcacggaattgaggttattaaggtcgctccggcctacacctcgcagcggtgctcacagtgcgggtacatctgcaaggagaatcgctgcacccaggccaccttcgagtgcaagcagtgcggctacaagactcacgcagactacaacgcagccaagaacatcagcacctacgacattgagaacatcatcaacaagcaattggctgtgcagtcaaagttgcacagcaaaaaatgcatggaggagtatatcgaggagttgggatacctcgactga

SEQ ID NO: 2748 - DNA, 1335 bp, Unknown
  Bacillus sp. multi
atgaagtaccagatactgtgcccgatgaacgtggactggactatcttcgaaaagcacctccggaaccttacctaccaagtccgcaccatctccaaccggacgatccagcagctttgggagttcgacgccctctcgttcgactacttcaaggaacgcggaacctatccgaccgtccaagacctctatggatgcactcagaagaaaatcgacggctacatctaccacacacttcagtccaagtacccggacatacacaagggcaatatgtcaactactcttcagaagattatcaagacttggaagtccagaaggaacgagatacggaaaggggaaatgagcatcccgagtttccgtaaccgtatccctattgacttgcacaacaactctgttgatattactaaggaaaaaaacggggactatatcgctggtatctcactcttcagccgcgatttccacaaggaaaacgatgacgtaccaaaggggaagatattcgtgaagctggccacccagaagcagaagtccatgaaggtcattctggaccgcctcattaaccagacctacagcaagggagcttgcatgattcacaagtacaagaacaagtggtatttgagtatcacatacaagttcaacgctatcaaggagaacaagttcgataaggagctaatcatgggcatcgacctcggagggattaacacagtttacttcgcgttcaacgagggcttcatccggagcaacatcaagtcagacgagattaagatgttcaacgagcgcatccgccagcggcgcattaacctgcttaaacagagcaaatattgttcgaactctaggaccggcaagggccgtaccaagaggcttcagccaatcgacgtgctttcaaacaagattgccaaattccgcaactctaccaaccataagtacgccaactacatcgttaagcagtgcttgaagcacaactgcggccgaatccagatggagttgctcaaggggatcagcaagaacgaccgcatactgaaagattggacatacttcgacctccaggagaagatcaaaaaccaggctgagattcatgggatcgaagttatcaaggttgccccagcctacaccagtcaacgctgctctcaatgcggctacatctgcaaggaaaatcgctgcacccaggccacgttcgagtgcaagcagtgcgggtacaagacgcacgctgactacaacgccgctaagaacatctctacttatgacattgagaacatcattaacaagcagcttgcggtgcagtctaagctacactccaagaagtgtatggaggagtacatcgaggagttgggatacctggactga

SEQ ID NO: 2749 - DNA, 1335 bp, Unknown
  Bacillus sp. multi
atgaagtaccagattctctgccccatgaacgtggactggaccatcttcgagaagcacctccgcaaccttacttaccaagtacgaacgatctcaaatcgcaccatccagcagctctgggagttcgacgccctttccttcgactacttcaaggagcgcggcacctacccaacggtccaggacttgtacggctgcacccagaagaagattgacggctacatctatcacaccctccagagcaagtaccctgacatccacaagggcaatatgtccaccaccctccaaaaaatcattaagacatggaaatcacgccgaaacgagatcaggaagggagagatgtcaattccctctttccgaaaccgcatcccaattgaccttcacaacaactccgtggacattacaaaggagaagaacggggactacatcgctggtatctctctgtttagcagagacttccacaaggagaacgacgacgtgcctaagggcaaaatcttcgttaaactcgccacacaaaagcagaagtccatgaaggtgatcctcgaccgtctgattaaccagacttactcaaaaggagcttgcatgatccacaagtacaagaacaaatggtacttgtcaatcacttacaagttcaacgccattaaggaaaacaaattcgacaaggaactgattatggggattgatctaggtgggattaacactgtgtactttgcattcaacgagggctttatccgaagtaacatcaagtccgacgagatcaagatgttcaacgagcggataaggcagcggaggatcaatctcctcaaacagtccaaatattgttcaaactcaaggaccgggaaggggagaactaaacgcctgcaacccatcgacgtgctgtccaacaagattgccaagttcagaaacagcaccaaccacaagtacgcgaactacatcgtgaagcagtgcctcaagcacaactgcggtcgcattcaaatggagctactaaaggggataagcaagaacgaccgtattctaaaggactggacctacttcgacctccaggagaagatcaaaaaccaggcggagattcacggcattgaagtcatcaaggtggcccctgcctacacctctcagcgatgctcccagtgcgggtatatctgcaaggaaaatcggtgcacccaagctacattcgagtgcaagcagtgcggctacaagacccatgccgactacaacgccgccaagaacatctctacctatgacattgaaaacatcatcaacaagcagctcgccgtccagtcaaagttgcatagcaagaaatgcatggaggagtacatcgaggaacttggctatttggactga

SEQ ID NO: 2750 - DNA, 1356 bp, Bacillus thuringiensis
ctcggggtgaccatcaagatcatgaagtaccagatcctttgcccgatgaacgttgactggacgatcttcgagaaacacctcaggaacctgacctaccaagttcgcactatctccaaccgaacgatacagcagctctgggagttcgacgccctgtcattcgactactttaaggcccgaggcacttatccaaccgtccaggatctgtacgggtgcactcagaagaaaatcgacgggtatatctatcacaccttgcagtccaagtaccccgacatccacaaggggaatatgagcaccacccttcagaagatcatcaagacatggaagtccaggcgtaacgagatcagaaaaggcgagatgtcgatcccctcctttcgaaaccgtatccctatcgacctgcacaacaactctgttgacattacaaaggaaaaaaacggcgactacatcgccggtatttccttgttcagtagggactttcacaaggagaacgacgacgtgcctaagggcaaaatcttcattaagctcgccacccagaaacagaagtcgatgaaggtgattctggaccgccttatcaaccagacgtacagtaaaggagcgtgcatgatccacaagtacaagaacaagtggtatctctcgattacctacaaattcaacgcgattaaggagaacaagttcgacaaggaacttatcatgggcatcgacatgggcgggataaacacggtgtactttgcattcaacgaggggttcattcggtcaaacatcaagagcgacgagattaagaccttcaacgagcgcatcaggcagcggcggattaacttactcaagcagagcaagtactgttcaaacagtcgaaccggaaaggggcgcacgaagcgtcttcagccaattgacgtgctgtccaacaagattgccaaattccgtaactctactaaccacaagtacgccaactacatcatcaagcagtgcctcaagcacaactgcggccgtattcagatggaactgttgaaggggatctccaagaacgacaaagtgctgaaagactggacctacttcgatctacaggaaaaaatcaagaatcaggccgagattcacgggatagaggtcattaagattgcgcctgcctacaccagccagagatgctcccagtgcggctacatctgtaaggaaaatcgctgcacccaggcgatgttcgagtgcaagcaatgcggctacaagacccacgcggattacaacgcagccaagaacatcagtacatacgacatcgagaacatcatcaacaaacagttggccgtgcagagtaagctacactccaagaagtgtatggcggagtacatggaggagttgggctacctggattaa

SEQ ID NO: 2751 - DNA, 1356 bp, Bacillus thuringiensis
cttggggtgacgatcaagatcatgaagtaccagatcctttgccctatgaacgtggattggacgatcttcgagaagcacttgcgaaacctgacgtaccaagtacgcacaatcagcaaccgcacgatccagcagctctgggagttcgacgccctcagcttcgactacttcaaggcaaggggaacatacccgaccgtgcaagacctctacggctgcacccagaagaagatcgacggttacatataccacaccttgcagagcaagtatcccgacatccacaaggggaatatgtccaccactctccagaagattatcaagacttggaaatcgcgtcgcaacgagattcgtaagggagagatgtcgatcccttcgttcagaaacagaatccctatcgacttgcacaacaactccgtggacattactaaggaaaaaaacggggactacatcgcggggatcagcttattctcacgagacttccacaaggagaacgacgacgtgccaaaaggcaagatattcattaagttggcaacgcagaagcagaagtctatgaaggtcatcctggacagactcatcaaccagacgtactcgaaaggtgcgtgcatgatccacaagtacaagaataagtggtatctatctatcacttacaagttcaacgctattaaggaaaacaagttcgacaaggagctaatcatgggcatcgacatgggtgggatcaacacggtgtactttgcattcaacgaagggttcatccgttccaacatcaagtctgacgagatcaagacgttcaatgagcgcatacgccagcggcggatcaacctactcaaacagtccaagtactgttcgaactcccgtactgggaaaggacgcacgaagcgcctccaaccgattgacgtgctcagcaacaagatcgccaaattccgcaacagcaccaaccacaagtacgcaaactacatcattaagcagtgcctcaagcacaactgcgggcgcatccagatggaattgctaaagggaatttccaagaatgacaaggtgcttaaggactggacgtacttcgacttacaggaaaaaatcaagaaccaggccgagatacacggcatcgaggtcattaagatcgcgccagcttacacaagccagcggtgctcacagtgcggctacatctgcaaggagaatcgctgcacccaggctatgttcgaatgcaagcagtgcgggtacaaaacgcacgccgactacaacgcagccaagaacatatcgacgtacgatattgagaacatcatcaacaaacagttggctgtgcagtcaaagctgcactccaaaaagtgtatggctgagtacatggaggagttgggctacctggactga

SEQ ID NO: 2752 - DNA, 1356 bp, Bacillus thuringiensis
ctcggtgtgactatcaagattatgaagtaccagatcctctgcccgatgaacgtggactggaccatcttcgagaagcacctccgtaacctcacctaccaagttagaacaatcagcaacaggaccatccagcagctttgggagttcgacgccctgtcgttcgattacttcaaggcgcgcgggacttacccaaccgtccaggatctctacggctgtactcagaagaagatcgacggctacatctaccatacactccaatcgaagtaccccgacatccacaagggcaatatgtcaaccactttgcagaagattatcaagacatggaaatcacggaggaacgagatccgcaagggtgagatgagcatcccctctttccggaaccgcatccctatcgaccttcacaacaactccgtcgatattacgaaggagaagaatggagactacatcgccggaatatccctgttctcaagggacttccacaaggagaacgacgacgtgccgaagggcaaaatcttcatcaagctcgccactcagaagcagaaatccatgaaggtgattctggaccgacttatcaatcagacttactcaaagggtgcgtgcatgatccacaagtacaagaacaagtggtacttgagcatcacctacaaattcaacgcgatcaaggaaaacaagttcgacaaggaacttatcatggggatagacatgggcgggatcaacactgtttacttcgcattcaacgagggcttcataaggtccaacatcaagagcgacgagatcaagacctttaacgagcgaatccgccagaggcgtatcaacctcttaaagcagtccaaatattgttccaacagccgcaccggcaagggtcgcaccaagcgcctccaacccatcgacgtgctctcaaacaagattgccaaattccgtaatagcactaaccacaagtacgctaactacatcatcaagcagtgcctcaagcacaactgcggacgcattcaaatggaactccttaaagggataagtaagaacgacaaggtgttgaaagactggacctatttcgacttacaggagaagatcaaaaaccaggccgagatccacgggattgaagtcattaagattgcaccagcttacacctcacagaggtgcagtcagtgcgggtacatctgtaaggaaaaccgttgtacccaggctatgttcgagtgcaagcagtgcgggtacaagactcatgccgactacaacgcagccaagaacatctccacctacgacattgaaaacattatcaataagcagctcgcggttcagtcgaagctccacagcaaaaaatgcatggcggagtacatggaggagttgggctatctcgactga

SEQ ID NO: 2753 - DNA, 1356 bp, Bacillus thuringiensis
ctcggagttacgatcaagattatgaagtaccagatcctgtgccccatgaacgtggactggaccatcttcgagaagcacctccggaacctgacgtaccaagtaagaacaatctcaaacaggaccatccaacaactgtgggagttcgacgccctgtcattcgactacttcaaggcccgtggcacttaccccaccgtccaggatctctacggctgcacgcagaagaagatcgacgggtacatctatcacaccctccagagcaagtaccccgacatccacaagggcaacatgagcaccaccttgcagaagattatcaagacttggaaatctcgaaggaatgagatccgtaaaggtgagatgtcaatccccagcttccgtaaccgaatacccatcgacctccacaacaattccgtggacattacaaaggaaaaaaacggggactacatcgcgggtatatccctgttcagccgagacttccacaaggagaacgacgacgtgccgaagggcaagatattcatcaagctcgccacgcagaagcagaagtccatgaaggtcatcctcgaccgacttatcaaccagacgtacagcaaaggcgcgtgcatgatccacaagtacaaaaacaaatggtacttgtcaattacctacaagttcaacgctatcaaggagaacaaattcgataaggaactcatcatgggcattgacatgggcgggattaacacggtttacttcgcattcaacgagggcttcatacgttccaacatcaagagcgacgagatcaagacattcaatgagcgtatccggcagaggcggatcaacctcctcaagcagagcaaatattgttcaaacagccgaacaggcaagggccgcacaaaacggcttcagcctattgacgtcctctccaacaagatcgccaaattccgtaacagcacaaaccacaagtacgctaattacatcatcaagcagtgcctcaagcacaactgcggacggattcagatggagctacttaagggtatctccaagaatgacaaagtgctaaaggactggacatacttcgacctccaggagaagatcaaaaaccaggcagagatacacggaatcgaggttatcaagatagccccagcatacacctcacagcgatgcagccaatgcgggtacatctgcaaggagaaccggtgcacccaggctatgttcgagtgtaagcagtgcgggtacaaaacccacgccgattacaacgccgctaagaacatcagtacatacgacattgagaacatcatcaataagcagctcgctgttcagagtaagttgcacagcaagaagtgtatggccgagtatatggaggaactgggctacctcgactga

SEQ ID NO: 2754 - DNA, 1356 bp, Bacillus thuringiensis
ctgggtgtgaccatcaagatcatgaagtatcagatcctatgcccgatgaacgtggattggaccatcttcgagaagcacctccgtaacctgacctaccaagtccgcacaatctccaaccgcacgatccagcagctctgggagttcgacgccctgagctttgactacttcaaggctcgtggcacctatcccactgtccaagacctttatggatgcactcagaagaagattgacgggtacatctaccacaccctacagtccaagtatcctgacatccacaaggggaacatgagcactaccttgcaaaaaatcatcaagacttggaaaagtcgtcgcaacgaaatccgcaaaggagagatgagcatcccgtccttccgcaaccgtatcccaattgatctccacaacaactccgtggacattactaaggaaaaaaacggcgactacatcgccggaatatccctgttctcccgagacttccacaaggagaatgatgacgtgcctaagggcaaaatcttcatcaagctggcaacccaaaagcagaagtccatgaaggtgatactcgaccggcttatcaaccagacctacagcaaaggagcttgcatgatccataagtacaagaacaagtggtacttgagtattacatacaaattcaacgccatcaaggagaacaaattcgacaaggagctgataatggggattgacatgggtggtatcaacactgtgtactttgccttcaacgagggattcataaggtcaaacatcaagagtgacgagatcaagacctttaacgagcgcatcagacagaggcgtatcaaccttctcaagcagagcaaatattgttccaactcaaggactgggaagggacgtacgaagcgccttcagccgattgacgtcctcagtaacaaaatcgccaaattccgtaatagcaccaaccacaaatacgcgaactatatcatcaagcagtgcttgaaacacaactgtggcagaatccaaatggagctgctgaaaggaatcagcaagaacgacaaagtgctgaaagactggacctactttgacctacaggagaagatcaaaaaccaggccgagattcacgggattgaggttatcaagatcgctccagcctacaccagccagaggtgctcacagtgcgggtacatctgcaaggagaaccgctgcactcaggccatgttcgagtgcaagcagtgcggctacaagacccacgccgactacaatgccgccaagaacatctcgacctacgacattgagaacatcattaacaagcagctcgccgtgcaaagtaaactgcatagcaagaagtgtatggcggagtacatggaggaactgggttatctcgattag

SEQ ID NO: 2755 - DNA, 1356 bp, Unknown
  Bacillus sp. multi
ctcggggttactatcaagatcatgaagtaccagatactctgtcccatgaacgtggactggaccatcttcgagaaacacctccgcaacctgacctaccagattcgtaccatctcgaatcgaaccattcagcagctctgggagttcgacgctctctcattcgactacttcaaggagcgcggcacctaccccaccgtccaagacctttatgggtgtactcaaaaaaagatcgacgggtatatctatcacactctccagagcaagtacccggacattcacaagggcaatatgagcaccaccctccagaaaatcatcaagacctggaagtctcggcgcaacgagatccgcaagggcgagatgtccatccccagcttcagaaaccgtatcccaatcgacttgcacaacaactccgttgacattactaaggagaagaatggagactacatcgcgggaatcagcctattcagccgcgatttccacaaggaaaatgacgacgtgcctaaagggaagatattcgtgaagctcgccacccagaagcagaagtcgatgaaggtgatcctggaccgccttatcaaccagacctactctaagggcgcgtgcatgatacacaagtacaagaacaagtggtatctatcaatcacatacaagttcaatgctattaaggaaaacaaattcgacaaggagttgataatggggattgacttgggcggtatcaacactgtgtacttcgctttcaatgaggggttcatacgctccaatatcaagtccgacgagatcaagatgttcaacgagcgtatcaggcagcgaaggatcaatctgctaaagcagagcaagtattgcagcaattccaggaccggaaagggccgtactaagcgcctccagcccatcgacgtgctcagcaataagatagctaagttccgtaatagcaccaaccacaagtacgccaactacatcgttaagcagtgccttaagcacaattgcgggaggatacaaatggaattgttaaagggtatctccaagaatgacaggatacttaaagactggacgtacttcgatctccaggagaagatcaaaaaccaggccgagatccacggtattgaggtcatcaaggtggccccagcctacacttcacagaggtgcagtcagtgtggctacatctgcaaggagaataggtgtacccaggctacgttcgagtgtaaacagtgcgggtacaagacacacgccgattacaacgccgccaagaacatatccacctacgatattgagaacatcatcaacaagcagctcgcggtacagtccaagctccattccaagaagtgtatggaggagtacatcgaggagctgggttatctcgactga

SEQ ID NO: 2756 - DNA, 1356 bp, Unknown
  Bacillus sp. multi
cttggagtgacgatcaagatcatgaagtaccagatactctgcccgatgaacgtggactggaccatcttcgagaagcacctccgcaacctgacctaccagattcgcactatcagcaacaggacgatccagcagctctgggagttcgacgctctatcattcgactacttcaaggaacgcggtacttaccccacggtgcaagacctgtacggctgtactcagaagaaaatcgacggctacatctaccatacgctccaaagcaagtatccggacatccacaaggggaatatgagcactacactccagaagatcatcaagacttggaaatccaggcgtaatgagatccgcaaaggggaaatgtccatcccatccttccgaaacaggataccaatagacctccacaacaactcggttgatattactaaggaaaaaaacggggactacatcgctggtatctccctgtttagccgggacttccataaggagaacgacgacgttccaaaaggcaaaatcttcgtgaagctcgcaacgcagaagcaaaagtctatgaaggtgattctggaccgccttatcaatcagacatacagcaaaggtgcctgcatgatccacaagtacaagaataagtggtatctgtcaatcacctacaagttcaacgccattaaggagaacaaattcgacaaggagctaatcatgggcatcgacctcggcggtatcaatactgtgtactttgcattcaacgaggggttcatccggtccaatatcaagagcgacgagattaagatgttcaacgaacgtatccgccagaggcgcatcaaccttctaaagcaatcgaagtattgctccaattctaggacagggaaggggcgtacaaaacggttgcagcctatcgacgtgctgtccaacaagatcgcaaagttccgtaactccaccaaccacaagtacgccaactacatcgtaaagcagtgcctgaaacataactgcggtcgcatacagatggagttgctaaaggggatcagcaagaatgaccggatattgaaggactggacttacttcgacctccaggagaagatcaaaaatcaggcggagatccacgggatcgaagtcatcaaggttgctcctgcctacacatcccagcggtgcagccagtgcgggtatatctgcaaggagaaccgttgcacacaagcgactttcgagtgcaagcagtgcggctacaagacccacgcggactacaacgccgccaagaatatctccacctacgacatcgagaacatcatcaacaagcagttggccgtccagtcgaagctacacagcaaaaaatgcatggaggagtacatcgaggagttgggatacttggattag

SEQ ID NO: 2757 - DNA, 1356 bp, Unknown
  Bacillus sp. multi
ctaggcgtcaccatcaagatcatgaagtaccagatcctctgccccatgaacgtggactggaccatcttcgaaaagcacctccgcaaccttacctaccagataagaacaatatcgaacagaaccatccagcaattgtgggagttcgacgctctcagcttcgactactttaaggagcgcggcacctatccgaccgtccaagacctttatggctgtacccagaagaagattgacgggtacatctaccacaccttgcagagcaagtaccccgacatacacaaggggaatatgagcaccaccctccaaaaaatcatcaagacttggaaatctcgcagaaacgagatccgcaagggtgagatgtccatacccagtttccggaaccgcatccccatcgaccttcacaacaactctgtggacattacgaaggagaagaacggagactacatcgctggtatcagcctgttcagccgcgacttccacaaggagaacgacgacgtgcctaagggcaagatattcgtgaagctggccacacagaagcagaagtcgatgaaggtgatacttgaccgcctcatcaaccagacatacagcaagggtgcttgcatgattcacaagtacaaaaacaagtggtatctcagcatcacctacaaattcaatgccattaaggagaacaagttcgacaaggaactgataatgggaatcgacttgggcgggattaacaccgtttacttcgccttcaatgaggggttcatccggagtaacatcaagtcggacgagatcaagatgttcaacgaacgcatccgccaaaggcgcatcaacctgttgaaacagagtaagtattgcagcaattcccgtacaggcaaagggaggactaagcggctccagcctatcgacgtcctctcaaacaagattgccaaattccgcaactccaccaaccacaagtacgccaactacattgtgaagcagtgcttgaagcacaactgcggccgaatccagatggaactgttaaagggtatcagcaagaacgacagaatcctcaaagactggacgtacttcgacttacaggagaagatcaaaaaccaggccgagatccacggcatcgaagttatcaaggtggctcccgcctatacaagccagaggtgttcacagtgcgggtacatctgtaaggaaaaccggtgcacccaagcgacattcgagtgcaagcagtgcggctacaaaacccacgccgactacaacgcagccaagaatatcagtacatacgacattgagaacattatcaataagcagctcgctgtccagtcaaagctccatagcaaaaagtgtatggaggagtacatcgaggaactgggctacctggactga

SEQ ID NO: 2758 - DNA, 1356 bp, Unknown
  Bacillus sp. multi
ctaggggtcacgattaagatcatgaagtaccaaatactgtgccctatgaacgtggactggactatcttcgagaagcacctgaggaacttgacgtaccagatccgcacaatctcaaaccgtactatccagcaattgtgggagtttgacgctctctccttcgactacttcaaggagcgtgggacttaccccaccgtacaagacctctatggctgtacgcagaagaagattgacggctacatctaccacacccttcagtcaaagtaccccgacatccacaagggcaacatgagcacgactcttcagaaaatcatcaagacctggaaatcccggaggaatgagattcgcaagggcgagatgtctatcccgtccttccgcaaccgtatccccattgacctccacaacaactctgttgacatcactaaggagaagaatggcgactacatcgctggcatcagcttattcagccgcgacttccataaggagaacgacgatgtgcctaaggggaagatattcgtgaagctggccacccagaagcagaagtctatgaaggtgatcttagaccgccttatcaatcagacctacagtaagggtgcctgcatgattcacaagtacaagaacaagtggtacttgtccatcacctacaagttcaacgccatcaaggaaaacaagttcgataaggaactcatcatgggcattgacctcggagggataaacaccgtgtacttcgcattcaatgaggggttcatccgatccaacattaagtccgacgagattaagatgttcaacgaacgcatccggcagagacgtatcaaccttctcaagcagtccaagtattgttcaaattcacgaaccgggaagggacggactaagcgcctccagccaatagacgtgctctcaaacaagatcgccaaattccgcaactccacgaaccacaagtacgcaaactatatcgttaaacagtgcttgaagcacaactgcggccgaatccagatggaactgttaaagggtatctccaagaacgacagaatcctcaaagactggacgtacttcgacttacaggagaagatcaaaaaccaggcggagattcacggaatcgaggttatcaaggtggcaccagcctacacaagtcagagatgctcccagtgcggctacatctgcaaggaaaaccgctgcacccaggccacgttcgagtgcaaacaatgcgggtacaagacgcacgccgattacaacgcagccaagaacatcagtacctacgacattgagaacattatcaacaagcagctcgctgtacagtcgaaacttcacagcaaaaaatgcatggaggagtacattgaggagttgggttatcttgactga

SEQ ID NO: 2759 - DNA, 1356 bp, Unknown
  Bacillus sp. multi
ctcggcgtgaccattaagatcatgaagtaccagatcctctgccccatgaacgttgactggaccatattcgagaagcacctaaggaaccttacttaccagatccgaacaatctccaaccgaaccatccagcagctctgggagttcgacgcgctctcgttcgactacttcaaggagcggggcacctacccgacagtccaagacctttatggctgcacccaaaaaaagatcgacgggtacatctatcacaccctccaatccaagtatcccgacattcacaagggcaacatgagcacaacactccagaagatcatcaagacgtggaaatcccgcagaaacgagatccgcaaaggagaaatgagcataccgagcttccgcaaccgtattcctatcgaccttcacaacaacagcgtggacatcacgaaggagaagaatggggactacatcgctggtatctcactgttcagtagggacttccacaaggaaaacgatgacgtgcccaaaggcaaaatcttcgtaaagttggcaactcaaaagcagaaaagtatgaaggtgatcttagaccgacttattaaccagacctactcaaaaggggcctgcatgattcacaagtacaagaacaagtggtatttgagcatcacatacaagttcaacgctatcaaggagaacaagttcgacaaggagctgattatggggattgatcttggagggattaacacagtgtactttgcattcaacgaggggttcatacgctcaaacattaagtcggacgagatcaagatgttcaacgagcgaatccgccagcgccggataaacctgctgaaacagtccaaatactgctcgaactccaggacgggaaaagggaggacgaaacgcctacagcccatcgacgtcctgtccaacaagattgccaagttccgtaactccacgaaccacaagtacgccaactatatcgtcaagcagtgccttaaacacaactgcggacgcatccaaatggaactgctcaagggtatctctaagaacgaccgcatactgaaagattggacatacttcgacttacaggaaaaaatcaagaatcaggcggaaatccacgggattgaagtcattaaggttgccccagcttacacgagccagaggtgctcccagtgcggttacatctgcaaggagaaccggtgcacccaggccacattcgagtgcaagcagtgcggatacaaaacccacgctgactacaacgccgctaagaacatcagcacctacgacatcgagaacattatcaataagcagttggccgtccagagtaagctgcactccaagaagtgtatggaggagtacatcgaggagctgggttacttggactag

SEQ ID NO: 2760 - DNA, 1356 bp, Unknown
  Bacillus sp. multi
ctcggtgtgacgattaagatcatgaagtaccagattctctgccccatgaacgttgactggaccatcttcgagaaacacctccgtaacctcacgtaccaagtaagaaccatctccaaccgcaccatccagcaactctgggagttcgatgccctatccttcgactactttaaggaacgaggcacctaccccaccgtccaagacctctatggatgcacccagaagaagatagacgggtacatctaccacaccctccagtcgaagtaccccgacatccacaaggggaatatgagtacaacactccagaaaatcatcaagacctggaaatcacgccggaacgagatccgaaaaggtgaaatgtccataccgtctttccgcaaccgcattccgattgatctgcacaacaattctgtggatattacgaaggaaaaaaatggtgattacatcgctggcatatcgttattcagtcgggacttccacaaggagaacgatgatgtccctaagggcaagatattcgtaaagctggccacccagaagcagaaatctatgaaggtgatactggaccgcctgataaaccagacctactcaaagggcgcttgcatgattcacaagtacaagaacaagtggtacttatcaattacctacaagttcaacgcgatcaaggaaaacaaattcgacaaggagttaatcatgggaattgacctcggtgggatcaacactgtgtacttcgctttcaatgaggggttcatccgttccaacatcaagagtgacgagattaagatgttcaacgagcgcatccgccagcgtcgcattaacctgctcaagcaatccaagtactgttccaattctcggacaggcaagggccgcaccaagcgtttgcagccgatagacgtgctcagtaacaagatcgccaagttccgtaactccaccaaccacaagtacgcgaactacatcgtgaagcagtgtctgaaacataactgcgggagaatccaaatggaactcctcaagggtattagcaagaacgaccgcattctcaaagactggacatacttcgatctccaggaaaaaatcaagaaccaggccgagatccacggaatcgaagttatcaaggtggctcccgcctacaccagccagaggtgctctcagtgcgggtatatctgtaaggagaatcgctgcacccaggccaccttcgaatgcaaacagtgcgggtacaagactcacgctgactacaacgccgccaagaacatatctacctacgacattgagaacatcatcaacaagcagcttgcggtacaaagcaaattgcacagcaagaagtgtatggaggagtacatcgaggaattgggctatctcgactaa

SEQ ID NO: 2761 - DNA, 1356 bp, Unknown
  Bacillus sp. multi
cttggcgtgacgattaagatcatgaagtaccagatcctctgccccatgaacgtggattggacgatcttcgagaagcacctccgcaacctcacctaccaagttcggactattagcaatcggaccattcagcagttgtgggagttcgacgcccttagtttcgactacttcaaggagcggggcacgtacccaaccgtccaagacctttatggctgcacccagaagaaaatcgacggctacatctaccacacacttcaatctaagtacccagacattcacaagggcaatatgtccacaaccctccagaagatcattaagacctggaagtcgcggcgtaacgagatccggaaaggggaaatgtccattccttccttccgaaaccgtatccctatcgacctacacaacaattcggttgacatcacaaaggagaagaacggagactacatcgctggtatctcactgtttagtcgagatttccacaaggagaacgacgacgttccgaagggcaaaatcttcgtgaagctggcaacgcagaaacagaagtccatgaaggtgatcctggaccgcttgataaaccagacgtacagcaagggtgcctgcatgattcacaagtacaagaacaagtggtatttgagtattacctacaagttcaacgctattaaggagaacaaattcgacaaagagcttatcatgggaatcgacctcggcgggatcaacaccgtgtactttgccttcaacgagggattcattcggtccaacattaagagcgatgagatcaagatgttcaacgagcgtatccgccagaggcgcatcaacctccttaaacagagtaagtattgcagtaactcccgcacgggcaagggccgaactaagcgactacagccaattgatgtcctgtccaacaagatcgccaagttccgcaactcaacaaaccataagtacgccaactacattgtcaagcagtgtctcaaacacaactgtggccgtatccagatggagttgcttaagggcatctccaagaacgaccgtattctaaaggactggacgtacttcgatctccaggagaagatcaaaaaccaggcggagatccacggaatcgaggttatcaaggtcgcaccagcctacacctcccagaggtgcagccagtgcggctacatctgtaaggagaaccgttgcacgcaagcaactttcgagtgcaaacagtgcggatacaagactcacgctgactacaacgccgccaagaacatctcgacgtacgacatcgagaacatcattaacaagcagctcgcggtccagagcaaactacacagcaaaaagtgtatggaggagtacatcgaggagcttggataccttgactga

SEQ ID NO: 2762 - DNA, 1356 bp, Unknown
  Bacillus sp. multi
ctgggagtgaccatcaagattatgaagtaccagatcctatgccccatgaacgtggactggaccatcttcgagaagcacctcaggaacctcacgtaccaagtacgcacaatcagtaaccgtaccatccagcaactctgggagtttgacgcactgagtttcgactacttcaaggagcgcggaacttatccaaccgtccaagacctctacggctgcacgcaaaaaaaaatcgacggttacatctaccacaccttgcagtccaagtaccccgacatccacaaaggcaatatgtccactaccctccagaaaatcatcaagacttggaagtctcgccgcaacgagatcagaaaaggcgaaatgtccataccttcgtttcgcaaccgcattccgattgacttacacaacaactccgtggacattactaaggagaagaatggagactacatcgccgggatttcccttttcagccgcgacttccacaaggagaacgacgacgtgcctaagggcaaaatcttcgtaaaactggcgacccaaaagcagaagtccatgaaggtgatcctggatcgactcatcaatcagacctacagcaagggcgcgtgcatgattcacaagtacaaaaacaagtggtacttatctatcacgtacaaattcaacgctatcaaggagaacaaattcgacaaggagttgataatgggaatcgacctcggagggatcaacactgtctatttcgccttcaacgaggggttcattcgttccaacattaagagcgacgagatcaagatgttcaacgaaaggatcagacaacgccggatcaatctcctcaaacaatccaagtattgctccaacagtagaacgggaaagggtcggactaagcgacttcaacccattgacgtgctcagcaacaagatcgccaaattccgcaacagcacaaaccacaagtacgccaactacatcgtgaaacagtgcctcaagcacaactgcgggcgcatccagatggagctgttaaagggaatttccaagaatgaccgaatacttaaagactggacgtacttcgacctccaggagaagatcaaaaaccaggccgagattcacgggatcgaggttatcaaggttgcgccagcatatacttcccagaggtgcagccagtgcggctacatctgcaaggaaaaccgctgcacccaggcaaccttcgagtgtaagcagtgcggctacaagacccacgccgactacaacgccgctaagaacatcagcacctacgacatcgagaacattatcaacaagcaattggccgtacagagcaagctccattccaagaagtgtatggaggagtacatcgaggagttgggctacttagactag

SEQ ID NO: 2763 - DNA, 1356 bp, Unknown
  Bacillus sp. multi
ctgggagtcacgatcaagatcatgaagtaccagattctctgccctatgaacgttgactggacgatcttcgagaagcacttaaggaacctgacctaccaagtgcggaccatctcaaaccgcacaatccagcagctctgggagttcgacgctttgagcttcgactatttcaaggagcgcggcacatacccgactgtccaagacttgtacggctgtacccagaagaaaatcgacggctacatctaccacaccctccagagcaagtacccggacatacacaaagggaacatgagtacaacccttcaaaaaatcatcaagacttggaagtcacgacgcaacgagatccgcaagggagagatgtcgattccgagcttccgtaatcgtatccccatcgacctccacaacaactccgtggacatcacaaaggagaagaatggtgactacatcgctggcatctcactattcagtagggactttcacaaggagaacgatgatgttcctaagggcaagatattcgtgaagctcgctacccagaagcagaagtccatgaaggtgatacttgaccggctgattaaccagacgtactccaaaggagcgtgcatgatccacaagtacaagaacaagtggtatttgagcatcacttacaaattcaacgcgatcaaggagaacaaattcgacaaggagcttatcatggggattgacttgggcgggatcaacactgtgtacttcgcattcaacgagggattcatacgcagcaacatcaagagcgacgagatcaagatgttcaacgaaaggataagacagcgacgcatcaacctccttaagcagtccaaatattgcagtaactcacgtacgggcaaggggaggaccaaacgcctccagccgatagacgtcctcagcaacaagattgccaaattccgaaactctacaaatcacaagtacgccaattacatcgttaagcagtgcctgaaacataactgcggacgcatacagatggaacttctcaaggggatcagcaagaacgaccggatacttaaagactggacctactttgacctccaggagaagatcaaaaaccaggccgagatacacggcattgaggtcattaaggtggcaccggcttacacctcccagcggtgcagccaatgcggctatatctgcaaggagaatcgttgcacacaggccacgttcgagtgtaagcagtgcggctacaagacccacgccgactacaacgcagccaagaacatcagtacctacgatattgagaacatcatcaacaagcagctcgcggtgcagtcgaaacttcactccaagaagtgtatggaggagtacatcgaggagcttggataccttgactag

SEQ ID NO: 2764 - DNA, 1356 bp, Unknown
  Bacillus sp. multi
ctcggagttaccatcaagatcatgaagtaccagatcctatgccccatgaacgtggactggaccatcttcgagaaacacctcaggaacctcacctatcaagtacgaacaataagcaaccgaaccatccagcaactttgggagttcgacgctctcagcttcgactacttcaaggagcgcggcacgtaccccaccgtccaagacttgtacggctgcacacagaagaagattgacggctatatctaccacacccttcagtccaagtatccagacattcataagggcaacatgagcaccactctccagaagatcatcaagacatggaagtccaggcggaacgaaatccggaagggcgagatgtccattccgtccttccgcaacagaatcccaattgatctgcacaacaacagtgtggacatcactaaggagaagaacggggactacattgcgggaatctcgctcttcagccgggatttccacaaggaaaacgacgacgtgccaaaggggaaaatcttcgttaagctggctacccagaagcagaagtccatgaaggtgatcctcgacagactcatcaaccagacatacagcaagggcgcttgcatgatccacaagtacaagaataagtggtacttgagcattacttacaaattcaacgccattaaggaaaacaaattcgacaaggaattgataatgggcatcgacctgggtgggatcaacacggtgtacttcgcattcaatgagggcttcatccgtagcaacatcaagtccgatgagattaagatgttcaacgaacgcatacgccaacggcgcatcaacctgttgaagcagagcaagtattgttcaaactccaggaccggcaagggaaggaccaagcggcttcagcccattgacgtcctcagcaacaagatagccaaattccgcaacagcaccaaccacaagtacgccaattacatcgtcaagcagtgccttaagcacaattgcgggagaatccagatggagttacttaagggcataagcaagaacgacagaatccttaaagactggacctacttcgacctacaggagaagatcaaaaaccaggctgagatccacgggatcgaagttattaaggtggctccagcatataccagccagaggtgctcccagtgcggttacatctgcaaggagaaccgatgtacccaagctacattcgagtgcaagcagtgcggctacaagactcacgctgactacaacgcggccaagaatatcagcacgtacgacatcgagaacattatcaacaagcagttggccgtccagtcgaagctccatagcaagaaatgcatggaggagtacattgaggagctgggctaccttgactga

SEQ ID NO: 2765 - DNA, 1356 bp, Unknown
  Bacillus sp. multi
ctcggggtgacgatcaagatcatgaagtaccagatcctctgccccatgaacgtggattggacgatcttcgagaagcacctcaggaacctcacttaccaagttcggaccatcagcaaccggaccattcagcagctctgggagttcgacgccctttccttcgattacttcaaggagcgtggcacctacccaaccgtacaagacctttacggctgcacccagaagaagatcgacgggtacatctaccacactcttcagtctaagtaccctgacatacacaaggggaacatgagcacaacactccagaaaatcatcaagacatggaagtcgagccgcaacgagattcgcaaaggggagatgtccattccctcgttccgcaaccgtatcccaatagaccttcacaacaactccgttgacattacaaaggagaagaatggggactacatcgccggaatctcactcttcagccgtgacttccacaaggagaacgatgacgttccaaaagggaagatattcgttaaactagcgacccaaaagcagaagtccatgaaggtgatcctggacaggcttatcaatcagacttacagcaaaggagcgtgcatgatccacaagtacaagaacaaatggtatctatccatcacgtacaagttcaacgctatcaaggagaacaaattcgacaaggagcttatcatgggaatcgacctcggtgggatcaacaccgtctatttcgcattcaacgaggggttcatccgctcaaacattaagtccgacgagatcaagatgttcaacgaaaggatcagacagcgccggatcaaccttctcaaacagtccaagtactgttcaaactccaggaccggcaagggccggacaaagcggttgcagcccattgatgtcctgtccaacaagattgccaaattccgaaatagcacgaaccacaagtacgcgaactacattgtcaagcagtgcttaaaacacaactgtgggaggatacagatggagctactcaaggggatctccaagaatgaccgtatcttgaaagactggacgtatttcgatctccaggaaaaaatcaagaatcaggccgagatccacggaatcgaggtcatcaaggtggcacccgcctacacatctcagagatgctcgcagtgtggctatatctgtaaggagaaccgctgcacccaagcgacattcgagtgcaagcagtgcggctacaagacccacgccgactacaacgcagccaagaatatcagcacatacgacattgagaatatcattaacaagcagctcgccgttcaaagcaaactacacagcaaaaaatgcatggaggagtacattgaggagttgggctacttggattaa

SEQ ID NO: 2766 - DNA, 1356 bp, Unknown
  Bacillus sp. multi
cttggggtgaccattaagatcatgaagtaccagatcctctgccctatgaacgtggactggaccatcttcgagaagcacctccggaacctgacctaccaagtgcgtaccatctcaaatcgaacaatccagcagttgtgggagtttgacgccctctccttcgactacttcaaggagcgaggcacgtaccccaccgtccaagacctttacggctgtacgcagaagaagatagacggttacatctaccacacgctacagtccaagtaccccgacatccacaagggcaatatgtccaccaccctccaaaaaatcattaagacatggaaatcgagtcgaaacgagatccggaaaggagagatgtcgatccccagcttccggaaccgtattcccattgacctgcacaacaactccgttgacataacaaaggagaagaatggagactacatcgctggtatttcactctttagtcgggacttccataaggagaacgacgatgtacctaagggcaagatattcgtcaagctcgcaacgcagaagcagaagtccatgaaggttatcctggacagactgattaaccagacatactcaaagggagcctgcatgattcacaagtacaagaacaagtggtacttgtcgatcacttacaagttcaacgccattaaggagaacaagttcgacaaggagctgataatggggatcgacctgggtgggattaacacagtttacttcgccttcaatgagggcttcatccggtcgaacatcaagtctgacgagatcaagatgttcaacgagcgcattcgccagaggcgtatcaaccttctaaagcagagcaaatattgttctaatagtcgaaccggcaaggggcgtaccaagcgtctccagccaatcgacgtcctcagcaacaagatcgctaagttccgaaatagcactaatcacaaatacgccaactacatcgtgaagcagtgcctcaagcacaactgcggtcgcatacagatggagttgcttaagggcatcagcaagaacgaccgcatcctcaaagattggacctacttcgacctccaggaaaaaatcaagaatcaggcagagatccacgggatcgaagttatcaaggttgctcccgcctacaccagtcagcgatgcagtcaatgcggctacatctgtaaggagaaccggtgcactcaggcgacattcgagtgtaagcagtgcggctacaaaacgcacgccgactacaacgctgccaagaacatctccacatacgacatcgaaaacatcatcaataagcagttggcagttcagagcaaactgcactccaagaagtgtatggaggagtacatcgaggagttgggctacctcgactga

SEQ ID NO: 2767 - DNA, 1356 bp, Unknown
  Bacillus sp. multi
ttgggagtgaccatcaagatcatgaagtaccaaatcctctgccctatgaacgtggactggacgatcttcgagaagcacctcaggaacctcacctaccaagtgaggaccatctccaaccgtaccatccagcagctctgggagtttgacgcgctgtcctttgactacttcaaggagcgtggcacgtacccaaccgtccaagacctctacggctgcacccaaaaaaagatcgacgggtatatctatcacacacttcagtccaagtaccccgacatccacaagggcaatatgagtaccacactccagaagattatcaagacatggaaaagtagtcgcaacgagattcggaagggcgagatgagcataccctcctttcggaaccgtattcctatcgacctccacaacaacagcgtggatattacaaaggagaagaatggtgactacatcgccgggatcagcctgttctctcgtgacttccataaggaaaacgacgacgtgccgaaggggaaaatcttcgtgaagctggccacccaaaagcagaagtctatgaaggtcatcctcgaccggctcattaaccagacctactcgaaaggtgcctgcatgatccacaagtacaagaacaagtggtacttgagcatcacgtacaagttcaacgccattaaggagaacaaattcgacaaggagcttatcatggggattgatctgggagggatcaacaccgtgtactttgccttcaacgagggcttcatccgctccaacatcaagagtgacgagatcaagatgttcaacgagcgcatacgtcaaaggaggatcaacctgttaaaacaatccaagtactgctcaaactcaagaaccggcaaggggcgcaccaagcgccttcagcccatcgacgtgctctcaaacaagatagcgaaattccgtaattccactaaccacaagtatgcgaactacatcgtgaagcagtgccttaaacacaactgtggtcgtattcagatggaacttctaaagggcatctccaagaacgaccgcatattgaaagactggacttacttcgacctccaggaaaaaatcaagaatcaggctgagattcatggcattgaggttatcaaggtcgctccagcttacacctcacagcgatgctcacagtgcgggtacatctgcaaggagaaccgctgtacccaggccaccttcgaatgtaaacagtgcggatacaaaacccatgctgactacaacgccgctaagaatatctctacatacgatattgagaacattatcaacaagcagctcgcggtgcagtccaagctccacagcaaaaagtgtatggaggagtacatcgaggagctgggctacctagactga

SEQ ID NO: 2768 - DNA, 1356 bp, Unknown
  Bacillus sp. multi
ttgggcgtgaccattaagatcatgaagtaccagatactgtgccccatgaacgttgactggacgatattcgagaagcacctcagaaacttaacctaccaagtccgaaccatctcaaaccgcaccatccagcaactctgggagttcgacgccttgtccttcgactacttcaaggagcgcggcacctaccctaccgtccaagacctttatggatgtacccagaagaagattgacggctatatctaccacacacttcagtccaagtacccggacatccacaagggcaacatgagtaccacactccagaagattatcaagacttggaaatccagtcgcaacgagattcgcaaaggggagatgagcatacccagcttccggaaccgtatccctatcgacctacacaacaacagcgtggacatcactaaggaaaaaaatggcgactacatcgccggaatttccctgtttagtagagacttccacaaggagaacgatgatgtgccgaaaggcaagatattcgttaaactcgctactcagaagcagaagtctatgaaggtgatcctcgacaggctgataaaccagacgtacagcaagggtgcgtgcatgatccacaagtacaagaataagtggtatcttagtattacctacaagttcaacgcgatcaaggaaaacaagttcgacaaggagcttatcatgggaattgatcttggcggtatcaacactgtgtacttcgcattcaatgagggattcatccgttccaacatcaagtctgacgagatcaagatgttcaacgagcgtatccggcagcgccgtatcaacctcctcaagcagagcaaatactgttccaactctcgcactggcaagggccgcaccaagcgccttcagccaatcgacgtgctgagcaacaaaatcgccaaattccgtaactctaccaaccacaagtacgccaattacattgtgaagcagtgcttgaaacacaactgcggccgtattcagatggagctgttgaagggaatcagtaagaacgaccgcatcttgaaagactggacctacttcgatctacaggagaagatcaaaaaccaggccgagattcacggcattgaggttattaaggtcgctcctgcatacacatctcaacgttgctcgcaatgcgggtacatctgcaaggagaaccgctgcacccaggccacctttgagtgcaagcagtgcggctacaagacgcacgcagactacaacgcagccaagaacatcagcacctacgacatcgagaacatcatcaacaagcagctcgccgtgcagtccaagttgcacagcaaaaagtgtatggaggagtacatcgaggagttgggataccttgactga

SEQ ID NO: 2769 - DNA, 1356 bp, Unknown
  Bacillus sp. multi
ctcggggtcacgattaagatcatgaagtaccagatcctctgccccatgaacgttgactggacgatcttcgagaagcacctccggaatctcacctaccaagtcagaactatctcgaatcgcaccatccaacagctctgggagttcgacgccctcagtttcgactactttaaggaacgcggcacctacccgacagttcaagacttgtacgggtgcacgcagaagaagattgacgggtacatctatcacaccttgcagagtaagtaccccgacattcacaagggcaacatgagcacaacgctccagaagatcattaagacatggaaatcatccaggaacgagatccgcaagggtgagatgtctataccatccttccgcaatcgcatccctatcgacctacacaacaattccgtggacatcacgaaggagaagaatggagactacatcgccgggatctccctctttagtagggacttccacaaggaaaatgatgacgtcccaaagggcaagatattcgttaagttggcaacacagaagcagaagtctatgaaggtgatcctcgacagactcatcaaccagacctacagtaaaggcgcgtgcatgatccataagtacaagaacaagtggtatttgagtatcacttacaaattcaacgccattaaggagaacaagttcgacaaggagctgataatgggaattgatctaggcggtatcaacactgtgtacttcgcattcaacgagggattcatacgttcgaacatcaagtcggacgagatcaagatgttcaacgagcgtatccgtcagcggcgcatcaacctgttgaaacagagcaagtattgctcaaattcacgtaccgggaaagggagaactaaacgcctccagccaattgacgttctctccaacaagattgcaaagttccgcaactccaccaaccacaagtacgcaaactacatcgtgaagcagtgcctcaagcacaattgcggacgcatccagatggagctattgaaggggatttccaagaacgacagaatactgaaagactggacatactttgacctccaggaaaaaatcaagaatcaggccgagatccacggcatcgaggttatcaaggttgcaccggcatacacctcccagcgttgcagccagtgcggctacatctgcaaggagaaccgttgtacccaagctacattcgagtgtaagcagtgtggctacaagactcacgccgactacaatgccgctaagaacatcagcacctacgacattgagaacatcatcaacaaacagttggccgtccagagcaagctgcactccaaaaagtgtatggaggagtacatcgaggagttggggtacttggactag

SEQ ID NO: 2770 - DNA, 1335 bp, Unknown
  Bacillus sp. multi
atgaagtaccagatcctgtgccccatgaacgtggactggactatcttcgagaagcacctccggaatcttacctaccaagtccgcaccattagcaatcgcacgatacagcagttatgggagttcgacgcgctctcattcgattacttcaaggctagaggaacctaccccactgtccaggacttgtacggctgtactcaaaaaaaaatcgacgggtacatctaccacaccttgcaatccaagtaccctgacattcacaaggggaatatgagcaccacccttcagaaaatcattaagacttggaagtccaggcggaacgagatcaggaaaggcgaaatgtccataccgtcctttcgtaaccgaataccgattgaccttcacaacaactcagtggacatcactaaggagaagaacggcgactacattgcgggaatctcactgttctcgcgcgacttccacaaggaaaacgacgacgttccaaagggcaagatattcatcaagctcgccacccagaagcaaaagtccatgaaggtgatacttgaccggctcatcaatcagacctacagcaaaggggcgtgcatgattcacaagtacaagaacaagtggtacttgagcatcacttacaagttcaacgccatcaaggagaacaagttcgacaaggagttgataatggggatagacatgggtggcattaacaccgtgtacttcgcgttcaacgaggggttcatccgctccaacattaagtccgacgagatcaagacgttcaacgaacggatacgccagcggaggatcaacctccttaaacaatccaagtactgctccaactccaggactggcaaaggccgcacaaaacgactccagccaatagacgtcctctcaaacaagatcgccaaattccgcaacagtaccaaccacaaatacgcgaactacatcattaagcagtgccttaagcacaactgcgggagaatccagatggagttactcaagggaatgtccaagaacgacaaagtgcttaaagactggacctacttcgatctccaggagaagatcaaaaaccaggctgagattcacgggattgaagtgattaagatcgcgcctgcatatacttctcagcgctgctcccagtgcggctacatctgtaaggagaaccgctgcacccaggcgatgttcgaatgcaagcagtgcggatacaagacccatgcggactacaacgccgccaagaatatctccacctacgacattgagaacattatcaacaagcagcttgcggtgcagtccaagctccatagcaagaagtgtatggctgagtacatggaggagctaggctacctagactaa

SEQ ID NO: 2771 - DNA, 1335 bp, Unknown
  Bacillus sp. multi
atgaagtaccagatcctctgccctatgaacgtcgattggacaatcttcgagaaacatctcagaaatctgacctaccaagtgagaactatttcgaaccggacaattcagcagctctgggagttcgacgctctcagcttcgactacttcaaggcgcgcggcacataccctaccgtccaagacctgtacggctgcactcagaagaaaatcgacggctatatctaccacaccttgcagtctaagtatcccgacatccacaaagggaacatgagcaccacccttcagaagatcattaagacttggaagtcgcggcggaacgagatccggaaaggtgaaatgtccattccgtccttcagaaaccggataccgattgacctgcacaataactccgttgacattactaaggagaagaacggcgactatatcgctggcatcagcttgttctcacgggatttccacaaggagaatgacgacgtgccaaaaggcaaaatcttcatcaagctcgccactcagaagcagaagtccatgaaggtgatcctcgaccggcttatcaatcagacctactcgaaaggggcttgcatgatccacaagtacaagaacaaatggtatctgtcaattacttacaaattcaacgcgattaaggaaaacaaattcgacaaggagctgataatggggatagacatgggagggatcaacacggtctatttcgcattcaacgagggcttcattcgatccaacatcaagtcagacgagatcaagactttcaacgaacgaatccgtcagcgtcgcatcaacctcttgaagcagtccaagtactgttccaactctcgaaccggcaagggacggaccaagcgcctgcaacccatcgacgtgctcagcaacaagattgctaagttccgcaacagcactaaccacaaatacgcgaactacatcatcaagcagtgcctcaaacacaactgcggtcggattcagatggaacttctcaaggggatgtccaagaatgacaaggttctcaaagactggacatacttcgacctccaggaaaaaatcaagaaccaggccgagatccacggtatcgaagtcatcaagattgcccctgcctacacatctcagcggtgctcccagtgcgggtatatctgcaaggaaaatcggtgcacacaggcaatgttcgagtgcaagcagtgcggctacaagacgcacgcagactacaacgccgccaagaatatctcgacgtacgacattgagaatatcatcaacaagcagcttgccgtgcagagtaagctccatagcaaaaaatgcatggccgagtacatggaggagctgggctacctggactga

SEQ ID NO: 2772 - DNA, 1335 bp, Unknown
  Bacillus sp. multi
atgaagtaccagatcctatgcccgatgaacgtggattggaccatattcgagaagcacctccgaaacttgacctatcaagtgcggaccatatccaaccgcaccattcagcagctctgggagttcgacgcgctgtccttcgactacttcaaggccagaggcacttatcctacagtccaagacctttatggctgtacgcagaagaagattgacggctacatctaccacaccctccagtcaaagtatccagacatacacaagggcaatatgagtaccaccctccagaagattatcaagacatggaagtcaaggcggaacgagattcggaagggagagatgagtatcccatccttcagaaaccggattccaattgatctgcacaacaactccgttgacattacaaaggaaaaaaacggtgactacatcgccgggatctcactattctccagagactttcacaaggagaacgacgacgttccgaagggcaaaatcttcattaagctggctacgcagaagcagaagtccatgaaggtgatccttgaccggctcatcaaccagacctactctaagggcgcttgcatgatccacaagtacaagaacaaatggtatttgagcataacctacaagttcaatgctatcaaggagaacaaattcgacaaggagcttatcatggggatcgacatgggcggcatcaacacggtttacttcgccttcaacgaaggcttcattcgatccaacatcaagtccgatgagattaagaccttcaacgagcggataagacagagacggattaacctgctgaaacagtccaaatattgttccaactcaagaacaggaaaagggcgcaccaagcggctccagccaatagacgtgctgagcaacaagattgccaaattccgcaactctaccaaccataagtacgcaaattacatcatcaagcagtgcctcaagcacaactgcgggcgcatacagatggagttacttaagggtatgtccaagaatgacaaggtgctcaaggactggacctacttcgacctccaggaaaaaatcaagaatcaggccgagatccacgggatcgaggtcatcaagattgctcccgcctacacttcccagcggtgctcccagtgcgggtacatctgcaaggagaaccgatgcactcaggccatgttcgagtgcaagcaatgcgggtacaagactcacgcagactacaacgcagccaagaatatcagcacgtatgacatcgagaacatcattaacaagcagttggcagtccagagcaaacttcacagcaaaaaatgcatggctgagtatatggaggagcttggctacctggactag

SEQ ID NO: 2773 - DNA, 1335 bp, Unknown
  Bacillus sp. multi
atgaagtaccagattctgtgccctatgaacgtggactggaccatcttcgaaaagcacttgaggaacctcacgtaccaagtccgtacgatctcgaaccgcacgattcaacagctctgggagttcgacgcactctcattcgactacttcaaggctaggggaacctaccccaccgtacaagacctctacggatgcacccagaagaagatagacggctatatctaccacaccctccagtcgaagtatccagacattcacaaggggaatatgtcaaccaccctccaaaaaatcattaagacttggaagtcgagacgcaatgagatccgtaaaggtgaaatgtccattcccagcttccggaaccgcatacctatcgacctgcacaacaacagtgtcgatattacgaaggagaagaatggcgactacatcgcgggcatctcactctttagtagagactttcacaaggagaacgacgacgttccgaaggggaaaatcttcatcaagctcgctacgcagaagcagaagtctatgaaggtgatcctcgaccgacttatcaaccagacctactccaaaggagcttgcatgattcacaagtacaagaacaagtggtacttgtcaatcacctacaagttcaacgctatcaaggagaacaagttcgacaaggagttgataatgggcattgatatgggagggataaacacagtttacttcgccttcaacgagggattcatcaggagcaacatcaagagcgacgagatcaagaccttcaacgaacgcatccgtcaacgccggattaacctgcttaaacaaagcaaatactgctcaaactccaggactgggaaagggcgcaccaagcgattgcaacctatcgacgtcctctccaacaagatcgccaagttccgtaattcaacgaaccacaagtacgccaactacatcatcaagcagtgcttgaagcacaactgtgggagaatccaaatggaactgctcaagggcatgtccaagaacgacaaggtgttaaaggactggacttacttcgacctccaggagaagatcaaaaaccaggctgagatccacggcatcgaagtgattaagatcgctcccgcatacacctcacagaggtgctcccagtgcggctacatctgtaaggagaaccggtgcactcaggcaatgttcgagtgcaagcagtgcggatacaaaacgcacgcagactacaacgcggccaagaacataagcacgtatgacattgagaacattatcaataagcagcttgccgtgcagagtaagctccactccaaaaagtgtatggcagagtacatggaggagcttggctatctcgactga

SEQ ID NO: 2774 - DNA, 1335 bp, Unknown
  Bacillus sp. multi
atgaagtaccagattctctgccccatgaacgtggattggactatcttcgagaagcacctccgcaacctgacctaccaagttcgtactatcagcaaccggacgatacagcagctctgggagttcgacgcgctgtccttcgactacttcaaggcgcgtggaacttaccctaccgtacaagacctttacggctgcacccagaagaaaattgacgggtacatctaccacaccctccaatcgaagtatcccgacatccacaaggggaatatgtccacaaccctccaaaaaatcatcaagacctggaagtcccgccgaaacgagattcgaaagggagagatgagcatccccagctttcgtaatcgcatcccaatcgacttgcacaacaacagcgttgacattactaaggaaaaaaatggcgactacatcgctgggattagcctctttagccgcgatttccacaaggagaacgacgacgtgcctaaggggaagatattcatcaagctggccacccaaaagcagaagtctatgaaggtgattctcgaccgccttatcaaccagacatactcgaagggtgcctgcatgatccacaagtacaagaataagtggtacttatctatcacctacaagttcaacgccattaaggagaacaaattcgacaaggaactgataatgggaatcgacatgggtgggatcaacaccgtgtactttgccttcaacgagggattcattcgttccaacatcaagtcggacgagatcaagacgttcaacgagcgtatccgccagcgacgcatcaacctcctcaaacaatccaaatattgcagcaactcccgcactgggaaggggaggaccaagcggcttcaacccattgacgtgctctccaacaagattgcgaaattcagaaatagtaccaaccacaagtatgccaactacatcattaagcagtgcttgaagcacaactgcggacggatacaaatggagctgctcaagggcatgtccaagaatgacaaggtgttgaaagactggacgtacttcgatctacaggagaagatcaaaaaccaggccgagatccacggaattgaggtcatcaagattgcaccagcctatacgagccagcgttgcagccaatgtggctatatctgtaaggagaatcgttgcacccaggccatgttcgagtgcaaacaatgcggctacaaaacccacgcggactacaacgcggccaagaacattagcacgtacgacatcgagaacatcatcaacaagcaattggctgtacagagtaagttacacagcaagaagtgtatggcagagtacatggaggagctgggctatctggactga

SEQ ID NO: 2775 - DNA, 1335 bp, Unknown
  Bacillus sp. multi
atgaagtatcagattctctgcccgatgaacgtcgattggaccatcttcgagaaacacctcagaaacctgacctaccaagtcaggaccatctccaaccggaccatccagcagctttgggagttcgatgcactctccttcgactatttcaaggcgcgcggcacctacccgaccgtccaggacttgtacggctgcacccagaagaagatcgacggctacatctatcacacccttcagtccaagtacccagatattcacaaaggcaatatgtcaactaccctccaaaaaatcatcaagacgtggaaaagccgtcgcaacgagatcaggaaaggtgagatgtcgatcccctccttccgcaaccggataccaattgacctccacaacaactcggttgacatcactaaggagaagaacggcgactacatcgccggaatctcactgttcagccgagactttcacaaggagaacgacgacgtgcccaaaggcaagatattcattaagctggcaacacagaagcaaaagtctatgaaggtgatcttggaccggctcatgaaccagacttactcgaagggagcgtgcatgatccataagtacaagaacaagtggtacttgtctatcacgtacaaattcaacgcgattaaggagaacaagttcgacaaggagctaatcatggggatcgacatgggtggcatcaataccgtttacttcgcgttcaacgaggggttcatccggagtaacattaagtctgacgagatcaagaccttcaacgagcgtatccgtcagcggcggatcaatctgcttaaacaatccaaatattgttcgaactcccggacagggaagggccgaacgaagcgcttgcagcctattgatgtgctcagcaacaagatcgccaaattccgtaacagtacaaaccacaagtacgccaactacattatcaagcagtgcctcaagcacaactgcggtcgcatccaaatggaactcttgaaggggatctccaagaacgacaaggtgctcaaagactggacgtacttcgatctccaggaaaaaatcaagaatcaggcagagatacacggtattgaggtgattaagatcgcacccgcctacacatcccagagatgcagccagtgcggttacatctgcaaggaaaaccgctgcacccaggccatgttcgagtgcaagcaatgcgggtacaagacacacgctgactacaacgctgccaagaacattagcacctacgacattgagaacattatcaacaaacaacttgcagtacagagtaaactgcactccaaaaaatgcatggcagagtacatggaggaattgggctatctggactga

SEQ ID NO: 2776 - DNA, 1335 bp, Unknown
  Bacillus sp. multi
atgaagtaccaaatactctgtcctatgaacgtggactggaccatcttcgagaagcacctcaggaacctcacgtaccaagtccggacaatctccaatcgcactatccagcagctctgggagttcgacgcccttagtttcgactatttcaaggcgcggggcacttaccccacggtccaagacctttacggatgcacccagaagaagatcgacggctacatctaccacacccttcagagcaagtaccccgacatccacaaggggaacatgagcactactttacaaaaaatcatcaagacttggaagtctcgacgtaacgagatccggaagggcgagatgtccatcccgagcttccgaaatcgaataccaatagacctccacaataacagcgttgacatcactaaggagaagaacggggactacatcgctggcatctccctgttcagccgcgactttcacaaggagaacgatgatgttccgaagggcaaaatcttcatcaagctggctacccagaagcagaagtctatgaaggtgattctcgaccgcctgatgaaccagacttactcaaaaggggcctgcatgatccacaagtacaaaaacaaatggtacttgtccatcacctacaagttcaacgctatcaaggaaaacaaattcgacaaggagttaatcatggggatagacatgggtggcatcaacacggtgtacttcgccttcaacgaggggttcatccgtagtaacattaagtcagacgagattaagaccttcaacgaacgaatcagacagcgccggattaacttgcttaaacagtccaaatattgttcaaactctcgcaccggaaagggacggaccaagaggcttcaacccatcgacgtcttgtccaacaagatagctaagttccgaaactccaccaaccacaagtatgctaactacatcattaagcagtgtctaaagcacaactgcgggcgcatccagatggaactgttgaagggcatatctaagaacgacaaggtgcttaaagactggacgtacttcgatctccaggaaaaaatcaagaatcaggcagagatacacggcattgaggtcatcaagatcgctcccgcatacaccagccagaggtgctcccagtgcgggtatatctgtaaggagaaccgctgcacccaggcgatgttcgagtgcaagcagtgcgggtacaagactcacgcggactacaacgcggccaagaacatcagcacctacgacatcgagaacattatcaacaaacaactggcagtgcagtcgaaactgcactccaaaaaatgcatggctgagtacatggaggagctgggttaccttgactga

SEQ ID NO: 2777 - DNA, 1335 bp, Unknown
  Bacillus sp. multi
atgaagtaccagatcctgtgccccatgaacgtggactggaccatcttcgagaagcacttgaggaacttgacctaccaagtgaggacgatctccaaccgtaccatccagcagctttgggagttcgacgccttgtctttcgactactttaaggcacgtggcacgtaccccacggtccaagacctttatggctgcactcaaaaaaagattgacggctatatctatcacacccttcagtcaaagtacccggacattcacaaggggaatatgtcaaccaccctccagaagatcattaagacttggaaatcgcgtaggaacgagatcaggaagggcgagatgtccattccctcattccgcaatcggattccgattgacctgcacaacaacagcgttgacattacgaaggagaagaatggcgactacatcgctgggatctcgcttttcagtagagacttccacaaggagaacgatgatgttcctaagggcaaaatcttcatcaagctggcgacccagaagcaaaagtccatgaaggtgatactggatcggcttatgaaccagacctacagcaagggcgcgtgcatgatccacaagtacaagaacaagtggtacttgagcatcacctacaagttcaacgcgatcaaggagaacaagttcgacaaggagcttatcatgggcattgacatgggtggcatcaacacggtgtacttcgccttcaacgagggattcattcgttccaatatcaagagtgacgagatcaagactttcaacgagcggatcaggcagcgccggatcaacctgctcaagcagtccaaatattgctcaaattcaaggacgggcaaaggccgcacgaagcgattgcagcccatcgacgtgctcagtaacaagattgccaagttccgtaattccacgaaccacaagtacgcgaactacatcatcaagcagtgtctcaaacacaactgtggccgtatccagatggagctgctcaaaggaatatccaagaacgacaaggtgttgaaagactggacatacttcgacctccaggagaagatcaaaaaccaggccgaaatccacggaattgaggttatcaagattgcaccagcctacacttcccagagatgcagccagtgcggctatatctgtaaggagaaccggtgcacgcaagcgatgttcgagtgtaagcagtgcgggtacaagacccacgctgactacaatgccgccaagaatatctccacatacgacatcgagaacatcatcaacaagcaactcgctgtccaatccaagctgcacagcaagaagtgtatggctgagtacatggaggagttgggataccttgactga

SEQ ID NO: 2778 - DNA, 1335 bp, Unknown
  Bacillus sp. multi
atgaagtaccagatcctgtgcccgatgaacgtggactggacgatattcgagaaacacctccggaacttaacgtaccaagtacggaccatctcgaaccggacgatccaacagctttgggagttcgatgcactttccttcgactatttcaaagcccgtggcacctaccccaccgtccaagacctttacggctgcacccagaagaagatcgacgggtatatctatcatacactccaatccaagtacccggacatccacaagggcaatatgagcacgacgctccaaaaaatcatcaagacatggaaatctaggcgtaacgagatcaggaaaggtgaaatgtccatcccttccttccggaaccggattcccattgacttgcacaacaactccgtggacatcactaaggagaagaacggcgactacatcgccggtatatccctgttcagcagagacttccacaaggagaacgacgacgttccaaagggcaaaatcttcatcaagctcgccacccagaagcagaagtccatgaaggttatcctggacagactcatgaaccagacgtacagtaagggcgcgtgcatgatccacaagtacaaaaacaaatggtacttgtccataacctacaaattcaacgccattaaggaaaacaaattcgacaaggagttgataatgggcatcgacatgggcgggatcaacacggtgtacttcgcgttcaacgagggcttcatccgaagtaacatcaagtccgacgagattaagactttcaacgagcgcatcaggcaacggcgcatcaacctcttaaagcagtccaaatattgttccaactcacgtacggggaaggggaggacgaagcgattgcagcctatcgacgtcctttcaaacaagattgcgaaattccggaacagcaccaaccacaagtatgccaattacatcatcaagcagtgcctcaagcacaactgcggccgtatccagatggaacttctcaagggcattagcaagaacgacaaggtgctaaaggactggacttacttcgacctccaggagaagatcaaaaaccaggccgaaatccacgggattgaggtgattaagatagccccagcttacacctctcagcgttgctcgcagtgcgggtatatctgtaaggagaaccggtgtactcaggctatgttcgagtgcaaacagtgcgggtacaaaacacatgcagactacaacgccgccaagaacatcagcacatacgatattgaaaacatcatcaacaagcagctcgccgtccagagcaaacttcactccaagaagtgtatggcagagtacatggaggaactcggttacttggattaa

SEQ ID NO: 2779 - DNA, 1335 bp, Unknown
  Bacillus sp. multi
atgaagtaccagatcctatgccccatgaacgtggactggaccatcttcgagaagcacctccgtaacctgacctatcaagtacgaaccatcagcaaccgcacgatccagcaactttgggagttcgacgccttgtccttcgactactttaaagccagaggcacttaccctacagtgcaagacctctacggctgcacccagaagaaaatcgacggctacatctatcatactcttcagtccaagtaccctgacatccacaaggggaacatgagcaccactttgcaaaaaatcatcaagacatggaaatctcggcgtaacgaaattcgcaaaggcgagatgtccatcccctccttccggaaccgcatacctatagacctgcacaacaactccgttgacattactaaggagaagaatggcgactacatcgctggcatctcgctctttagccgcgacttccacaaggaaaatgacgacgtgccgaaagggaagatattcatcaagttggctacacagaagcagaagtctatgaaggtgatcttggacaggctcatgaaccagacgtacagcaagggcgcgtgcatgatccataagtacaagaataagtggtacttgtccatcacctacaaattcaacgcgattaaggagaacaagttcgacaaggagcttatcatggggatagacatgggcgggatcaacaccgtgtactttgccttcaacgaggggtttatccgttcgaacatcaagtcggacgagatcaagacattcaacgaaaggatacggcagcgaaggatcaatctacttaaacagtccaagtactgctcaaactcaaggaccggcaagggccgtactaagcgcctgcaacccatcgacgtcctgtcaaacaagatcgccaagttccgtaattcgaccaaccacaagtatgcgaactacatcatcaagcagtgcctcaaacacaactgcggtcgcattcagatggagttacttaaggggattagcaagaacgacaaagtgttgaaggactggacatacttcgacctacaggagaagatcaaaaaccaggccgagatccacggtatcgaagttattaagatagcaccagcctacaccagccagaggtgtagtcaatgcgggtatatctgcaaggagaaccggtgcacccaggccatgttcgagtgcaagcagtgcggatacaagacacacgcggactacaacgcggccaagaacatatcaacctacgacatcgagaacattatcaacaagcagctcgcggtgcagagcaagctccacagcaagaaatgcatggcggagtacatggaggaacttggctacctcgactag

SEQ ID NO: 2780 - DNA, 1356 bp, Unknown
  Bacillus sp. multi
ctcggggtcacgatcaagattatgaagtaccagatcctctgtcccatgaacgtggactggacgatcttcgaaaagcagctccgaaacctcacgtaccaagtccgcaccatatcgaatcgtaccatccagcaactgtgggagttcgatgcgctctcattcgattacttcaaggagcgcggcacgtacccgaccgtacaagacctttatggctgcacccagaagaaaatcgacgggtatatctaccacaccttgcaatccaagtaccccgacatccacaagggcaacatgagcacgacgctccagaagattatcaagacttggaaatctcgtaggaacgagatacgaaaaggagagatgtccataccttcctttcgtaacagaatccctattgatcttcacaacaactccgtggacatcatcaaggaaaaaaatggcgactacatcgccgggatctccctgttcagccgcgacttccacaaggagaacggtgatgttcctaaggggaagatattcgtgaaactcgggacgcagaagcagaagtctatgaaggtgatcctggatcgccttatcaaccagacatactcaaaaggagcgtgcatgatccacaagtacaagaacaagtggtatttgagcatcacgtacaagttcaacgcgattaaggagaacaaattcgacaaggaactgattatgggaatcgacatgggcggcatcaacaccgtgtactttgctttcaacgaggggttcatccggtccaacatcaagagcgacgagatcaagatgttcaacgagcgtatccggcagaggaggatcaacctcctcaagcagtcgaaatactgctccaactccaggactggaaaaggtcgtaccaaacgccttcagcctatcgacgtcctgtccaacaagattgctaagttccgaaatagcaccaaccacaagtacgcaaactacatcgttaagcagtgcctcaagcacaactgcggacgcatccaaatggaattgctcaaaggaatctccaagaacgacaaggtgttgaaggactggacatacttcgatctccaggaaaaaatcaagaaccaggcggagatatacgggattgaggtgattaaggtcgtacccgcatacaccagtcagaggtgcagccagtgcggctacatctgtaaggaaaatcgttgcacccaggccatgttcgagtgcaagcagtgcggatacaagacccacgccgactacaatgctgccaagaatatctccacctacgatattgagaacatcatcaacaagcagttggctgttcaaagtaagctgcactccaagaagtgtatggaggagtacattgaggagcttggatacttagactag

SEQ ID NO: 2781 - DNA, 1356 bp, Unknown
  Bacillus sp. multi
ctaggtgtgacgattaagatcatgaagtaccagatactctgtcctatgaacgtggactggacaatcttcgagaagcagctccgcaacctcacctaccaagttcgtacaatatccaaccgaacgatccagcagctctgggagttcgacgccctttcgttcgactacttcaaggagcgcgggacttatccaacggtccaagacctttatgggtgcacgcagaagaaaatcgacggttacatctatcacaccctgcaaagtaagtacccagacatccacaaggggaacatgagtaccaccctccagaagatcatcaagacctggaaatcacggaggaacgagattcggaagggcgagatgtccatacccagcttccggaacaggatacctatcgacctccacaacaactctgttgacatcatcaaggagaagaacggggactacatcgccggaatttcgctcttcagccgcgacttccacaaggaaaacggcgacgtccctaagggcaaaatcttcgtaaaactcggcacccagaaacagaagtccatgaaggtgattctggatcgcctcatcaatcagacatacagtaaaggagcctgcatgatccacaagtacaagaacaagtggtatttgagcatcacctacaagttcaacgctattaaggagaacaagttcgacaaggagctaatcatgggaattgacatgggagggatcaacacggtttacttcgctttcaacgagggcttcatccgttccaacatcaagagcgacgagattaagatgttcaacgagcgcatccgacagaggaggatcaatctgttaaagcagtctaagtattgttccaattcccgcaccgggaaggggcggactaagcgcttgcagcctatcgacgtgctgagcaacaagatcgccaagttcagaaactcaactaaccacaagtacgctaactacatcgttaaacagtgcttgaaacacaactgcgggcgcatccagatggagcttctcaagggtatttccaagaacgacaaggtgctcaaggactggacctacttcgatctacaggagaagatcaaaaaccaggctgagatatacggaattgaagtcatcaaggtggtccctgcttacacttcacagaggtgcagtcagtgcggctatatctgcaaggagaaccggtgcacccaagctatgttcgaatgcaagcagtgcggctacaagacgcacgccgactacaacgcggctaagaacatctctacctacgacatcgagaacattatcaataagcagttggccgtgcagtctaaactccacagcaaaaaatgcatggaggagtacattgaggagttgggctacctcgactag

SEQ ID NO: 2782 - DNA, 1356 bp, Unknown
  Bacillus sp. multi
ttgggagtgaccatcaagatcatgaagtatcagatactctgccctatgaacgttgactggacgatcttcgagaagcagctcagaaacctcacctatcaagtccggaccattagcaacaggacgatccagcagctctgggagttcgacgcactgtccttcgactacttcaaggaacggggcacctacccaaccgtccaagacctttacggttgcactcagaagaagatcgacggctacatctaccataccctccagagcaagtaccccgacatccacaaagggaacatgagtaccaccctccagaagattatcaagacctggaagtcccggcgaaacgagatccggaagggcgagatgagtatcccctcattccgcaaccgcatccctatcgacttgcacaacaactccgtggacatcatcaaggagaagaacggcgactacatcgctggcatctctctgttcagtagggatttccataaggagaacggcgatgttcctaagggcaaaatcttcgtcaagctggggacgcagaagcagaagtccatgaaggtgatcctcgacaggcttatcaaccagacctactctaagggcgcgtgcatgatccataagtacaagaacaaatggtacttgtcaatcacctacaagttcaacgccatcaaggagaacaagttcgacaaggagctgattatgggcattgatatgggtgggatcaacacagtttacttcgcattcaatgagggcttcatccggtcgaacatcaagtcggacgagattaagatgttcaacgagcggatcagacaacgacgcattaacctcctaaagcagtccaagtattgctccaattctcgtaccggcaagggccgcactaagcggctccagcctatcgacgtgctgagcaacaagattgccaaattccgcaatagcacgaaccacaagtacgccaactacatcgtcaagcagtgcctcaagcacaactgcggacgtatccagatggaactcctaaagggtatcagcaagaacgacaaggtgcttaaggactggacctacttcgacttacaggagaagatcaaaaaccaggccgagatatacgggatcgaggtgattaaggtcgtgcccgcctacacttctcaaagatgctcccagtgcggctatatctgtaaggagaaccgatgcacccaagcaatgttcgagtgcaagcagtgtggctacaagacccatgccgactacaacgcagctaagaacatcagcacctacgacattgaaaacatcatcaacaaacagctcgccgtgcagagtaagctccactccaagaaatgcatggaggagtacattgaggaattgggctacctggactag

SEQ ID NO: 2783 - DNA, 1356 bp, Unknown
  Bacillus sp. multi
ctgggcgtgacgattaagatcatgaagtaccagatcctctgccccatgaacgttgactggacgatcttcgagaagcagcttcgcaacctgacgtaccaagtgagaacgatctcaaatcggactatccagcagctctgggagttcgatgcactgagcttcgactacttcaaggaacgcggcacctaccccacggtacaagacctatatggctgcacccaaaaaaagattgacgggtacatctaccacactctccagtccaagtaccccgacatacacaaggggaatatgagcaccacccttcaaaaaatcatcaagacttggaaatcccgccgcaacgagatccgaaagggtgagatgtctattccctccttccgtaaccgtatccctattgacctgcacaacaactccgttgacattatcaaggagaagaacggagactatatcgctgggataagcctgttctctagggacttccacaaggagaatggagacgtaccaaaggggaagatattcgtcaaactcggcacacagaagcagaagtctatgaaggtcatcctcgacagacttatcaaccagacctattcaaaaggcgcgtgcatgattcacaagtacaagaacaagtggtatttgagcatcacatacaagttcaacgccatcaaggaaaacaagttcgataaggagctgattatggggatcgacatgggcgggattaacactgtgtacttcgccttcaacgagggcttcatccggtcgaacatcaagtcggacgagattaagatgttcaacgagcgcattagacaaaggcgcattaacctgctcaagcaatccaaatactgctccaacagccgaacgggaaaggggcggactaagcgtttacagccaatcgacgtcctgtcaaacaagatcgccaagttccgcaactccaccaaccacaagtacgcaaactacatcgtaaagcagtgccttaagcacaactgcggaaggatacaaatggagctgctcaaagggatctctaagaacgacaaagtgctcaaggactggacctacttcgacttacaggagaagatcaaaaaccaggcagagatatacgggattgaagtcatcaaggtcgtccccgcctacaccagccagaggtgctcacagtgcgggtacatctgcaaggagaaccggtgcacacaggctatgttcgaatgcaaacagtgcgggtacaagacccacgccgactacaacgccgccaagaacatcagtacctacgatattgagaacatcatcaacaagcagctcgcagtacagtcgaagctacactccaagaagtgtatggaggagtacatcgaggaactcggctaccttgactag

SEQ ID NO: 2784 - DNA, 1356 bp, Unknown
  Bacillus sp. multi
ctaggagtcacgattaagatcatgaagtaccagatcctgtgccccatgaacgtggactggaccatcttcgagaagcaactccgtaacctaacgtaccaagtcaggacgattagcaaccggaccatccagcaactctgggagttcgacgccctgagcttcgactacttcaaggagcgcggaacgtaccccaccgtccaggacttgtacggctgcacgcagaagaagatcgacggctatatctaccacacccttcagtcgaagtacccggatattcacaaggggaacatgagcaccaccttacaaaaaatcatcaagacctggaaaagtaggcgtaacgagatccggaagggagagatgtctatcccctccttccgtaaccgcataccgatagacctccacaacaactccgtggacatcatcaaggagaagaacggcgactacatcgctggcatctctctgttcagtagggactttcacaaggagaatggggacgttcctaagggcaaaatcttcgttaagctgggcacgcaaaagcagaagtctatgaaggtgatcttggatagacttatcaaccagacctactctaaaggagcctgcatgatacacaagtacaagaataagtggtacttgagtattacatacaaattcaacgccatcaaggagaacaaattcgacaaggagctgattatgggaattgacatgggcggcatcaacacagtgtacttcgccttcaatgagggcttcatccggtccaacatcaagtccgacgagatcaagatgttcaacgagcgtatcaggcagagacggattaacctccttaagcagtctaagtattgcagcaactcccgaaccgggaaggggcgcaccaagcgtttgcagcctatcgacgtcctgtccaataagatcgctaagttccgaaactctaccaaccacaagtacgccaactacattgtcaagcagtgcttgaaacacaactgcgggcgcattcagatggagctgttgaaggggataagcaagaatgacaaggtgctcaaagactggacgtacttcgacctccaggaaaaaatcaagaatcaggctgaaatctatggaatcgaggtcatcaaggtggtgcccgcatacacaagccagaggtgctcacaatgtggttacatctgcaaggaaaaccgctgcactcaagcaatgttcgagtgcaaacagtgcggctacaagacgcacgctgactacaatgcagccaagaacatctctacctacgacatcgagaatatcatcaacaaacagctcgcagtgcagagtaagctccactccaagaagtgtatggaggagtacattgaggaattgggttacctcgactga

SEQ ID NO: 2785 - DNA, 1335 bp, Unknown
  Bacillus sp. multi
atgaagtaccagattctgtgccctatgaacgtggactggaccatattcgagaagcaccttcgcaacctgacctaccaagtccgcactattagcaaccgcaccatacagcagctttgggagttcgatgccttgtcattcgactacttcaaggaacgtggcacatatcccaccgtgcaagacctctacggctgcacgcagaagaagatagacgggtacatctaccacactcttcaatccaagtaccccgacatccacaagggcaatatgtcaaccaccctacagaagatcattaagacatggaaatcgagacggaacgagattcgcaagggtgagatgagcattcccagcttccgcaaccgcatccccatcgacctccacaacaacagcgtggacatcattaaggagaagaacggtgactacatcgccgggatttcccttttcagtcgtgacttccacaaggagaacggcgacgtgcctaagggcaagatattcgttaaactaggaacccagaagcagaagtccatgaaggtgatcttggaccgcctgattaaccagacgtactcaaaaggtgcttgcatgattcacaagtacaagaacaagtggtatctgtcaattacttacaagttcaacgcgatcaaggagaacaagttcgacaaggagcttatcatgggaattgacatgggtggtatcaacacagtgtacttcgcattcaacgagggcttcattcgttccaacattaagagtgacgagatcaagatgttcaacgaacgaatcagacagcgccggatcaacttattgaaacagtccaaatattgctcaaactcacgcacaggcaagggccggaccaagcgacttcagcccatcgacgtgctcagtaacaagatagccaagttcagaaacagcacgaaccacaaatacgccaactacatcgtgaagcagtgcctcaagcacaactgtgggagaatccagatggagcttctaaaggggatcagcaagaacgacaaggtgctcaaggactggacctacttcgacctccaggaaaaaatcaagaaccaggccgagatatacgggatcgaggtcatcaaggttgttcctgcatacaccagtcagcggtgcagtcagtgcgggtacatctgcaaggagaatcggtgcacgcaagcaatgttcgagtgcaagcagtgcggttacaagactcacgccgactacaacgcagccaagaacatatcgacctacgacattgagaacatcattaacaagcagttggccgtgcagagtaaactccacagcaagaaatgcatggaggagtatatcgaggagttgggttacctggactaa

SEQ ID NO: 2786 - DNA, 1335 bp, Unknown
  Bacillus sp. multi
atgaagtaccaaatactgtgtccgatgaacgtggactggactatcttcgagaagcacctccgcaacctgacctaccaagtgcgtaccatctccaaccggacgatccagcagttgtgggagttcgacgccctatcctttgactacttcaaggagcgcgggacgtacccgaccgtacaagacctctatggctgcacccagaagaagatagacgggtacatctaccacaccctccagtctaagtacccagacatccacaagggcaatatgagcacaaccttgcagaagatcattaagacttggaagtcaaggaggaacgagatccgcaaaggcgagatgagcattccgtccttccgaaaccgaataccgattgacctccacaacaacagcgtggacatcatcaaggaaaaaaacggggactatatcgctggcatctccctattcagcagagatttccataaggagaacggagacgtacctaagggcaagatattcgtgaagctcggcacccagaagcagaagtctatgaaggtgattctcgacaggctgataaaccagacatactcaaagggagcgtgcatgatccacaagtacaagaacaagtggtacttgagcattacttacaagttcaatgccatcaaggagaacaaattcgacaaggagctgattatgggaatcgacatgggcggcatcaataccgtgtactttgctttcaacgaggggttcatcagaagcaacatcaagtccgacgagattaagatgttcaacgagcgcatcaggcagcgtcgcattaacctccttaagcagagcaaatactgttccaactccaggaccgggaaagggaggaccaagcgtcttcaacctatcgacgtgctttcgaacaagattgccaagttccgtaacagtaccaaccacaagtacgccaactacattgttaagcagtgcttaaaacacaactgcggcagaatccaaatggagttgctcaaagggatcagtaagaacgacaaggttctcaaggactggacgtatttcgatctccaggagaagatcaaaaaccaggcggagatatacggtatcgaagtcatcaaggtggtgcccgcctacacctcgcagcggtgctcccagtgcgggtacatctgcaaggagaaccgctgcacccaggccatgttcgagtgcaagcagtgcggctacaagacacacgccgactacaacgcagctaagaacatcagcacttacgacattgagaacatcattaacaagcaattggcagtccagagcaagctgcacagcaaaaaatgcatggaggagtacatcgaggagttgggttacttggactga

SEQ ID NO: 2787 - DNA, 1335 bp, Unknown
  Bacillus sp. multi
atgaagtaccagattctctgccccatgaacgtggactggaccatcttcgagaagcacctgaggaatctgacttaccaagtgcgaactatctccaaccgcaccatccagcagctttgggagttcgacgcgctcagcttcgattacttcaaggagcgcggcacctaccctaccgtccaagacctgtacggttgcactcaaaaaaagatcgacgggtatatctatcacacactacagtccaaatacccagacatacacaagggcaacatgagcactacccttcagaagattatcaagacttggaaatctcgtcgaaacgagatcaggaagggagagatgtccattccgagcttccggaacagaatccctattgacctgcacaacaactccgtggacatcatcaaggagaagaacggcgactacatcgcgggcatatcacttttcagcagagacttccacaaggagaacggcgacgtgccgaagggcaagatattcgtgaagctgggaacgcagaagcagaaatctatgaaggtcatcctcgaccgcctcatcaaccagacctactccaaaggagcgtgcatgatccacaagtacaagaacaagtggtatctgtccattacttacaagttcaacgctatcaaggagaacaagttcgacaaggagctgataatgggaatcgacatgggtgggataaacacagtgtacttcgccttcaacgagggattcataagatccaacatcaagagcgacgagatcaagatgttcaacgagcgtatcagacaacggaggatcaacctgctcaagcaaagcaagtactgttccaattctcgcacaggaaaagggcgcactaagaggctgcaacccatcgacgtcctcagcaataagattgctaagttccgtaattcgactaaccacaagtacgccaactatatcgtgaagcagtgcctcaagcacaactgcggacggatacagatggaacttctaaagggtatctctaagaacgataaggtgctaaaggactggacctacttcgacctccaggaaaaaatcaagaatcaggccgagatatacgggatcgaggttattaaggtcgtgccagcctatacctcccagcggtgctcccaatgcggctacatctgtaaggagaatcgctgcacccaggcgatgttcgagtgcaagcaatgcggctacaagacccacgccgactacaacgccgccaagaacatatcgacctacgacatcgagaacatcatcaacaagcagcttgcagtgcaatcgaagctgcactccaagaaatgcatggaggagtacattgaggaattgggatacctagactag

SEQ ID NO: 2788 - DNA, 1335 bp, Unknown
  Bacillus sp. multi
atgaagtaccagatcctctgccccatgaacgtggactggaccatcttcgagaagcacctcaggaatctgacctaccaagtccgcacaatctccaatcgcaccattcagcagctctgggagttcgacgcgctttccttcgattacttcaaggagcgcggaacctaccccacagtccaggatctctatggctgcacccaaaaaaagatcgacggctatatctatcacaccttgcaatccaagtacccagacatccacaaggggaatatgagtacgaccttgcagaaaatcatcaagacctggaagtcacgaaggaatgagatccgcaaaggtgaaatgtcgatccccagcttccggaacaggatacctatcgacctccacaacaacagtgtggacatcatcaaggagaagaatggcgactacattgctgggatcagtctattcagtagggacttccacaaggagaacggggatgtgccgaagggcaagatattcgtaaagctcggcacccagaagcagaagtccatgaaggtgatacttgatcggcttatcaaccagacatactctaaaggagcgtgcatgatccacaagtacaaaaacaagtggtatttgagcatcacttacaagttcaacgctatcaaggagaacaaattcgacaaagagctgataatgggcattgacatgggtgggatcaacaccgtgtactttgccttcaacgagggcttcatacgaagcaatatcaagtcagacgagatcaagatgtttaacgagcgcataaggcagcggaggataaacctcctcaagcagagcaagtactgtagtaactctcgcacaggaaaagggcgtactaagcgtcttcaacccattgacgtattgtccaacaagatagccaagttcagaaactcgactaaccacaagtacgcaaactacatcgttaagcagtgcctcaagcacaactgcgggcgcatccagatggagctactcaaggggatcagcaagaacgacaaagtgctaaaggactggacctactttgacctacaggaaaaaatcaagaaccaggccgagatatacggtatcgaggtcatcaaggtggtgcccgcctatacttcacagaggtgcagccagtgcggctatatctgtaaggagaaccgatgcacacaagcgatgttcgagtgcaagcagtgcgggtacaagacccacgctgactacaatgcggccaagaacatcagcacctacgacatcgagaacatcatcaacaagcaacttgccgtccagagcaaattgcatagcaagaagtgtatggaggagtacattgaggaactggggtatctcgactga

SEQ ID NO: 2789 - DNA, 1335 bp, Unknown
  Bacillus sp. multi
atgaagtaccagatcctatgcccgatgaacgtggactggaccatcttcgagaaacacttaaggaacctcacctaccaagtaagaacgatctccaaccgcaccatccaacagttgtgggagttcgacgcactctccttcgattacttcaaggagcgcgggacgtacccgaccgtacaagacctgtacggctgcactcaaaaaaagatcgacgggtacatctaccacaccttgcagtctaagtaccctgacatccacaaggggaacatgagcaccacccttcaaaaaatcatcaagacttggaaatcacggaggaacgagatccgtaaaggcgaaatgtccattcccagtttccgtaacaggatacccatcgacttgcacaacaacagcgttgacatcatcaaggagaagaatggagactacatcgctggcatctccttattctcccgtgacttccacaaggagaacggggacgtgccgaaggggaaaatcttcgtgaaattgggaacacagaagcaaaagtccatgaaggtgatccttgacaggctgattaaccagacttactcaaagggcgcgtgcatgatccacaagtacaagaacaagtggtatctctcaatcacctacaagttcaacgctattaaggaaaacaagttcgacaaggagctgataatggggatcgacatgggtgggataaacactgtttacttcgccttcaatgagggcttcatccgctccaacatcaagtcagacgagattaagatgttcaacgaacggatacgtcagagacgcatcaacctgctaaagcagagcaagtactgctcaaacagccggacggggaaaggtcgcaccaaaaggcttcagccgattgatgtgctctccaacaagatcgctaagttccggaatagcactaaccacaagtatgccaactacatcgttaagcagtgcttaaagcacaactgtggacgtattcagatggagctgttgaaggggatcagcaagaacgacaaggtgctcaaagactggacttactttgacctccaggagaagatcaaaaaccaggcagagatatacggcatcgaggtcattaaggtcgtccctgcttacaccagccagcggtgctcacagtgcggctacatctgcaaggagaaccggtgcacacaggcaatgttcgagtgcaagcagtgcggctacaagacccacgcggactacaacgcggctaagaacatcagcacctacgacatcgagaacatcatcaacaagcagctcgccgtccagagcaagctccacagcaagaaatgcatggaggagtatatcgaggaacttggatacctcgattga

SEQ ID NO: 2790 - DNA, 1326 bp, Unknown
  Bacillus sp. multi
atgaagtaccagatcctgtgccccatgaacgtggactggatcatcttcgaaaagcacctcaggaacctcacgtaccaagtgcgaaccatctccaaccgcaccatccaacagctctgggagttcgatgcgttgtccttcgattacttcaaggtccgtggaacttatccaactgttcaagacctttacggctgtacccaaaaaaagatcgacggctatatctatcacaccttgcaaagcaagtatcccgacatccacaagggcaatatgagcaccaccctccagaagatcatcaagacgtggaaaagcagacgcaacgagatccgcaagggcgagatgagcatcccttcattccggaaccggataccaatcgacatacacaacaactccgtggacatcactaaggagaagaatggggactacatcgcgggtatctcgctgttctcccgcgacttccacaaggagaacggtgacgtgcctaaaggcaagatattcgtcaagctcgctacccagaagcagaaatccatgaaggtgatcttagaccgcctcattaaccagacctactctaaaggagcctgcatgatccacaagtacaaaaacaagtggtatctcagtatcacttacaaattcaacgccttaaaggagaacaagttcgacaaggagttgataatggggatcgacatgggcggtattaacactgtgtactttgcgttcaacgagggcttcatccgaaacaacatcaagtctgaggagatcaagatgttcaacgagcggattcgccagcggcgcatcaacttattgaagcaatccacctactgctccaactccaggacgggcaaggggcggaccaagcgcctccagccgatagacgttctctcaaacaaaatcgctaagttccgaaattccactaaccacaagtacgccaactacatcatcaagcagtgtctcaaacacaactgcgggcgcatccaaatggagcttctaaaagggattagcaagaatgacaaggttctgaaagactggacatacttcgacctccaggagaagatcaaaaaccaggcagaaattcacgggattgaggtcatcaaggtggctcccgcctacacctcgcaacgctgctcccagtgcggctatatctgcaaggagaacagatgtacccaagccatgttcgagtgcaagcagtgcgggtacaagacgcacgcagactacaacgctgccaagaacatcgccacgtacgatattgaaaacatcatcaacaagcagctcgcggtacagagcaagttgcacagcaaaaagtgtatggaggagtacatcgaggaactgggatag

SEQ ID NO: 2791 - DNA, 1326 bp, Unknown
  Bacillus sp. multi
atgaagtaccagatcctatgccccatgaacgtggattggatcatcttcgagaagcacctcagaaacctcacctatcaagttcggacaatctcgaacagaaccatccagcaactctgggagttcgacgccctgtccttcgactacttcaaggtgcgcggcacctaccctacggtccaagacctttacgggtgcacgcagaagaagatcgacggttacatctaccacaccctacagagcaagtacccagacatccacaaggggaacatgagcaccaccctccaaaaaatcattaagacgtggaagtcccgccgcaacgagatccggaagggcgagatgagcattcccagctttcggaaccgtatccctattgacattcacaacaactcagtggacatcactaaggaaaaaaatggcgactacattgcgggtatatccctgttctcaagggatttccataaggagaatggtgacgtgcctaaaggcaaaatcttcgttaagctggcgacgcagaagcagaagtccatgaaggtgatcctggaccggctcatcaaccagacctactcaaagggtgcttgcatgatccacaagtacaagaataagtggtatctgagtattacctacaagttcaacgcccttaaggagaacaaattcgacaaggagctgattatggggatagacatgggagggattaacaccgtgtacttcgccttcaacgagggctttatcagaaacaacatcaagtccgaggagattaagatgttcaacgagcgcatcagacagaggaggatcaatctgctaaagcagtcaacctactgtagcaactcccgtaccggaaagggccggacaaaacgtcttcaacctatcgacgtgctgtcgaacaagattgcaaagttccgcaatagcacaaaccacaagtatgcgaactacatcatcaagcagtgcctcaagcacaactgcggccggatacagatggagctgcttaagggtatcagcaagaatgacaaggtgttgaaggactggacgtacttcgatctccaggagaagatcaaaaaccaggcggagatccacggaattgaggttattaaggttgctcctgcctacacatcacagcggtgctctcagtgcggctatatctgtaaggagaaccgatgcactcaggctatgttcgaatgcaagcagtgtggctacaagactcacgcggactacaatgcggccaagaacatcgccacctacgacatcgagaacatcattaacaagcagcttgcagtgcagtccaaacttcactccaaaaaatgcatggaggagtacattgaggaacttggatga

SEQ ID NO: 2792 - DNA, 1326 bp, Unknown
  Bacillus sp. multi
atgaagtaccagatcctgtgcccgatgaacgtcgattggatcatcttcgagaaacacctgagaaacctgacttatcaagtaagaactatttccaacaggactatccagcaactttgggagttcgacgctctgagcttcgattacttcaaggtgcgcggtacttatccgactgttcaagacctttacggctgcacgcagaagaaaatcgacggctacatctatcacacgctccagagcaagtacccggacatccacaagggcaatatgtcaaccaccttgcagaagattatcaagacatggaagtcccgtcgtaacgagatcaggaagggcgaaatgtcgatcccctcctttcgaaaccgcatacctattgacatccacaacaactcagttgatattacaaaggaaaaaaacggcgactacatcgctgggatctcgctgttcagtagggactttcacaaggagaacggggacgttcctaagggcaagatattcgtgaaactggcgactcagaagcagaagtcgatgaaggtcatcctcgacagactcatcaatcagacctacagcaagggtgcttgcatgattcacaagtacaaaaacaagtggtacttgtcaattacctacaagttcaacgcccttaaggagaacaagttcgacaaggagctgataatggggatagacatgggagggatcaacaccgtgtacttcgcgttcaacgagggcttcatccgcaacaacatcaagtcagaggagatcaagatgttcaacgagcgcatcaggcagcgccgcatcaatctgttgaagcaatccacgtactgctcgaacagccgaacggggaaggggaggaccaagaggttgcagccgattgacgtgctttccaacaagattgccaagttccgcaactccactaatcacaaatacgccaactacatcatcaagcagtgcttgaagcacaactgcggccgtattcagatggaactgcttaaagggatctccaagaacgacaaagtgttgaaggactggacctatttcgatctccaggaaaaaatcaagaaccaggccgagattcacgggatcgaagttattaaggtcgcaccggcctacacctcacagcgttgctcccagtgcggctacatctgcaaggaaaatcgctgcacacaggccatgttcgaatgcaagcagtgcgggtacaagacccacgcggactacaacgccgctaagaacatcgcaacttacgacattgaaaacatcatcaacaaacagttggcagtgcagtcgaaactacactccaagaagtgtatggaggagtacatcgaggaattggggtga

SEQ ID NO: 2793 - DNA, 1326 bp, Unknown
  Bacillus sp. multi
atgaagtaccagatcctctgcccgatgaacgtggactggatcatcttcgagaagcacctccgcaacttgacctaccaagtccgtacaatctccaaccgcacgatccagcagctctgggagttcgacgccctcagcttcgattacttcaaggttcgcggcacgtatccgactgttcaagacctttatggctgcacccagaagaaaatcgacggctatatctaccacacccttcagtccaagtacccggacatccacaaggggaacatgagtacgacactacaaaaaatcatcaagacatggaaaagtcgccggaacgagatccgtaaaggcgagatgagcatccccagcttccgcaaccgcattccaattgacattcacaacaactccgtggacattacgaaggagaagaacggggattacattgctggaatatccttgttctcaagggacttccacaaggaaaacggagacgtgcctaaaggcaagatattcgtcaagctggcaacccagaaacagaagtccatgaaggtcatattggaccgtcttatcaaccagacttactctaaaggggcgtgcatgatacacaagtacaaaaacaaatggtacttgtccatcacctacaaattcaacgcccttaaggagaacaaattcgacaaggaactgataatggggatagacatgggtggtattaacacggtgtactttgctttcaatgagggattcatccgaaacaacattaagtccgaggagatcaagatgttcaacgaacgcatcagacagaggcgtatcaatctcctaaagcagtccacctattgcagcaactcaaggacaggcaagggccgtactaagcgcctccagccaatcgacgtcctcagcaacaagatcgcaaagttccgcaatagcaccaaccacaagtatgctaactacattatcaagcagtgcctcaagcacaactgcggacgaatccagatggagctacttaagggaatcagcaagaacgacaaggtgctcaaagactggacgtacttcgatctccaggaaaaaatcaagaaccaggcggagattcatggcattgaagtcatcaaggtggccccggcttacacgagccagaggtgctcgcagtgtggctatatctgtaaggagaaccgatgcacacaggcaatgttcgagtgcaagcagtgcggctacaagacccacgcggactacaacgccgccaagaacatcgcaacctacgacatcgagaacatcatcaataagcaattggcagtgcaaagtaagctccattccaaaaagtgtatggaggagtacatcgaggagcttggctaa

SEQ ID NO: 2794 - DNA, 1326 bp, Unknown
  Bacillus sp. multi
atgaagtaccagatcctctgccccatgaacgtggactggatcatcttcgagaagcaccttcgaaacttgacataccaagttagaactatctccaacaggactatccaacaactctgggagttcgacgctctgtccttcgactatttcaaggtgcgcggcacataccctaccgtccaagacttgtacggctgcacacaaaaaaagatcgacgggtatatctaccacacactccagagcaagtacccagacattcacaagggcaatatgagcaccactctccaaaaaatcatcaagacatggaaaagcagaaggaacgagatccgcaaaggtgagatgtcaatcccgtctttccgcaaccgaatccctattgacattcacaacaacagcgtggacataacgaaggagaagaatggtgactacattgctggtatcagcctgttctctagggacttccacaaggagaacggggacgtgcctaagggcaagatattcgtaaaactggctacccagaagcagaagtccatgaaggtgatccttgaccgccttatcaatcagacatactcgaaaggagcttgcatgatccacaagtacaagaataagtggtacttgagtatcacctacaagttcaacgccctcaaggaaaacaaattcgacaaggaattgataatggggatagacatgggcggcatcaacaccgtgtacttcgcattcaacgagggcttcatccggaacaacatcaagtctgaggagatcaagatgttcaatgagcgcatacgccagcgccgtatcaacctgctcaagcagagcacctattgctcaaactcaagaacagggaaggggcgcaccaagcggcttcagcccattgacgtcctgtcaaacaagatagccaagttccgcaacagcaccaatcacaagtacgcgaactacatcatcaagcagtgcctaaagcacaactgtggtcgtattcagatggagcttctcaagggtatatctaagaatgacaaggtgttgaaggactggacgtacttcgatctccaggagaagatcaaaaatcaggctgagattcatggaatcgaggtcatcaaggtggctccagcctacacttcacagcgatgcagccagtgcgggtacatctgtaaggagaaccgctgcacccaggccatgttcgaatgtaaacagtgcggctacaagacccacgcggactacaacgcggccaagaacatcgccacctacgacatcgagaacattatcaacaagcagctcgcagtacagtccaagttacacagcaagaaatgcatggaggagtacatcgaggaactcgggtag

SEQ ID NO: 2795 - DNA, 1356 bp, Unknown
  Bacillus sp. multi
ctgggcgtgaccatcaagatcatgaagtaccagatactgtgccctatgaacgttgactggaccatcttcgagaaacacctcagaaaccttacataccaagttcgtaccattagcaacaggacaatccaacagctctgggagttcgatgctctatccttcgactacttcaaggaacgcggcacctaccccaccgttcaagacctttacggctgtactcagaagaaaatcgacggttacatctatcatactctacagtcgaagtaccctgacatccacaagggaaacatgagcaccactcttcagaagattatcaagacttggaagtcccgacgcaacgagatcaggaaggggaagatgtccatcccgtcgtttcgcaaccgcatcccaatcgacctacacaacaactccgtggacattactaaggaaaaaaacggggactacatcgctggtatctctctattcagtcgggatttccacaaggagaacgacgatgtgcctaagggcaaaatcttcgtaaagttggcgacgcagaagcagaagtctatgaaggtcatcctggaccgcctcatcaatcagacttacagcaaaggggcttgcatgattcacaagtacaagaataagtggtatttgagtatcacttacaagttcaacgccattaaggagaacaaattcgacaaggagttgataatggggatagacttgggcgggatcaataccgtgtactttgcattcaacgagggcttcattcggtccaacatcaagtccgacgagatcaagatgttcaacgagcgtatccgtcagaggaggatcaatctcctcaagcagagcaagtactgctcaaactcaaggaccggaaagggacgcaccaagcgacttcagcctattgacgtcctgagcaacaagatcgccaaattccgcaactccacaaaccacaagtacgcgaactatatcgtcaagcagtgcctcaaacacaactgcgggcgcatccagatggagctgttgaagggcatctccaagaatgaccgcattctcaaagactggacctacttcgacctccaggaaaaaatcaagaatcaggccgagatccacgggattgaagtcatcaaggttgccccggcatacacatcacagaggtgctcccagtgcgggtacatctgcaaggagaatcgctgcacacaggccactttcgagtgcaagcagtgtggctacaagactcacgccgactacaacgccgccaagaacatctctacctatgacatcgagaacatcatcaacaagcaactggctgtccagtcgaaactgcacagcaagaagtgtatggaggagtacattgaggagttgggctacctagactga

SEQ ID NO: 2796 - DNA, 1356 bp, Unknown
  Bacillus sp. multi
ttgggtgtcaccatcaagattatgaagtaccagatcctgtgcccgatgaacgtggattggacgatcttcgagaagcacctcaggaacctgacgtaccaagtcaggactatcagcaaccgcacgatccagcagctctgggagttcgacgcgctctcgttcgactacttcaaggagcgcggcacctacccgacggtccaggacttgtacggttgcacccagaagaaaatcgacgggtacatctaccacacccttcagtccaagtacccggacatacacaaggggaacatgagtacgaccctccagaagatcatcaagacttggaaaagccgacgaaatgagatcaggaaggggaagatgtccatcccgtctttccgtaaccgcatacctattgacctgcacaacaactccgtggacattactaaggagaagaatggcgattacatcgcgggaatctcactattcagtagggacttccataaggagaacgatgacgtgcctaaggggaagatattcgttaagctggctacacagaagcagaagtccatgaaggtgatcctagaccgtctcattaaccagacctactcgaaaggggcttgcatgattcacaagtacaagaacaagtggtacttgtccatcacctacaagttcaatgccatcaaggagaacaaattcgacaaggagctgattatgggcatcgacttgggcgggatcaataccgtgtacttcgccttcaacgaggggttcatcagaagcaacatcaagtctgatgagatcaagatgttcaacgagcgcatccgtcagaggcgcatcaacttgctcaaacagtccaagtactgctccaattcgcgtaccggaaaggggcgcaccaagcgactccagcccattgacgtcctatccaacaagattgctaagttccgaaactcgaccaaccataagtatgccaactatatcgtaaaacagtgcttgaagcacaactgcggcagaatccagatggagcttctaaaggggataagcaagaatgaccgcatcttgaaagactggacctacttcgacctacaggaaaaaatcaagaatcaggcagagattcacggcattgaggttattaaggtcgctcccgcctacacgagccagcggtgctcgcagtgcggctatatctgtaaggagaatcgttgcactcaagctaccttcgagtgtaaacagtgtggctacaagacacacgccgactacaacgcagccaagaacattagcacctacgatattgagaacatcatcaacaagcagctcgccgtgcaatcgaagttgcactccaagaagtgtatggaggagtacattgaggagttgggctacctagactag

SEQ ID NO: 2797 - DNA, 1356 bp, Unknown
  Bacillus sp. multi
ctcggtgtgaccatcaagattatgaagtaccagatcctctgccctatgaacgtggactggaccatcttcgagaagcacctcaggaacctcacataccaagtccgtactatcagcaatcggaccatccagcagttgtgggagtttgacgccctgtccttcgactacttcaaggagcgcggcacctaccctacggtccaggatctctacggctgtactcagaagaagattgacggctatatctaccacacccttcagtccaagtaccccgacatccacaagggcaacatgagtaccaccctccagaagattatcaagacctggaaatcccgcagaaacgaaatcaggaaagggaagatgtccattccttccttccgcaaccgcatcccgattgatctccacaacaactcggtggacattactaaggagaagaacggtgactacattgctggcatcagtctgttctcaagggacttccacaaggagaatgacgacgtgccaaaaggcaagatattcgtaaagctggcaacgcaaaagcaaaagtctatgaaggtgatcctggatcgactcatcaaccagacctacagcaaaggggcctgcatgattcacaagtacaagaacaagtggtatttgagtatcacctacaagttcaacgccatcaaggagaacaagttcgacaaggaattgataatggggattgacctcggcggtatcaacactgtgtacttcgctttcaatgagggcttcatacgcagtaacatcaagtccgacgagattaagatgttcaacgagcgcatacggcagcggcgcatcaacctcctcaagcaaagcaagtattgctccaacagccgtacaggcaagggccgcaccaagcgactccagccaatcgacgttcttagcaacaagatcgccaaattccgtaatagtacaaaccacaagtacgccaactacatcgtgaagcagtgcctgaaacacaactgcggtcgcattcagatggagttgcttaaggggatttccaagaatgaccggatcttgaaagactggacttacttcgacctccaggagaagatcaaaaaccaggcggaaattcacgggattgaggttattaaggtcgctcctgcttacaccagccagaggtgctcgcagtgcggctacatctgcaaggagaaccgatgcacccaggcgactttcgagtgcaagcaatgcgggtacaagacgcacgcagactacaacgctgccaagaacatatctacatacgacatcgagaacatcattaacaagcagcttgcagttcaaagcaagctacactccaaaaagtgtatggaggagtacatcgaggagttgggctacttggactag

SEQ ID NO: 2798 - DNA, 1356 bp, Unknown
  Bacillus sp. multi
ctaggagtcacgattaagatcatgaagtaccagatcctatgccccatgaacgtggactggacgatcttcgagaagcaccttcgcaacctgacctaccaagtgcgtacaatatcgaatcgcactatccagcaactttgggagttcgacgccttgtccttcgactactttaaggagcgcggcacctaccccaccgtgcaagacctgtacgggtgcactcagaagaaaatcgacgggtacatctatcacacgcttcaatccaagtaccccgacatccacaaggggaatatgagtaccaccctccaaaaaatcatcaagacatggaaatcacggcggaacgagatacgcaagggcaagatgtcgatcccgtccttccgtaacagaatccctattgaccttcataacaacagtgtggacatcacgaaggagaagaacggggactacattgcgggtatctctctgttctcgcgggacttccataaggagaacgacgacgtgccaaagggcaaaatcttcgttaaactggctacccagaagcagaagtcgatgaaggtgatacttgaccgccttattaaccagacatactcgaaaggagcgtgcatgatacacaagtacaagaacaagtggtacttgagtattacctacaagttcaatgccattaaggaaaacaaattcgataaggaactgattatggggattgacttgggtggcatcaataccgtttacttcgcgttcaacgaggggttcattcgctcaaacatcaagagcgacgagatcaagatgttcaacgagcgtatccggcagaggcgcatcaatctgctcaagcagagcaaatattgcagcaatagccgcactggcaaggggaggacaaagcgtcttcagccgatagacgtgctctccaacaagatcgccaagttccgcaactccacaaaccacaagtacgccaactacatcgtcaaacagtgccttaaacacaactgcgggaggatacagatggaattgcttaagggaatcagtaagaacgaccggatattgaaagactggacctacttcgacttacaggagaagatcaaaaatcaggcagagatccacgggattgaagttattaaggtcgcgcccgcctacacctctcaacgatgctcccagtgtggctatatctgtaaggagaaccgctgcacccaggcgacattcgagtgcaagcagtgcgggtacaagacccacgcagactacaacgcggccaagaacatctctacatacgacattgagaatatcatcaacaagcaacttgccgtgcagtccaagttgcacagcaagaaatgcatggaggagtacattgaggagttgggttacctggactga

SEQ ID NO: 2799 - DNA, 1356 bp, Unknown
  Bacillus sp. multi
ctcggtgtgacgattaagatcatgaagtaccagattctgtgccctatgaacgtcgattggacaatcttcgagaagcacctcagaaatctcacctaccaagtccgcacgatctccaaccgtacaatccaacaactttgggagttcgacgcgctctcgttcgactacttcaaggagcgtggcacttatcccaccgtccaagacctctatggctgcacacagaagaagatcgacggctacatctaccacacactacagagtaagtatcccgacatccacaagggcaatatgagcactaccctacagaaaatcatcaagacctggaagtcccgccgtaacgagatccgcaaggggaagatgtccatcccgtcattccgtaaccgcatacccatcgacttacacaacaattcggttgacataacgaaggaaaaaaatggcgactatatcgctgggatctcattgttcagccgggatttccacaaggagaatgatgacgtcccaaaagggaaaatcttcgtgaagctggctacccagaagcaaaagtccatgaaggtgatcctggaccgcctcatcaaccagacgtactctaaaggggcctgcatgattcacaagtacaagaataagtggtacttgagtatcacatacaagttcaacgccatcaaggagaacaaattcgacaaggagctgattatggggattgacttgggcggcatcaacacggtttacttcgctttcaacgaggggttcatacgttccaacatcaagtcagacgagatcaagatgttcaatgagcgcatcagacagcggaggatcaacttgctcaaacagtcaaagtattgttcaaactcccgtactggcaaagggcgcactaagcgcctacagcccattgacgtgctgagcaacaagatcgccaaattccggaactccacaaatcacaagtacgccaactacatcgtcaaacagtgccttaagcacaactgtggccgcatccagatggagctgttaaaggggataagtaagaacgaccgcattcttaaagactggacgtacttcgacctccaggagaagatcaaaaaccaggccgagatccacgggatcgaggtgattaaggtggcaccggcctacacatcgcagcggtgcagccagtgcgggtacatctgtaaggagaaccgttgcacacaggccacgttcgagtgcaagcagtgcggatacaagacccatgccgactacaacgccgccaagaacatatccacttatgacatcgagaacatcatcaacaagcagctcgcggtgcagtccaagctgcacagcaaaaaatgcatggaggagtacatcgaggaattgggttatcttgactga

SEQ ID NO: 2800 - DNA, 1356 bp, Unknown
  Bacillus sp. multi
ctcggggtgaccatcaagattatgaagtaccagatcctctgccccatgaacgtggactggactatcttcgagaagcacctccgcaaccttacctaccaagtccgtactatctcgaaccggaccatccagcagctctgggagtttgacgcgctgtccttcgattacttcaaggaacgcggcacctacccaaccgtacaagacctttacgggtgcacacagaagaaaatcgacggctacatctatcacactctgcaatctaagtacccggacatccacaagggcaatatgagtacaaccttgcagaagatcattaagacatggaaatctcggcgcaacgagatacgcaagggcgagatgtcaattccctcctttcggaacagaatacccatcgacctccacaataactcagttgacatcatcaaggagaagaatggggactacatcgctggtatctcgctgttctcccgcgacttccacaaggagaacggggacgtgccgaaggggaagatattcgtcaagctcggaactcaaaagcagaagtctatgaaggtgatcttggacaggcttatcaaccagacctactcaaagggcgcgtgcatgatccacaagtacaaaaacaagtggtacttgtctattacctacaaattcaacgccattaaggagaacaaattcgacaaggagttaatcatgggcattgacatgggagggattaacacagtgtacttcgccttcaacgagggattcatacgctccaatatcaagtcggacgagatcaagatgttcaatgagcgaatccgtcagcggcgcatcaacctacttaagcagagcaaatattgctccaactctcgcaccggcaagggccggactaagcgactccagcccattgacgtcctcagcaataagatcgccaagttccgcaacagcaccaaccacaagtacgccaactacatcgtcaagcaatgcctgaaacataactgcggacgcatacaaatggaattgctcaagggcataagcaagaacgacaaggtgctcaaagactggacgtacttcgatctccaggagaagatcaaaaaccaggccgagatatacggtattgaggtgattaaggtggtccctgcatacacgagccagcggtgcagtcagtgcggctatatctgtaaggagaaccgttgcacccaggcaatgttcgaatgcaagcagtgcggatacaagacacacgccgattacaacgcggccaagaatatctccacttatgacatcgaaaacattatcaacaagcagcttgctgtccagagcaagctccactccaagaagtgtatggaggagtacattgaggagttgggctacctggactga

SEQ ID NO: 2801 - DNA, 1356 bp, Unknown
  Bacillus sp. multi
ctaggcgttaccatcaagatcatgaagtaccagatactctgccccatgaacgtggactggaccatcttcgagaagcacctccggaacctcacctaccaagttagaactatcagcaacaggacgatccagcagctctgggagtttgacgccctctccttcgactacttcaaggagcggggaacataccccactgttcaagacctatatgggtgcactcagaagaagattgacggttacatctaccacacgcttcaatccaagtaccccgacatccacaaggggaatatgagcactactctacagaagatcatcaagacctggaaatcacgccggaacgagatcaggaagggcgaaatgtcgattcccagcttccggaaccgtattcctattgacctccacaacaactctgtggacatcatcaaggagaagaacggggactacatcgctggtatctccttattcagtagggacttccacaaggaaaatggggacgtgcctaagggcaagatattcgtaaagctcggcacccagaagcagaagtccatgaaggtgatcttagaccgacttatcaaccagacgtactccaaaggggcttgcatgatccacaagtacaagaacaagtggtatctatccattacttacaagttcaacgcgatcaaggagaacaaattcgacaaggagttgataatggggattgacatgggcggcatcaacaccgtgtactttgctttcaacgaggggttcattcggagcaacatcaagtctgacgagattaagatgttcaacgagcgcatacgccaaaggcggatcaacctcttaaagcagagcaaatactgtagcaacagtaggaccggaaagggacggacgaagcgccttcaacccatcgacgttctgagcaacaagatagctaagttccgcaactccaccaatcacaagtacgcgaactacatcgtgaagcagtgccttaaacacaactgcggacggatacagatggagctattgaaggggataagcaagaatgacaaggttctgaaagactggacgtacttcgacctccaggaaaaaatcaagaatcaggccgaaatctacgggattgaggttatcaaggtggttcctgcctacacaagccagcggtgctcccagtgcggctacatctgtaaggagaaccgctgcacccaggctatgttcgagtgcaagcaatgtggctacaagacgcacgcagactacaatgcggccaagaacatctcgacgtacgacattgagaacatcattaacaaacagctcgctgtccagtccaaacttcacagcaagaaatgcatggaggagtacatcgaggagctaggctatctggactga

SEQ ID NO: 2802 - DNA, 1356 bp, Unknown
  Bacillus sp. multi
ctgggagtcacgatcaagatcatgaagtaccagatcctctgccccatgaacgtcgattggacaatcttcgagaaacaccttcgtaatctcacctatcaagtccgcacaatctcgaaccggaccatccagcagttgtgggagttcgacgccctctccttcgactacttcaaggagcgcggcacttatcccactgtacaagacctctatggctgcacccaaaaaaagatagacggttacatctaccatacccttcagagcaaatacccggacatccacaaggggaatatgagtacaacgcttcagaagattatcaagacttggaagtcccgtcggaacgagatcaggaagggagagatgtcgatccccagcttccgaaaccggattcccattgatctccacaacaacagcgtggacatcatcaaggagaagaacggggactacattgcggggatctcgctattctcacgcgactttcacaaggagaacggcgatgtgccaaagggcaagatattcgtaaagctcgggacacagaagcagaagtcgatgaaggtcattctggaccggcttatcaaccagacatactctaaaggtgcgtgcatgatccacaagtacaagaacaagtggtacttgtccatcacatacaagttcaacgccatcaaggagaacaagttcgacaaagagctgattatggggatcgacatgggcgggatcaacacagtgtacttcgcattcaacgagggcttcatacgctcaaacatcaagtcagacgagatcaagatgtttaacgaacgtattcggcaacgccggatcaacctccttaaacagtccaaatactgttctaatagtcgtaccgggaaggggaggactaaaaggttgcagccaattgacgtcctgtcaaacaagatcgccaaattccgaaattccacgaaccacaagtacgctaactatatcgtgaagcagtgcctcaagcacaactgtggtcgcattcaaatggaactacttaagggcatctctaagaatgacaaggtgcttaaggactggacatactttgacctacaggaaaaaatcaagaaccaggcagagatatacgggattgaggtgattaaggttgtccccgcctacacatcgcagaggtgcagccagtgcgggtatatctgtaaggagaaccggtgtacccaggccatgttcgagtgcaagcagtgcggctacaagacccatgctgactacaacgccgccaagaacatctccacgtacgacatcgagaacatcatcaacaagcagcttgctgtccagagtaagttgcacagcaagaaatgcatggaggagtacatcgaggagctgggctacctcgactga

SEQ ID NO: 2803 - DNA, 1356 bp, Unknown
  Bacillus sp. multi
cttggtgtaaccatcaagatcatgaagtaccagatcctctgccccatgaacgtggactggaccatcttcgagaagcacctcagaaacctcacgtaccaagttcgaaccatctccaaccgaaccatccagcagctctgggagttcgatgcgttgtcattcgattacttcaaggaacggggcacctatcccaccgtccaagacctgtacggatgtacgcagaagaagattgacggctatatctaccacacactccagtcaaagtacccggacatccacaaggggaatatgagtacaaccctccagaagatcatcaagacttggaaatccaggaggaacgagatacggaaaggcgagatgagcataccctcgttccgaaaccgaatacctatagaccttcacaacaacagcgtggacatcattaaggaaaaaaatggcgactacattgccgggatctcactgttcagcagagacttccacaaggagaatggggacgtacctaagggcaagatattcgtcaaactcggcacccagaagcagaagtccatgaaggtcatactggaccggctgataaaccagacctactcaaaaggggcctgcatgatacacaagtacaagaacaagtggtatctgagtatcacctacaagttcaacgcgatcaaggagaacaaattcgacaaggagttaatcatgggaatagacatgggcggcatcaatacggtgtacttcgccttcaacgaagggttcatccgctccaacatcaagtctgacgagattaagatgttcaacgaacgaatcagacaacgaaggatcaatctgcttaaacagtccaagtattgctccaactctcgcaccggaaaaggccggacaaagcgcctacagccaattgatgtcctgtcaaacaagattgcgaaattccgcaacagcacaaaccacaagtacgcaaactacattgtgaagcagtgccttaagcacaactgcggccgaatccagatggaattgctcaagggcatcagcaagaacgacaaggtgttgaaagactggacctactttgacctccaggagaagatcaaaaaccaggccgagatatacggcatcgaagttatcaaggtggtgcccgcctacacttcccagcgttgctcgcagtgcggctacatctgcaaggagaaccgctgcacccaggcaatgttcgagtgcaagcaatgcggctacaaaacacacgccgactacaacgcagccaagaatatctcaacatacgacatcgagaacatcatcaacaaacaattggcagtgcagtccaaactgcactccaaaaagtgtatggaggagtacatcgaggaactaggctacctagactag

SEQ ID NO: 2804 - DNA, 1356 bp, Unknown
  Bacillus sp. multi
ctcggggtgacgatcaagattatgaagtaccagatcctctgccccatgaacgtggattggaccatcttcgagaagcacctccggaacctcacgtaccaagtccgcaccatcagcaaccgtactatccagcaattgtgggagtttgacgccttgagcttcgactacttcaaggagcgagggacatatcccaccgtccaagacctctacggctgcacacagaagaaaatcgacggctacatataccacacgctacagtcaaagtacccagacattcacaagggcaacatgagcactaccctccagaaaatcatcaagacctggaaatcacggagaaacgagatccgtaagggcgagatgagcattccctcctttcgcaaccgtatccctatagacttgcacaacaactccgttgacatcattaaggagaagaatggggactatatcgctggtatctccctattcagtcgtgacttccataaggaaaatggcgatgtgcctaagggcaagatattcgtcaaactcggcacacagaagcagaaatccatgaaggtcatcttggaccggctcatcaatcagacctactcaaaaggggcgtgcatgatccacaagtacaagaacaagtggtacttgtcaataacttacaagttcaatgcgatcaaggagaacaagttcgacaaggaattgataatgggcatcgacatgggtggcatcaacactgtttacttcgcgttcaacgagggcttcatccgctccaacattaagagcgacgagatcaagatgttcaacgagcgcatcaggcaaaggcgtatcaaccttctcaagcagtccaagtactgctccaactcgcgtactggaaaggggaggacaaaacgcctccaacctatcgacgtgctcagtaacaagattgccaagttccggaatagcaccaaccacaagtacgccaactacattgtgaagcagtgcctcaaacacaactgcgggcgcatccagatggagctgctcaaggggatctctaagaacgataaggttctcaaggactggacctacttcgacctacaggaaaaaatcaagaatcaggccgagatatacggtatcgaagttattaaggtggttcccgcttacacctcccaacgttgctcgcagtgcgggtatatctgtaaggagaaccggtgcacccaggccatgttcgagtgcaagcagtgcggttacaagacgcacgccgattacaacgcggctaagaacattagcacctacgacatcgagaacatcatcaacaagcagttggcggttcagtcaaagttgcactccaagaagtgtatggaggagtatatcgaggagctgggttatcttgactga

SEQ ID NO: 2805 - DNA, 1356 bp, Unknown
  Bacillus sp. multi
ctgggtgttacgatcaagatcatgaagtaccagatcctctgccccatgaacgtggactggacgatcttcgagaagcacctccgcaacctcacgtaccaagtccggacaatctccaacaggactatccagcaactctgggagttcgacgccctcagcttcgactactttaaggaaagaggcacctatccgacagaccaagacctatacggatgcacccaaaaaaagatagacggctacatctaccacaccctacagtcgaaataccccgacatccacaaggggaatatgagcaccaccctccagaagatcattaagacttggaaaagtcgtcgcaacgagatccggaagggcgagatgtccataccatccttccgtaatcgcattccgattgacctccacaacaactccgtggacattactaaggagaagaacggagactacatcgccggaatttcccttttcagccgcgacttccacaaggaaaacgatgacgttccgaaggggaaaatcttcgtcaaactggcaacgcagaagcagaagtccatgaaggttatcctggaccggctgattaaccagacttactcaaagggcgcgtgcatgattcacaagtacaagaacaagtggtacttgtcaatcacttacaagttcaacgccatcaaggaaaacaaattcgacaaggaactgattatggggatcgacctcggagggatcaacacggtgtacttcgcgttcaacgagggcttcataaggtcaaacattaagtccgacgagatcaagatgttcaacgagcgaatcaggcagcgccggatcaacttgctcaagcagtccaagtattgctcaaacagccgtacggggaagggtcgtaccaagcgtcttcagcccatcgacgtgctctcgaacaagatcgcaaagttccagaactctaccaaccacaagtatgccaactacatcgtgaagcagtgccttaagcacaactgtgggcgaatccaaatggagttattgaagggcatcagcaagaatgaccgcatcctgaaagactggacttacttcgatctccaggagaagatcaaaaaccaggccgagatacacgggatcgaggtcattaaggttgcacccgcatatacaagtcagcgctgttcacaatgcggctacatctgcaaggagaaccgctgcacccaggccaccttcgaatgcaagcagtgcgggtacaagactcacgccgactacaacgccgccaagaatatctcaacttacgacatcgagaacatcatcaacaagcagcttgcagttcagtctaaactgcatagcaaaaagtgtatggaggagtacattgaggaattgggttatcttgactga

SEQ ID NO: 2806 - DNA, 1356 bp, Unknown
  Bacillus sp. multi
cttggtgtgactatcaagattatgaagtaccagattctctgcccgatgaacgtggactggacaatcttcgaaaagcacctccggaacctgacctaccaagtgagaacgatcagcaaccgcaccatccaacagctctgggagttcgacgcgctcagcttcgactacttcaaggaacgaggaacctacccgaccgaccaagacctttacggctgcacccagaagaagatagacggctacatctaccacaccctacaatccaagtaccccgacattcacaagggcaacatgagcaccaccctccaaaaaatcatcaagacatggaaatctcgaaggaacgagatccggaagggcgagatgtccatcccatccttccgtaaccggattcctatcgacttgcacaacaactctgttgacattactaaggaaaaaaatggcgactacatcgccgggatttcgttattcagccgcgacttccacaaggagaatgatgacgtgcctaaggggaagatattcgtcaagttggctacacaaaagcagaagtctatgaaggtgatcctcgaccgactgattaaccagacttactctaagggagcgtgcatgatccacaagtacaagaacaaatggtatctctcaattacatacaaattcaacgccattaaggagaacaagttcgacaaggagctgattatggggatagacttgggcggtattaacacagtgtactttgcattcaacgagggcttcatacgctcaaacattaagtcggacgagattaagatgttcaacgagcgaatccgccagaggaggatcaatctgctaaagcagagcaagtactgctcgaactcgcggacgggaaaaggacgtactaaacgcctccagcccattgacgtgctaagcaacaagatcgccaaattccagaactctaccaaccacaagtacgccaactacattgtgaagcagtgcctcaagcacaactgcggacggattcagatggagctgcttaagggcatcagtaagaacgaccgcatattgaaagactggacctatttcgacttacaggagaagatcaaaaaccaggccgagattcacggcatcgaagttatcaaggtggccccggcctacacttctcagcgttgcagtcagtgcggttacatctgtaaggagaaccggtgcacccaagccactttcgagtgcaagcagtgcgggtacaaaacccacgcagattacaacgctgccaagaatatctcgacctatgacattgagaacatcatcaacaaacagttggcagtccagtccaagttgcacagcaagaaatgcatggaggagtatatcgaggagctaggctacctggactga

SEQ ID NO: 2807 - DNA, 1356 bp, Unknown
  Bacillus sp. multi
ctcggggtcacgattaagatcatgaagtaccagatcctctgcccgatgaacgttgactggaccatattcgagaaacacctcagaaacctcacctaccaagtgcgaaccatcagcaatcgcaccatccaacaactgtgggagttcgacgcgctgtccttcgactacttcaaggaacgcggaacctacccgacggaccaagacctctatggctgcacccagaagaagatagacggctacatctaccacacgctccaaagcaagtaccccgacatccacaaggggaacatgagcaccaccctccagaagatcatcaagacatggaaatcccgacgcaacgagatccgaaagggagaaatgtctattccgtcctttcgcaacagaatacctattgaccttcacaacaacagcgtggacatcactaaggaaaaaaatggagactacattgccggtatctccctgttcagtagagacttccataaggagaacgatgatgtgccaaaaggcaagatattcgtcaagttggcgacacagaagcagaagtccatgaaggtgatattggacaggctcattaaccagacgtactcgaagggtgcctgcatgatccacaagtacaagaacaagtggtacttatctattacatacaaattcaacgccatcaaggagaacaaattcgacaaggagctgataatggggattgatcttggtggcattaacaccgtgtacttcgctttcaacgagggcttcatccgctccaacatcaagtctgacgagatcaagatgttcaacgaacgtatcaggcagcggcgtatcaatctgttgaagcagagcaagtactgctccaactcccgcacggggaaaggccgcactaagcggctccaacccattgatgtcctcagcaacaagatcgcaaagttccagaactctaccaaccacaagtacgccaactacatcgtcaagcagtgccttaagcacaactgcggtcgtattcaaatggagttgttaaagggcatatccaagaacgacaggatattgaaagactggacgtactttgacctacaggagaagatcaaaaaccaggctgagattcacggcattgaagtcatcaaggtcgctcccgcatacaccagccagaggtgctcgcagtgcgggtacatctgcaaggaaaaccggtgcacacaggcgactttcgagtgcaagcagtgcgggtacaagacacacgccgactacaacgctgccaagaacattagcacttacgacatcgagaacatcatcaacaagcagttggcggtccagtccaaactccacagcaagaaatgcatggaggagtacattgaggaactggggtatctcgactag

SEQ ID NO: 2808 - DNA, 1356 bp, Unknown
  Bacillus sp. multi
ttaggtgtcaccatcaagattatgaagtaccagatactgtgccccatgaacgttgactggacaatcttcgagaaacaccttcgaaacctgacttaccaagttcgcactatctccaacagaaccatccagcaactttgggagtttgacgccttatccttcgactacttcaaggaacgcggcacctatcccaccgaccaagacctatatggctgcacccagaagaagattgacggctacatctaccatacactccagtccaagtacccagacatccacaagggaaacatgagcaccaccctccaaaaaatcattaagacttggaaaagtcgtcggaacgagattcgtaagggagagatgtcaatcccctcattccgcaaccgtatccccattgacctgcacaacaactccgtggacattactaaggagaagaacggggactacattgctggaatctcccttttcagcagagacttccacaaggaaaacgacgacgtgccaaaggggaaaatcttcgtaaagctggccacccagaagcagaaatctatgaaggttattctggaccgcctcattaaccagacctacagcaagggagcttgcatgattcacaagtacaagaacaagtggtatctgagtatcacttacaaattcaacgccattaaggagaacaagttcgacaaggagctgattatgggcatcgacctcggtgggatcaatactgtgtacttcgcattcaacgaggggtttatccgctccaatatcaagagcgacgagattaagatgttcaacgagcgtattcgccagaggcgcatcaacctgctcaagcagagcaagtactgctcaaacagccgaaccgggaaggggaggaccaagaggctccagcctatcgacgtgctctccaataagattgcgaagttccagaacagcaccaaccacaagtacgcaaactacatcgttaagcagtgcttgaaacacaactgcggtcgcatccagatggagttgcttaaggggataagcaagaacgaccgcattcttaaggactggacgtatttcgacctccaggagaagatcaaaaaccaggccgagatccacgggatcgaggtcattaaggtcgcacccgcctacacttcacagcgctgctcgcagtgcggttacatctgcaaggaaaatcgttgcacacaggcgaccttcgagtgtaagcagtgcgggtacaaaactcatgcggactacaacgccgctaagaatatctctacctacgacatcgagaacattatcaacaagcaactggctgtgcagtccaagctgcactccaaaaaatgcatggaggagtacattgaggaactgggctacctggactga

SEQ ID NO: 2809 - DNA, 1356 bp, Unknown
  Bacillus sp. multi
ttgggagttaccattaagatcatgaagtaccagatcctctgtcccatgaacgtcgattggacgatcttcgagaaacacctcagaaacctgacgtaccaagtccgaaccataagcaaccgcactattcagcagttatgggagttcgatgctcttagtttcgactactttaaggagcgcgggacgtatcccaccgaccaggatctatacggatgcacacaaaaaaaaatcgacggctacatctaccacactcttcagtcaaagtaccccgacatccacaagggcaatatgagcacgacgcttcagaagatcattaagacgtggaaaagcagacgaaacgagatccgcaagggcgagatgagcattcctagtttccgcaaccgcatccccatcgacctccacaacaacagtgttgacatcactaaggagaagaatggggactacatcgctggcatcagcctgttcagccgagacttccacaaggagaacgatgacgtgcctaaagggaaaatcttcgtgaagctggcaacgcaaaagcagaagtctatgaaggtcatcttggaccggcttatcaaccagacctactctaagggagcgtgcatgatccacaagtacaagaacaagtggtatcttagtatcacctacaagttcaacgcgattaaggaaaacaaattcgacaaggagctgattatggggattgacttgggagggatcaacaccgtgtacttcgcctttaacgaggggttcatccggagcaacatcaagtcagacgagatcaagatgttcaacgagcgcatacgccaacgtcgtatcaacttgctaaagcagtccaaatattgctcaaacagtcgcaccggaaagggaaggactaagaggctccagcctattgatgtcctcagcaacaagatcgctaagttccagaactccacgaaccacaagtacgcgaactacatcgtgaagcagtgcctgaaacacaactgtggtagaatccaaatggagttgctcaaggggatctctaagaacgacagaatcctcaaggactggacctacttcgacctacaggagaagatcaaaaaccaggcggagatacacggaatcgaggttatcaaggtcgccccagcctacacatctcagagatgcagccagtgcggctatatctgcaaggagaaccgctgtacccaggcaacgttcgagtgcaagcagtgcgggtacaagacgcacgctgactacaacgcggccaagaacataagcacatacgatattgagaacattatcaataagcagttggctgtacagagtaagctgcacagcaagaaatgcatggaggagtacattgaggaactgggctaccttgactga

SEQ ID NO: 2810 - DNA, 1356 bp, Unknown
  Bacillus sp. multi
ctcggggtgactatcaagatcatgaagtaccagattctctgccccatgaacgtggattggaccatcttcgagaaacaccttcgcaatctcacctatcaagtccgaaccatctcgaaccggacgatccagcagctctgggagttcgacgctctcagcttcgattacttcaaggagcgcggcacgtacccgacggtccaagacctatatgggtgcacgcagaagaaaatcgacggctatatctatcataccctccagtcgaagtacccagacattcacaaggggaacatgagcaccaccttacaaaaaatcattaagacgtggaaatcacgccgaaacgagatcaggaagggcgagatgtctatcccgagcttccgaaaccgaatccccattgacctccacaacaacagtgtggacatcattaaggagaagaacggcgactacatcgctgggatctcactcttcagtcgagacttccataaggagaacggtgacgtccctaaggggaagatattcgtaaagctgggaacccagaagcagaaatccatgaaggtgatcctcgatagactgattaaccagacttacagtaagggagcttgcatgatccacaagtacaagaacaaatggtatctctcaataacctacaagttcaacgctattaaggaaaacaaattcgacaaggagttgataatgggaattgacatgggcgggatcaacaccgtgtacttcgctttcaatgaggggttcatccgcagcaatatcaagtccgacgagatcaagatgttcaacgagcgtatcaggcagcgccggatcaacctactcaaacagtctaagtattgctcaaatagtagaacaggaaagggtcgtatgaagcgccttcagcccattgacgtgctgtccaacaagattgctaagttccgcaactcgacgaaccacaagtacgcaaattacattgtgaagcagtgcctaaagcacaattgcggtcgcatacagatggagttattgaagggcatcagcaagaacgacaagatccttaaagactggacttacttcgacttacaggaaaaaatcaagaaccaggcggagattcacgggatcgaggtcatcaaggtggctcctgcttacactagccagcggtgctcgcaatgcggctacatctgcaaggaaaatcggtgcacccaggctacgttcgagtgcaagcagtgcgggtacaagacccacgccgactacaatgcagccaagaacatctcgacttacgacatcgagaacatcatcaacaagcaactagccgtccagtcaaagctccacagcaaaaaatgcatggaggagtacatcgaggagttgggctatttggactga

SEQ ID NO: 2811 - DNA, 1356 bp, Unknown
  Bacillus sp. multi
cttggcgtgaccatcaagatcatgaagtaccagatactctgccctatgaacgtggactggaccatcttcgagaagcacctccgtaacttgacctaccaagtccgcacgatctcaaatcgtaccatacagcagctctgggagtttgacgccctatcgttcgactacttcaaggaacgaggcacttaccccaccgtccaggacttgtacgggtgcacgcagaagaagatagacggctacatctatcacaccctccagtcaaagtaccccgatattcacaagggcaacatgagcaccaccctccagaaaatcatcaagacatggaagtcacgccgcaacgagatccgtaaaggcgaaatgagtattcccagcttccgcaaccgtatcccaattgaccttcacaacaacagtgtggacatcatcaaggaaaaaaacggggactacatcgctgggatctctctgttcagtcgagacttccacaaggagaacggagacgtgccaaagggcaaaatcttcgttaaactgggcacacagaagcagaagtcgatgaaggtgatcctcgaccgcctgattaaccagacctattctaaaggagcgtgcatgatccacaagtacaagaacaagtggtacttgtccatcacctacaaattcaacgctattaaggagaacaaattcgacaaggagttgataatgggcatcgacatgggcggcattaacaccgtttactttgcattcaacgagggcttcatcaggagcaacatcaagtcggatgagattaagatgttcaacgaacgtattcgacagaggaggatcaatctattgaaacagtctaagtattgttctaattcccggactggcaagggtcgtatgaagcggttgcagcccatcgacgtgctaagtaacaagattgctaagttccgaaacagtacaaatcacaagtatgccaactatatcgtgaagcagtgcttgaaacacaactgtggtcggatacaaatggagttgctcaaggggatctccaagaacgacaagattctcaaggactggacctacttcgacctccaggagaagatcaaaaaccaggccgagattcacgggatcgaggttatcaaggtcgctcccgcctacacttctcagcgatgcagccagtgtggctatatctgcaaggagaacagatgcacacaagctacgttcgagtgcaagcagtgcggctacaagacacacgccgattacaacgcagccaagaacatctctacctacgacattgagaacatcattaacaagcagttggccgtgcagtcgaaactacactccaaaaagtgtatggaggagtacatcgaggagctgggctacctcgactaa

SEQ ID NO: 2812 - DNA, 1356 bp, Unknown
  Bacillus sp. multi
ctgggcgttaccatcaagatcatgaagtaccagatcctctgtcccatgaacgtggactggaccatcttcgagaagcaccttcggaacttaacatatcaagtgaggacaatctccaaccgaaccatacagcagctttgggagttcgacgccttgtccttcgactacttcaaggagcgcggcacgtatccgacagtccaagacctttatggctgcactcaaaaaaagattgacggttacatctaccacaccctccagagcaagtaccccgacatccacaaggggaatatgagcaccacgcttcaaaaaatcatcaaaacgtggaaatcacgtcgcaatgagatccgcaaaggagaaatgtccatcccctcgttccgcaaccgaatacctatcgacctgcacaacaacagcgttgacattatcaaggagaagaacggcgactacattgctggcatctcactgttctctcgtgacttccacaaggagaacggcgacgtgccaaaaggcaagatattcgtcaaacttggcactcagaagcagaagtccatgaaggtgatactggatcggctcatcaaccagacttactcaaaaggtgcgtgcatgatccacaagtacaagaataagtggtatctatctattacatacaagttcaacgcgatcaaggagaacaaattcgacaaggaacttatcatgggaatcgacatgggcggcattaacacggtgtactttgccttcaacgagggcttcatcagaagcaacatcaagtctgacgagattaagatgttcaacgagcgcatacggcagcgccggattaacctcctcaagcaatccaagtattgctcgaactctaggaccgggaagggtcgtatgaagcgcttgcaacccattgacgtcctgagcaacaagattgccaagttccgtaactctaccaaccacaagtacgctaactacatcgtaaagcagtgcttgaagcacaactgcggaaggatacagatggagctgctcaagggcattagcaagaacgacaagatcctcaaagactggacgtatttcgatctccaggagaagatcaaaaaccaggctgagatccacgggattgaggttattaaggttgccccagcatacacctcacagcgctgctctcagtgcgggtatatctgcaaggagaaccgatgcacccaggctacgttcgagtgcaagcagtgcggctacaagacccacgccgactacaacgcggccaagaacatcagtacctacgacatcgagaacatcatcaacaaacagttagccgtgcagagcaagttgcactccaagaagtgtatggaggagtatatcgaggagttggggtacttggactga

SEQ ID NO: 2813 - DNA, 1356 bp, Unknown
  Bacillus sp. multi
ttgggcgtgaccatcaagattatgaagtaccagatcctgtgcccgatgaacgtggattggacgatattcgagaagcacctccgaaaccttacttaccaagtgcggactatcagcaaccgcacgatccaacaactatgggagttcgatgcccttagtttcgactacttcaaggagcgcggcacctaccccaccgtccaagacctctatggctgcactcaaaaaaagatcgacgggtacatctaccacaccctccagagcaagtaccccgacattcacaagggaaacatgagcacgacccttcagaaaatcattaagacttggaaaagccgtcggaatgagatccgcaaaggagagatgtccatcccgtccttccgtaaccgcatacccattgacttgcacaacaacagtgtggacatcatcaaggagaagaatggcgactacatcgctggtatttcgttattcagtagagacttccataaggagaacggcgacgtgcctaaggggaagatattcgtaaaactgggaactcagaagcagaagtccatgaaggtgatcctggaccggctgataaaccagacctatagcaagggagcctgcatgatccacaagtacaagaacaaatggtatctgtcgatcacctacaaattcaatgctattaaggagaacaagttcgacaaggagctgattatgggaattgatatgggtgggattaacaccgtgtacttcgcgttcaacgagggattcatccgatccaacatcaagtcggacgagatcaagatgttcaacgagcgcatccgccagaggcgcatcaacctgctcaagcagagcaaatattgcagtaattcgcgcaccgggaaagggcggatgaagcgcctccagccaatcgacgtcctgtccaataagatcgccaagttccgaaactctaccaaccacaagtacgcgaactacatcgtcaagcagtgtctcaagcacaactgcggacgtatccagatggaactgttgaaggggatcagcaagaatgacaaaatcctcaaggactggacatacttcgatctccaggagaagatcaaaaaccaggctgagatccacggaatcgaggtcattaaggtggctccagcctacacctcacagcgatgctctcagtgcggctatatctgcaaggaaaatcggtgtacccaggcgacgttcgagtgtaagcagtgcggctacaagacacacgctgactacaacgccgccaagaacatctcgacctacgatattgagaacatcatcaacaaacagcttgcagtacagagcaagttgcacagcaagaagtgtatggaggagtacatcgaggagctaggctacctcgactga

SEQ ID NO: 2814 - DNA, 1356 bp, Unknown
  Bacillus sp. multi
ttgggtgttacgattaagatcatgaagtaccagatcctctgcccgatgaacgtggactggaccatcttcgagaagcacctcaggaatctcacctaccaagtgcgtacaatctccaatcgtaccatccagcagctctgggagttcgacgccctctccttcgactacttcaaggagcgtggcacttatcccaccgtgcaagacctctacggctgcacccagaagaagattgacgggtatatctaccacaccctccagagcaagtatccggacattcacaagggcaatatgtccaccaccctccaaaaaatcatcaagacttggaagtcaagacggaacgagatccggaaaggagagatgtcaataccctcattccgaaaccgcattcctatagacttgcacaacaactccgttgacattatcaaggagaagaatggcgactacatcgctggaatcagcttgttcagtcgagatttccacaaggagaacggagacgtcccaaagggcaaaatcttcgtcaaactcggcacacaaaagcagaagtcgatgaaggttatcctggaccgtctcatcaaccagacttacagcaaaggtgcctgcatgattcacaagtacaagaacaagtggtatctctccatcacttacaagttcaacgcgattaaggaaaacaagttcgacaaggagcttatcatgggaatcgacatgggcggtatcaacacggtgtacttcgcattcaacgagggcttcatccgtagcaacattaagtccgacgagatcaagatgttcaacgaacggatacgacagagacgtatcaaccttctcaagcagagcaagtactgctccaactctcgaaccggaaagggccgcatgaagcgtttgcagccgattgacgttctgtccaataagatcgcaaagttcagaaacagtacgaaccacaagtacgccaactacatcgtgaaacagtgcttgaaacacaactgcggccggattcaaatggaactcttgaaggggatctccaagaacgacaagatactgaaagattggacttacttcgacctccaggaaaaaatcaagaaccaggccgagatccacgggatcgaggtcattaaggtcgcaccagcttacaccagccagaggtgctcccaatgcgggtacatctgcaaggagaatcggtgcactcaggccaccttcgagtgcaagcagtgcggttacaagacccacgccgactacaacgcagctaagaacatctcgacctatgacatcgagaacatcatcaacaagcagcttgccgtgcagagtaagctgcactccaagaaatgcatggaggagtacatcgaggagctgggatacctggattga

SEQ ID NO: 2815 - DNA, 1335 bp, Unknown
  Bacillus sp. multi
atgaagtaccagatcctctgccccatgaacgttgactggaccatcttcgagaagcacctccgcaacctaacctaccaagttcgtaccatctccaacaggacaatccagcagctatgggagttcgatgctctctcgttcgactatttcaaggcacgtgggacgtacccaacagtccaagacctctacggatgcacccaaaaaaagatagacggctatatctaccacaagctgcaaagcaagtacccggacatccacaaggggaatatgtccaccacactccagaagatcattaagacatggaaaagcagacgtaacgagatccgcaagggtgagatgtcgatcccctcattccgcaacagaatccccatcgacctccacaacaactccgtggacattacgaaggagaagaatggtgactacattgctggtatctcattgttctcccgagacttccacaaggagaacggtgacgtccctaagggcaagatattcgtcaaactgggcaccaagaagcagaagtccatgaaggtgatcttggatcgcctcatgaaccagacctacagcaaaggtgcctgcatgatccacaagtacaagaataagtggtacttgagtattacctacaagtgcaacgccctcaaggaaaacaaattcgacaaggagttaatcatgggaattgacatgggagggattaacactgtgtacttcgctttcaacgaggggttcatacggaacaacatcaagagcgacgagattaaggcgttcaacgaacgtatccgacagagacggattaacctgctgaaccagtccaagtattgctcaaattccagaaccgggaaaggtcgcacgaagcggcttcagcctatcgacgtgctcagtaacaagatcgccaaattccgaaactcgaccaatcacaagtacgcaaactacatcatcaagcagtgcctcaagtacaactgtggtcgaatccaaatggaacttctcaaggggatcagcaagaacgataaggtgcttaaggactggacctacttcgacctacaggagaagatcaaaaaccaggccgagatcaggggtatcgagatcatcaaggtcgcgcctgcatacaccagtcagcgatgctcgcagtgcggctatatctgcaaggaaaatcgctgcactcaggccatgttcgaatgcaagcagtgcgggtacaagacgcacgccgactacaacgctgccaagaacattgccacctatgacatcgagaacatcatcaacaaacaactagctgcccagtcaaaactacattccaaaaaatgcatggaggagtacattgaggagcttggctacctcgactga

SEQ ID NO: 2816 - DNA, 1335 bp, Unknown
  Bacillus sp. multi
atgaagtaccaaatcctgtgccccatgaacgttgactggactatcttcgagaaacacctccgtaacctcacctaccaagtgaggaccatctccaaccggacaatccagcaactgtgggagttcgacgcgctgtcattcgactacttcaaggccaggggcacataccctacggtacaagacctctatggctgcacccagaagaaaattgacgggtatatctaccacaaattgcaaagcaaataccccgacatacacaaggggaatatgagtaccacgctccaaaaaatcatcaagacctggaaatcgagaaggaacgagatccgcaagggagagatgtccatccccagcttccgaaaccgtatccctattgacctgcacaacaacagcgtcgatattacgaaggagaagaacggcgactacattgccggaatatccttgttctctcgtgacttccataaggagaacggcgacgtaccaaagggcaagatattcgtcaaactggggaccaagaaacagaagtccatgaaggtcatccttgaccgtcttatgaaccagacttacagtaagggtgcctgcatgatccataagtacaaaaacaagtggtatttgagcatcacctacaagtgcaacgcactcaaggagaacaaattcgacaaggagcttatcatggggattgacatgggcggcatcaacacggtgtactttgctttcaatgagggcttcattcgtaacaacatcaagtcggacgagattaaggcgttcaatgagcggatacgccagagacgtatcaacctcctgaaccagagcaagtattgctcgaacagccgcaccggcaaaggccgtaccaagcggctacagccaatcgacgtccttagcaacaagatcgccaaattccggaactccacaaaccataagtacgctaactacatcatcaagcagtgcttgaagtacaactgcgggcgcatccagatggaactcctcaaggggatcagcaagaatgataaggtgctaaaggactggacctatttcgacctccaggagaagatcaaaaatcaggcagagatccgaggaatcgagatcatcaaggtggctcccgcctacacttcgcaacgctgttcgcagtgcgggtatatctgcaaggagaaccgatgcacccaagctatgttcgagtgcaagcagtgcggctacaagacgcacgctgactacaacgcagccaagaacattgctacttacgacatcgagaacatcattaacaagcaactcgcggcgcagtccaaattgcacagcaagaaatgcatggaggagtacattgaggagttgggttacctggattga

SEQ ID NO: 2817 - DNA, 1335 bp, Unknown
  Bacillus sp. multi
atgaagtaccagatcctctgccccatgaacgtggactggactatcttcgagaagcacctcagaaatctgacgtaccaagtccgtaccatctccaacaggacgattcagcaactctgggagtttgacgccttgtccttcgactacttcaaagcgcggggcacctaccccacagtccaggacttgtacggctgcactcagaagaagatcgacgggtacatctaccacaaactccagagtaagtaccctgacattcacaagggcaatatgagtacaaccctccagaagattatcaagacttggaaatctaggcgtaacgagatccggaaaggcgaaatgagtattccttcgtttcgcaaccgaatacctatcgaccttcacaacaactcagtggacattactaaggagaagaatggcgactacattgctggtatctcattgttcagtagggacttccacaaggagaacggcgatgttcccaaaggcaaaatcttcgttaagctgggcaccaagaaacagaagtctatgaaggtgattcttgaccgtctgatgaaccagacctatagcaaaggagcctgcatgattcacaagtacaagaacaagtggtatctctcaatcacctacaaatgcaacgccctcaaggagaacaaattcgacaaggagttaatcatggggattgacatgggagggatcaataccgtgtacttcgccttcaacgaggggttcatccgtaacaacatcaagtcggacgagatcaaggcgttcaacgagcgcatcaggcagagacgcatcaacctccttaaccagtccaaatactgctcgaacagccggacggggaagggccgcacaaagcgcttgcaacccattgacgtcctctcaaacaagatcgctaagttccgtaactccaccaaccacaagtacgctaactacattatcaagcagtgcctcaagtacaactgcggtagaatccagatggaacttctgaaaggaatctctaagaacgacaaggttctcaaggactggacctacttcgacctccaggagaagatcaaaaaccaggccgagatcaggggaattgaaatcatcaaggtggccccggcctacacgagccaaaggtgctcccagtgcggctacatctgcaaggagaaccggtgcacccaggcaatgttcgaatgcaagcagtgcgggtacaagacccatgccgattacaatgccgccaagaatatcgcaacttacgacatcgagaacatcatcaacaaacaactggccgcacagtcaaagctacacagcaagaaatgcatggaggagtacattgaggagttgggttacttggactga

SEQ ID NO: 2818 - DNA, 1335 bp, Unknown
  Bacillus sp. multi
atgaagtaccagatcctctgcccgatgaacgtggactggaccatcttcgagaaacacctccgaaacctgacctaccaagtccggaccattagcaaccgcaccatccagcagctctgggagttcgacgccctatccttcgactacttcaaggctcggggaacctacccaacggtacaagacctgtacggatgcactcagaagaagatcgacggctatatctatcacaagctacagagtaagtaccccgacatccacaagggcaacatgagtaccacactccagaaaatcatcaagacctggaaaagtcgtcgcaacgagattcgcaagggcgaaatgtccatcccgagctttcgcaaccggattcctattgacttgcacaacaactcggtggacattactaaggagaagaatggagactacatcgccggtatctccctgtttagtcgggacttccacaaggaaaatggagacgttcctaagggcaaaatcttcgtaaagctgggcaccaagaagcagaagtccatgaaggtgatcctggacaggcttatgaaccagacatacagtaagggagcctgcatgatccacaagtacaagaacaaatggtacttgtccattacatacaagtgcaacgctcttaaggagaacaaattcgacaaggagcttatcatgggaatagacatgggtgggatcaacaccgtttacttcgctttcaacgagggcttcataaggaacaacatcaagtccgacgagattaaggctttcaacgagcgaatcagacagcggcgtatcaacttactgaaccagagcaaatattgcagtaatagccggactggcaaggggaggaccaagaggctccagcctattgacgtgctctcgaacaagatagccaagttccgtaactccaccaaccacaagtatgccaactacatcatcaagcagtgcctcaagtacaattgtggtcggatacagatggaactgctcaagggaatctctaagaacgacaaggtgctcaaggactggacttacttcgacctacaggagaagatcaaaaaccaggccgagattcgagggatcgagatcattaaggtcgccccggcctacacttcacagaggtgctcccaatgcgggtacatctgcaaggagaaccgctgcacccaggccatgttcgagtgcaagcagtgtggatacaagacccatgccgactacaacgccgctaagaacattgccacttacgacatcgagaacatcatcaacaagcagctcgcagctcagagcaagctacactccaagaaatgcatggaggagtacatcgaggagctgggctacctcgactaa

SEQ ID NO: 2819 - DNA, 1335 bp, Unknown
  Bacillus sp. multi
atgaagtaccagattctctgccccatgaacgttgactggaccatcttcgagaaacacctacgcaacctgacctaccaagtccgcacgatcagcaacagaaccatccagcagctttgggagttcgacgccctctcgttcgactacttcaaggcgaggggcacgtaccccacggttcaagacctatatggttgcactcagaagaagattgacggctacatctatcacaagctccagagcaagtacccagacattcacaagggcaacatgagcacgaccctccagaaaatcattaagacctggaagtctaggcgcaacgagatccgcaagggcgagatgtccatcccgagctttcggaacaggatacctatcgaccttcacaataacagtgtggacatcactaaggaaaaaaatggagactatatcgctggaatatcattgttctctcgggatttccacaaggagaacggcgacgtgccgaaggggaagatattcgttaagctggggaccaagaagcagaagtccatgaaggtcattctcgaccgacttatgaaccagacctactctaagggtgcctgcatgatccacaagtacaagaataagtggtatctcagcattacatacaaatgtaacgcccttaaggagaacaaattcgacaaggagctgataatgggcatcgacatgggtgggataaacacagtttacttcgctttcaatgaggggttcattcgaaacaacattaagagtgacgagatcaaggcgttcaacgaacgcatccgccagcggcggattaacctgttgaatcagagcaagtactgtagtaactccaggacaggcaagggaaggaccaagcgccttcagcccattgacgtgctttcgaacaaaatcgctaagttccgcaactccaccaaccacaagtatgctaactacatcatcaagcagtgcttgaagtacaactgtggacgaatccagatggagctgttaaagggcatcagcaagaacgacaaggtgctaaaggactggacctacttcgatctccaggaaaaaatcaagaaccaggcggagataagaggaatagagatcatcaaggtggctccggcctacacgagccagcgatgctctcagtgcggctatatctgtaaggagaataggtgcacccaagccatgttcgagtgcaagcagtgcggttacaagacccacgctgactacaacgctgctaagaacattgcaacctacgacattgagaacatcatcaacaagcagcttgccgcccagagcaagctccacagcaagaaatgcatggaggagtacattgaggagttgggttacctcgactag

SEQ ID NO: 2820 - DNA, 1356 bp, Unknown
  Bacillus sp. multi
cttggagttaccatcaagatcatgaagtaccagatcctttgccccatgaacgtggactggacgatcttcgagaaacacctccgaaacctcacctatcaagttagaacaatcagcaaccgcactatacagcagctctgggagttcgacgccctctcctttgactacttcaaggaacggggcacctacccgaccgttcaagacctgtacggatgcacacagaagaagattgacggctacatctaccacacattgcagagcaagtaccctgacatacacaagggcaatatgtcaacaacccttcaaaaaatcatcaagacgtggaaatcacgtcgtaacgaaatacggaagggcgagatgagcatcccttcctttcggaacaggataccaatagaccttcacaacaactccgtggacattatcaaggaaaaaaatggggactacatcgccggaatcagcctgttcagccgcgacttccacaaggagaacggggacgtgccaaagggcaagatattcgtgaaactggggacacagaagcagaagtccatgaaggtgatcctggaccggcttattaaccagacatactcaaagggtgcgtgcatgattcacaagtacaaaaacaaatggtatctgtcaatcacatacaagttcaacgccatcaaggagaacaagttcgacaaggagcttatcatgggcatcgacatgggagggattaacactgtgtacttcgcattcaacgagggcttcattcgttcaaacatcaagtccgacgagatcaagatgttcaacgagcgcatccgccaaaggcggatcaacctcctcaagcaatccaagtactgctcaaactccaggaccggcaagggacggaccaaacgccttcagccaatcgacgtccttagtaacaagatagccaaattccgcaatagtaccaaccacaagtacgctaactacatcgtcaagcagtgcctcaagcacaactgcggccggatacagatggaacttctaaaggggatctccaagaacgataaggtgcttaaagactggacgtacttcgacctccaggagaagatcaaaaaccaggcagagatatacggaatcgaggtcatcaaggtggtcccagcctacacctcccaacggtgctctcagtgcggttacatctgcaaggagaaccgctgcacacaggcaatgttcgagtgtaaacagtgcgggtacaagacacacgccgactacaacactgccaagaacatctctacctacgatattgagaacatcatcaacaagcagcttgcagtgcagagcaagctccacagcaagaaatgcatggaggagtacatcgaggaactcggctacttggactag

SEQ ID NO: 2821 - DNA, 1356 bp, Unknown
  Bacillus sp. multi
ctcggtgtgactatcaagattatgaagtaccagatactctgccccatgaacgttgactggaccatcttcgagaagcacctcaggaacctcacctaccaagtgaggacaatctccaaccgcacgatccagcagctctgggagtttgacgccctctcgttcgactatttcaaggaacgcggcacttacccaaccgtccaggacttgtacggctgcactcagaagaagattgacgggtatatctaccacaccttgcagtctaagtaccccgacatacacaaaggcaatatgagcaccaccctccaaaaaatcatcaagacttggaaatccagacgtaatgagatacggaagggcgagatgagtatcccatccttcagaaaccgaatccccattgacttgcacaacaactcagtggacatcattaaggaaaaaaatggcgactacatcgcggggatttcgctgttctcaagggacttccacaaggagaacggtgatgtaccgaagggcaaaatcttcgtcaagctgggcacgcaaaagcagaagtccatgaaggtgatactggatcgtctcatcaatcagacctactctaagggtgcttgcatgattcacaagtacaagaacaagtggtatctctccattacttacaagttcaacgctatcaaggagaacaaattcgacaaggagctgattatgggaattgacatgggcgggattaacaccgtgtacttcgctttcaacgaggggttcatccgtagcaacattaagtccgacgagatcaagatgtttaacgagcggatcagacaaaggcgtatcaacctattgaagcaaagcaaatactgttcaaatagtagaaccggcaagggacgcacaaagaggctacagcctattgatgtgctatcgaacaagatagccaaattccgtaatagcacgaaccacaagtacgccaactacatcgtgaagcaatgccttaaacacaactgcggacggattcagatggagctgttgaaggggatttccaagaacgacaaggtgctcaaggactggacttacttcgacctacaggagaagatcaaaaaccaggctgagatatacggcatcgaggtcattaaggttgtgcccgcctacacctcccagcgatgctctcagtgcggctacatctgcaaggaaaatcggtgtacccaggccatgttcgagtgcaagcagtgcggctacaaaacccacgcggactacaacaccgccaagaacatctccacctacgacatcgagaacatcatcaacaagcaactcgccgtgcagtctaagctgcacagcaagaagtgtatggaggagtacattgaggagctgggctacctggactga

SEQ ID NO: 2822 - DNA, 1356 bp, Unknown
  Bacillus sp. multi
ctcggcgtcacgattaagattatgaagtaccagatcctgtgcccgatgaacgtggattggacgatcttcgagaagcacctccgtaacctgacctaccaagtccgaaccatcagcaaccgcactatccagcagctttgggagttcgacgccctttccttcgactacttcaaggagcgaggaacttaccccaccgtccaagacttgtacgggtgtactcagaagaagatagacggctatatctaccacaccctccagtccaagtacccggacattcacaagggcaatatgtcaaccaccttacagaagattatcaagacatggaaatcccgtcgaaacgagatcaggaaaggtgagatgagcatcccttccttccgtaatcgcatcccaatagacctgcataacaactccgtggacatcatcaaggagaagaatggggactacatcgctggaatctcccttttcagccgagacttccataaggaaaacggggacgtgccgaaggggaaaatcttcgttaaactcggaacccaaaagcagaagtccatgaaggttattctggatcggcttatcaaccagacctactccaaaggggcctgcatgatccataagtacaagaacaagtggtatctatcaattacttacaagttcaacgccatcaaggagaacaaattcgacaaggagcttatcatggggatagacatgggtgggattaacactgtgtacttcgccttcaacgaggggttcatccggtccaacatcaagagcgacgagattaagatgttcaatgagcgcatccgtcagcgacgcatcaacctcctaaagcagtccaaatattgttcaaattctcgcacaggcaagggccgaacaaagcgcctccagcccatcgacgtcctctcgaacaagattgccaaattccgtaattccaccaatcacaagtacgcgaactacatcgtgaagcagtgcctcaaacataactgcggccggattcagatggagctgctcaagggaatctccaagaatgacaaggttctcaaagactggacctacttcgacttacaggagaagatcaaaaaccaggcggagatatacggaatcgaagtgattaaggtcgtcccagcctacacatcacagaggtgctcccagtgcggttacatctgcaaggaaaaccgttgcacccaggcaatgttcgagtgcaagcagtgcgggtacaagacgcacgccgactacaacactgccaagaacattagcacttacgacatcgagaacatcatcaacaagcaattggccgtgcagtctaagctacactccaagaaatgcatggaggagtacatcgaggagttgggataccttgactag

SEQ ID NO: 2823 - DNA, 1356 bp, Unknown
  Bacillus sp. multi
ctcggtgtgactatcaagatcatgaagtaccagatcctttgccccatgaacgtggattggacaatcttcgagaagcacttaaggaacctcacctaccaagtcaggacgatctcaaatcggactatccagcagctctgggagttcgacgcactgtcgttcgactatttcaaggagcgcggcacctatccaaccgtacaggatctctacggctgcacccagaagaaaattgacgggtacatataccacaccctccagtccaagtaccccgacatccacaaggggaacatgagcacgaccctccaaaaaatcatcaagacctggaaaagtaggcggaacgagatccgaaagggcgaaatgtccatcccatccttccgcaaccgtattcccattgacctgcacaacaactccgttgacatcatcaaggagaagaatggcgactacatcgctggtatcagcctctttagtcgtgacttccacaaggagaacggcgacgtgccaaagggcaagatattcgtgaagctggggacacaaaagcagaagtctatgaaggttatcctcgaccgtcttattaaccagacatactcgaagggagcctgcatgatccacaagtacaagaacaagtggtacttgagcatcacatacaagttcaatgccatcaaggagaacaaattcgacaaggagcttatcatgggaattgacatgggtgggatcaacactgtttacttcgcattcaacgaggggtttatcaggagcaacatcaagagcgacgagattaagatgttcaacgaacgcattcggcagcggcgtattaacttattgaaacagagcaaatattgttccaactccaggactggcaaggggcgcactaagaggctacagccaatcgacgtcctgtccaacaagatcgcaaagttcagaaacagtaccaaccacaagtacgcgaactacatcgtcaagcaatgccttaagcacaactgcgggcgaatccagatggagttgctcaagggtatctctaagaacgacaaggtgctaaaggactggacgtacttcgacctccaggagaagatcaaaaaccaggccgagatatacgggatcgaggtcatcaaggtggtgcctgcttacacttcacagcgttgcagccaatgtggctacatctgcaaggagaatcgttgcacccaggccatgttcgagtgcaagcagtgcgggtacaagacgcacgcggactacaacactgctaagaatatctccacctatgacattgagaatatcatcaacaagcaattggcggtgcagtctaagctccacagcaaaaaatgcatggaggagtatatcgaggagctgggctacctagactag

SEQ ID NO: 2824 - DNA, 1356 bp, Unknown
  Bacillus sp. multi
ctcggagtcactatcaagatcatgaagtaccagatcctgtgcccgatgaacgtcgattggactatcttcgagaagcacctccggaaccttacctaccaagtgagaacgatcagcaaccgcaccatccagcagctctgggagttcgacgcactctccttcgactacttcaaggagcgcggcacataccccacggttcaagacctgtacggatgcacccagaagaaaatcgacggctacatctaccacaccttgcagtccaagtatcccgacatccacaagggcaatatgtcaaccacgttgcagaaaatcatcaagacttggaagtctcgtaggaacgagataaggaaaggtgaaatgtctattccctctttccggaaccgaatccccatcgacctgcacaacaactccgttgacattatcaaggaaaaaaacggcgactacatcgctggtatctcgctgttctccagagactttcacaaggaaaatggagacgtcccgaagggcaagatattcgttaaactcggcacgcagaagcagaagtctatgaaggtcatcctggaccgtcttattaaccagacctacagtaagggcgcttgcatgatacacaagtacaaaaacaaatggtacttatctatcacctacaagttcaacgctatcaaggagaacaaattcgacaaggaactcataatgggaatcgacatgggcggcattaacaccgtttacttcgccttcaacgagggattcattcgttcgaacattaagagcgacgagatcaagatgttcaacgagcgcataaggcagaggcggatcaacctcttaaaacaatccaagtactgttcaaatagtcggacgggaaagggccggaccaagcgtttgcagccaattgatgtcctgagcaacaagattgccaaattccgcaactccacaaaccacaaatacgccaactacatcgtaaagcagtgcttgaaacacaactgtggtcgtatccaaatggagctacttaagggtatcagcaagaacgacaaggtgcttaaggactggacatacttcgatctccaggagaagatcaaaaaccaggcagagatatacggaatcgaagtcatcaaggtcgtgccagcctatacttcgcagcgctgtagccagtgcgggtacatctgcaaggagaaccgctgtactcaggccatgttcgagtgcaagcagtgcggctacaagacccacgctgattacaacaccgccaagaacatcagcacgtatgacattgagaacatcatcaacaaacagctcgccgtgcagtccaagctacactccaaaaagtgtatggaggagtacatcgaggagctgggttacctggactga

SEQ ID NO: 2825 - DNA, 1335 bp, Unknown
  Bacillus sp. multi
atgaagtaccagatactctgccctatgaacgtggactggaccatcttcgagaagcacctacgcaacctgacctaccaagtgcgaacgatctcgaaccgaacgatacagcaactctgggagttcgacgctttgagctttgactatttcaaggagcgtggcacctaccccaccgtccaggacttgtacggctgcacccaaaaaaaaatcgacgggtacatataccacaccttgcagtccaagtaccccgacatccacaaggggaacatgagtacaaccctccagaagattatcaagacatggaaaagtaggcgtaacgagatacgcaaaggagagatgtccatcccctcgttccgcaaccgtatccccatcgacctgcacaacaacagcgtggacattactaaggagaagaatggtgcctacattgctgggatttcctttttcagtagagacttccacaaggagaacggcgacgttcctaagggcaaaatcttcgttaagctcagtacccagaagcagaagtctatgaaggtgatcctggaccggctcatgaaccagacgtactcaaagggtgcttgcatgatccacaagtacaagaacaagtggtacttatcaatcacctacaagttcaacgccatcaaggagaacaagttcgacaaggagttgataatgggaatagacatgggcgggatcaacaccgtttacttcgccttcaacgaagggttcatccgttccaatatcaagtccgacgagattaaggctttcaacgagcgtatcaggcagcgccgcattaacctactcaagcagtccaaatattgttccaatagccgaacggggaaggggcgcactaagcgccttcagcctatagacgttctgtcaaacaagattgcaaagttccgaaactctactaatcacaagtacgcgaactacatcgtgaagcagtgcttgaaacacaattgcggacggattcagatggaactcctcaaggggatctccaagaacgacaagatcctgaaagactggacatacttcgacctccaggagaagatcaaaaatcaggccgagatacacggtatcgaggtcatcaaggtcgcacccgcctatacctcccaaaggtgctcccagtgcgggtacatctgtaaggaaaatcgctgcacccaggcgatgttcgagtgtaagcagtgcgggtacaagacccacgctgactacaatgcggccaagaatatctctacttacgacattgagaacattatcaacaagcagcttgctgtgcagtccaaattgcatagcaagaagtgtatggaggagtacatcgaggagctggggtatctcgattga

SEQ ID NO: 2826 - DNA, 1335 bp, Unknown
  Bacillus sp. multi
atgaagtaccagatcctatgccccatgaacgttgactggaccatcttcgagaagcaccttcgcaaccttacataccaagtccgcacgatctccaaccggacgattcagcagctctgggagttcgatgccctgagtttcgactacttcaaggagcgtggtacataccctactgtccaggatctctacggttgtactcagaagaaaattgacggctacatctatcacaccctccagagcaaataccctgacattcacaaggggaacatgagtacgaccttgcaaaaaatcatcaagacgtggaaaagtcggcgtaacgagatccgcaagggtgagatgtctatccccagtttccgaaacaggatacccattgacttgcacaacaacagcgttgacatcacgaaggagaagaatggcgcttacatcgcgggtatatccttctttagccgagacttccataaggagaacggcgacgttcctaagggcaaaatcttcgtgaagctatcaacgcagaagcagaagtccatgaaggtgatccttgacagacttatgaaccagacctacagcaaaggagcctgcatgatccacaagtacaagaataagtggtacttgagcatcacgtacaaattcaatgctattaaggaaaacaaattcgacaaggaactgattatggggattgatatgggcggcatcaataccgtgtacttcgccttcaacgagggcttcattcgaagcaacattaagagcgacgagatcaaggcgttcaacgagcgaatacgccaacgccggataaacctgctcaagcagtccaagtactgttcaaacagtcggacaggaaaggggaggacaaagcgccttcagccaatcgacgtcctgtccaacaagatcgccaagttcagaaacagcacaaatcacaagtacgccaattacattgtcaagcagtgcctgaaacacaactgcggtcggattcaaatggagctgcttaagggtatcagtaagaacgacaaaatcctcaaagactggacctacttcgacctccaggaaaaaatcaagaaccaggccgagatccacgggatcgaggtcattaaggtggcaccggcatacacctctcagcggtgctcccagtgcggctacatctgcaaggagaaccggtgcactcaggccatgttcgagtgcaagcagtgcgggtacaagactcacgccgactacaacgccgctaagaatatcagcacctacgacatcgagaacattatcaataagcaactggccgtgcagagcaagctccactccaagaagtgtatggaggagtacatcgaggagctgggctacctcgactaa

SEQ ID NO: 2827 - DNA, 1335 bp, Unknown
  Bacillus sp. multi
atgaagtaccagatcctgtgccccatgaacgtggactggactatcttcgagaagcacctccgcaacctcacctaccaagttcgtactatctcaaaccggaccattcagcagctctgggagttcgatgccctgtcctttgactatttcaaggagcgcggcacctatcccacggtccaagacttgtacggctgcactcagaagaagatagacggctacatataccacacgctgcaaagcaagtacccggacatccacaagggcaatatgtccaccacactccagaagatcattaagacatggaaaagtaggcgtaacgagattcgtaaaggtgagatgtcgatcccctccttccgaaaccgtattcccatcgacctccacaacaacagcgttgacattacgaaggagaagaacggtgcttacatcgctggtatatctttcttcagtcgtgacttccataaggagaacggcgacgtgccgaaaggcaagatattcgttaagctgtcaacccagaagcagaagtctatgaaggttatcctcgaccgtctgatgaaccagacatactcaaaaggcgcttgcatgatccacaagtacaagaacaaatggtatctgtccattacctacaagttcaatgctattaaggagaacaagttcgacaaggagctgataatgggcatcgacatgggcggcatcaacaccgtttacttcgctttcaacgaggggttcattcgtagtaacatcaagtccgacgagattaaggcgttcaatgagcgcatacggcagaggcggatcaacctccttaagcaaagcaagtattgcagcaattcgaggaccgggaagggtcgcacaaagcgcctccagcccattgacgtcctctcaaacaagatcgccaaattccgtaattccactaaccataagtacgcaaactacatcgttaaacaatgcctcaaacacaactgcggacgcatccaaatggagctgttgaaggggatctccaagaacgacaagatactcaaagactggacgtacttcgacctccaggagaagatcaaaaaccaggccgagatacacggcatcgaggttatcaaggttgcccctgcatacacctcccagcggtgcagccagtgcggctacatctgcaaggaaaatcgctgcactcaggcaatgttcgagtgcaaacagtgcggctacaagacacacgctgactacaacgccgctaagaacatctctacctatgacatcgagaacattatcaacaagcagttggcagtgcagtccaagctccactccaaaaaatgcatggaggagtacatcgaggaactcggttaccttgactag

SEQ ID NO: 2828 - DNA, 1335 bp, Unknown
  Bacillus sp. multi
atgaagtaccagatcctctgccccatgaacgtggactggacgatcttcgagaagcacctccgcaacctgacataccaagtgcgaactatctccaaccgcaccatacagcagctctgggagttcgacgccctgagcttcgattacttcaaggagcgcggaacgtatccaacggttcaagacctttatggatgcacccagaagaaaatcgacgggtacatctaccacaccctccagagcaaataccccgacatccacaaggggaatatgtccacaacgctccagaagatcattaagacgtggaaatctcggcgtaacgagatcaggaaaggcgaaatgtccatcccctcgttccgaaatcggattcctattgatctccacaacaactccgtggacattactaaggagaagaacggtgcgtacatcgcgggaatttcgttctttagtcgggacttccacaaggagaacggtgatgtacctaaaggcaagatattcgtgaagctcagcacccagaagcagaagtccatgaaggtgattctcgataggcttatgaaccagacctactctaaaggagcctgcatgatccacaagtacaagaacaagtggtatctaagtattacctacaaattcaacgcgattaaggagaacaaattcgacaaggagttgataatgggaatcgacatgggagggatcaacactgtttacttcgccttcaacgaggggttcatacggagcaatatcaagagcgacgagattaaggcgttcaacgagcggatcaggcagcgccgtatcaacctcctcaaacagagcaagtactgtagcaactcccgcacagggaaggggcgaactaagcgtcttcagcctattgacgtgctgtcaaacaagattgcaaagttcagaaactctaccaaccacaagtacgcaaactacatcgtcaagcagtgcctcaaacacaattgcggtcgaatccagatggagctgcttaaggggatcagcaagaacgataagattctgaaagactggacctacttcgacctccaggagaagattaaaaaccaggccgagatccacgggattgaagtcatcaaggttgctccggcctatacaagccagcgctgctcgcagtgcggctacatctgcaaggagaaccggtgcacccaggcaatgttcgagtgcaagcagtgcgggtacaagacccacgcggactacaacgcggccaagaatatcagtacctatgatattgagaacatcatcaacaaacagttggcggtgcagagcaaattgcacagcaagaagtgtatggaggagtacatcgaggagctgggctacttagactaa

SEQ ID NO: 2829 - DNA, 1335 bp, Unknown
  Bacillus sp. multi
atgaagtaccagattctatgccccatgaacgttgactggaccatcttcgaaaagcacctccgcaacctgacctaccaagtacgcaccatctcgaaccgcaccattcagcaactgtgggagtttgacgccttgtctttcgattacttcaaggaacgaggaacatatcctaccgtgcaagacctttacggctgcacacagaagaagatcgacgggtacatctaccatacgttacaaagcaagtatcccgatattcacaaggggaatatgagtaccaccttacagaaaatcatcaagacctggaagtccaggcgtaacgagatccgaaaaggcgagatgagcatccccagcttccgcaatcggattcccattgacttgcacaacaatagtgttgacatcactaaggagaagaatggggcctacatcgcggggatttccttttttagtcgtgacttccacaaggagaacggggacgttccgaaaggcaaaatcttcgtgaaactgtccacccagaagcagaagtctatgaaggtcatcctggacagactcatgaaccagacgtactcgaagggagcgtgcatgatacacaagtacaagaacaagtggtacttgagtatcacctacaagttcaacgctatcaaggagaacaaattcgacaaggagctgataatgggcatcgacatgggcgggattaacacagtgtactttgcgttcaacgaggggttcatccgcagtaacatcaagtcggatgagattaaggcgttcaacgagcgcattcgccagaggaggatcaacctcttaaaacagtccaagtactgctcgaactcaaggactgggaagggccggaccaagcggctacagcccatcgacgtgctgtccaacaagatagccaagttccgcaacagcacaaaccacaagtacgctaattacatcgtgaagcagtgcctcaagcacaactgcggccggatacagatggagctgctcaagggcatcagtaagaacgataagatattgaaagactggacctacttcgatctccaggagaagatcaaaaaccaggcggagatccacggaattgaagtcattaaggtcgctccggcctacaccagccagaggtgctcgcagtgcggctatatctgtaaggaaaatcgctgcacacaggctatgttcgagtgcaagcagtgcggatacaagacacacgctgactacaatgcggccaagaatatcagtacctacgacatcgagaacatcattaacaagcaattggcggtacagtcgaagctacactccaagaagtgtatggaggagtatatcgaggaactcggctacctagactag

SEQ ID NO: 2830 - DNA, 1335 bp, Unknown
  Bacillus sp. multi
atgaagtaccagatcctctgtcccatgaacgtcgattggaccatcttcgagaagcacctccggaacctcacctaccaagtccgtacgatctcgaaccggacgatccagcagctctgggagttcgacgcactctcattcgactactttaaggagcgcgggacataccccaccgtccaagacctttacgggtgcactcagaagaaaatagacggctacatctaccacaccttgcagtctaagtaccccgacatccacaagggcaatatgagtacgacgttgcagaagattatcaagacttggaaaagcagacgtaacgagatacgcaaaggagagatgagcatcccctccttccgtaatcgcataccaatcgacctccacaacaactccgtggacatcactaaggaaaaaaatggtgactacatcgctggcatatcgctgttctctcgggacttccacaaggagaacggcgacgttccaaagggcaagatattcgtgaagctcgctacacagaagcagaagtcgatgaaggtgatcctcgaccggttgatgaaccagacctacagtaagggagcctgcatgatccacaagtacaagaataagtggtatctgtcaatcacatacaagttcaacgctctcaaggaaaacaagttcgacaaggagttgataatgggaatagacatgggtggcatcaacacagtgtacttcgccttcaacaagggattcatccgctccaacatcaagtcggatgagattaagaccttcaacgaacgaatccgtcaaaggcggattaacctgctcaatcagtccaaatattgttcaaattctcgcacaggaaaggggaggaccaagaggctccagcccattgacgtcctgtcaaacaagatcgccaagttccgtaacagcacaaaccacaagtacgccaactacatcatcaagcagtgcctcaaacacaactgcgggcgcatccagatggagctgttgaaagggatctccaagaatgacaaggtgctcaaggactggacctacttcgacctccaggagaagatcaaaaaccaggctgagattcacggcattgaggtgattaagattgcccctgcctacacctcacagcgatgctctcagtgcggctacatctgcaaggagaaccgttgcacccaagatatgttcgaatgcaagcagtgcggatacaaaactcacgccgactacaacgccgccaagaacatcagtacctacgggattgaaaacatcatcaataagcagctcgcggtgcagagtaagctccacagcaagaagtgtatggaggagtacatcgagaaactaggctacttggactag

SEQ ID NO: 2831 - DNA, 1335 bp, Unknown
  Bacillus sp. multi
atgaagtaccagatcctctgcccgatgaacgttgactggactatcttcgagaaacacctacggaacctgacgtaccaagtgagaactatcagcaaccgcaccatccagcagctctgggagttcgacgcgctctccttcgactacttcaaagagcgcggaacataccccaccgtacaagacctctacggttgcacccagaagaaaatcgacggctacatctaccacacactgcaatcgaagtacccagacattcacaaggggaacatgagcaccacccttcaaaaaatcatcaagacatggaaaagtcggcgcaatgagattcgaaaaggtgagatgtccatcccctccttccgtaaccgcatcccaattgatctccacaacaatagtgttgacattactaaggagaagaacggcgactacatcgctggcatctcgttgttctcacgggacttccacaaggagaacggcgacgtgccgaaggggaagatattcgttaagctggccacccagaagcaaaagtcgatgaaggtgatcctggaccggctcatgaaccagacttactcaaagggcgcgtgcatgatacacaagtacaaaaacaaatggtacttgagcattacctacaagttcaacgctcttaaggagaacaagttcgacaaggaactaatcatgggaatcgacatgggagggatcaacaccgtgtacttcgctttcaacaagggcttcatccgcagcaacatcaagtccgacgagattaagacattcaacgaacgcatccgccaacggcggatcaacctgcttaaccagtccaaatattgcagcaactctaggaccgggaaggggaggacaaagcgccttcagcccattgacgttctcagcaacaagattgcgaagttccgcaattccactaaccataagtatgctaattacatcattaagcaatgcctcaagcacaactgtggccgcatacagatggagttattgaaggggatcagcaagaacgacaaggttctcaaggactggacctacttcgacctccaggaaaaaatcaagaaccaggcggagatacacggcatcgaggttattaagattgcccctgcctataccagtcagaggtgctcacagtgcggttacatctgcaaggagaaccgctgcacacaagatatgttcgaatgcaagcagtgcggatacaagacacacgccgactacaatgccgccaagaatatctccacctatggtattgaaaacatcatcaacaagcaattggccgttcagagcaaactgcactccaaaaaatgcatggaggagtacattgagaagctgggctacttagactga

SEQ ID NO: 2832 - DNA, 1335 bp, Unknown
  Bacillus sp. multi
atgaagtaccagatactttgcccgatgaacgtggactggacaatcttcgagaagcacctccgcaacctgacgtatcaagttagaacaatttcgaaccggaccatacagcagctctgggagttcgacgcgctttccttcgactatttcaaagagcggggcacctaccccaccgtccaagacctctacgggtgcacgcagaagaaaatcgacgggtacatctaccatacgcttcagtcgaagtaccccgacatccacaagggcaacatgagcaccaccctccagaagatcattaagacatggaagtccaggcgaaacgaaatccggaagggtgagatgtcgatcccctccttccgtaaccgtatccctattgacctccacaacaactcggtggacattactaaggagaagaatggggactacatcgccgggatctcactgttctcaagggatttccacaaggaaaacggagacgtgccgaagggaaagatattcgtcaagttggccacccagaagcagaagtctatgaaggtcatcctcgaccggctcatgaaccagacctactctaagggcgcttgcatgatacacaagtacaagaacaagtggtatctatctattacttacaaattcaacgccttgaaggaaaacaagttcgacaaggagcttatcatgggcattgacatgggtgggatcaacaccgtttacttcgcattcaacaagggattcatccgcagcaacatcaagtccgacgagattaagactttcaacgagcgaatccgtcagaggaggatcaacctgctaaaccagtccaagtactgctcaaactctcgcaccgggaagggccggactaaacgcctccaacctattgacgtactaagcaacaagatcgccaaattccggaactccacaaaccataagtacgcaaactacatcatcaagcaatgcctcaagcacaactgcgggcgaatccaaatggagctgcttaagggcatctctaagaacgacaaggtgcttaaagactggacgtatttcgacctccaggaaaaaatcaagaatcaggcagagatccacggcatcgaggtgattaagatcgctcccgcctacacctctcagagatgttcccagtgcggttacatctgcaaggagaaccggtgtactcaggatatgttcgaatgcaaacagtgcggctacaagacgcacgccgactacaacgccgccaagaatatctcaacgtacggcattgagaacatcatcaacaagcaactcgcagtccaaagcaagttgcattccaagaagtgtatggaggagtacatcgagaagctggggtatctcgactga

SEQ ID NO: 2833 - DNA, 1335 bp, Unknown
  Bacillus sp. multi
atgaagtaccagatcctgtgtccgatgaacgtggattggaccatcttcgagaaacacctccgcaacctcacataccaagtcagaactatctccaaccgcaccattcagcagctctgggagttcgacgccctcagcttcgactatttcaaggagcggggaacctacccgacggtccaagacctctatggctgcacccagaagaaaatagacggctacatataccacaccctccagtccaagtaccccgacatccacaagggcaacatgagcaccactcttcaaaaaatcatcaagacctggaagtcgaggcgcaacgagatccggaagggtgagatgtccataccctccttccgtaaccgcattccgattgatctgcacaacaactcggtggacattacgaaggagaagaacggggactatatcgctggtatctccctcttcagtagggactttcacaaggagaacggagatgtgcctaagggcaaaatcttcgttaagctggccacccagaagcagaagtctatgaaggtgattctcgaccgacttatgaaccagacctattctaaaggagcttgcatgatccacaagtacaagaataagtggtacttgtcaatcacatacaagttcaacgctcttaaggagaacaagttcgacaaagagttgataatgggcatcgacatgggcggcatcaacaccgtttacttcgcgttcaacaagggcttcatccgtagcaatatcaagtcagacgagatcaagacctttaacgagcgcatccgtcaacgccgcatcaacttactgaaccagtccaagtattgcagcaatagtcgaaccgggaagggccgtactaagcgcctccagcctatcgacgtcctttccaacaagattgccaaattccgtaattccaccaaccacaagtacgcaaactacatcatcaagcaatgcttgaagcacaactgcggtcgtattcaaatggagttgctaaagggaatctccaagaatgacaaggttctcaaggactggacctacttcgacctccaggagaagatcaaaaaccaggccgagattcacggtatcgaggtcatcaagatcgcccctgcctacacatctcagaggtgcagccaatgcggctatatctgcaaggaaaatcgctgcactcaagatatgttcgaatgtaagcagtgcggatacaagacgcacgcggactacaacgcggctaagaacatctctacctacgggattgagaatatcatcaacaagcagctcgcggtgcagtctaagttgcactccaaaaaatgcatggaggagtacattgagaagctcggctacttggactag

SEQ ID NO: 2834 - DNA, 1335 bp, Unknown
  Bacillus sp. multi
atgaagtatcagatactctgccccatgaacgtggactggacgatattcgagaagcacttacggaatctgacctaccaagtaaggacaatctctaatcgtaccatccagcagctctgggagttcgacgcactcagcttcgactacttcaaggaacgtggcacttaccccaccgtccaggacttgtacgggtgcacgcagaagaagatcgacgggtacatctaccacactctacagagtaagtaccccgacatccacaagggcaatatgagcacgactcttcagaagattatcaagacttggaaatcacgccgcaacgagatccgcaaaggcgagatgtccatcccctccttccgcaaccgaatccccatcgaccttcacaacaacagcgtggacatcacgaaggaaaaaaatggtgactacattgccggaatctctctgttctcccgcgacttccacaaggagaacggagacgtgccgaagggcaagatattcgtaaagctcgccacccagaagcagaagtcgatgaaggtgattcttgaccggctcatgaaccagacgtacagcaagggagcttgcatgattcacaagtacaagaacaagtggtatcttagcatcacttacaagttcaacgcgctaaaggagaacaaattcgacaaggagctgataatgggcatcgacatgggtgggatcaacacggtgtacttcgctttcaacaagggcttcatccgcagcaatatcaagtcagacgagattaagactttcaacgaacgaatcaggcagcgtcgtattaacctgctgaaccagagcaaatattgttccaacagtcgcaccggaaagggaaggaccaagcgtcttcagcccatcgacgtacttagcaacaaaatcgccaagttccgaaactcaacgaaccacaagtacgccaactacattatcaagcagtgccttaagcacaactgtggccgcatacagatggagctgctcaagggcatcagcaagaacgacaaggttctgaaagactggacctactttgacctccaggagaagatcaaaaaccaggccgagattcatgggatagaggttattaagattgctccagcatacactagccaacggtgcagccagtgcgggtatatctgcaaggaaaatcgctgcacacaagatatgttcgagtgtaagcaatgcgggtacaaaactcacgctgactacaacgccgccaagaacatctcgacctacgggatcgagaatatcatcaacaagcagttggccgtgcagagcaaactccactccaaaaaatgcatggaggagtacattgagaagctcggctaccttgactga

SEQ ID NO: 2835 - DNA, 1356 bp, Unknown
  Bacillus sp. multi
ttgggtgtgactatcaagatcatgaagtaccagatcctctgtcctatgaacgttgactggaccatcttcgagaagcaccttcgcaacctcacctaccaagtcagaacaatcagcaaccgtaccattcagcagctctgggagttcgacgccttatcattcgactatttcaaggagcgaggcacctaccccaccgtccaagacctctatggctgcacccagaagaaaatcgacggctacatctaccataccctacagagcaagtacccggacatccacaaggggaacatgagtaccactctccagaagatcatcaagacttggaaatcccgtcgcaacgaaattcgtaagggcaagatgtctatcccctccttccggaaccgtatcccgattgacctgcacaacaacagcgtggacattactaaggaaaaaaacggcgactacatcgcggggatctccctattctcgcgggacttccacaaggagaacgacgacgtgcctaaaggcaaaatcttcgtaaagctcgcaacccagaagcaaaagtcgatgaaggtgatcctcgatagactcatcaaccagacttacagcaaaggggcctgcatgatccacaagtacaagaacaaatggtacttgtctatcacctacaagttcaacgctattaaggagaacaaattcgacaaggagttgataatgggcattgatcttggagggatcaacacagtgtactttgcattcaatgaggggttcatccggagcaacattaagagtgacgagatcaagatgttcaacgaacgtatccgtcagcgccggataaacttgctcaagcagagcaagtactgctcgaacggcagaacggggaagggtaggaccaagcgtctccaacctatcgacgtcctctcaaacaagatcgccaagttccgcaacagcacgaaccacaagtatgccaactacatcgtgaagcagtgcctcaaacacaactgcggtagaatccagatggagctgcttaaagggatttccaagaacgacaggatactcaaagactggacctactttgacctccaggagaagatcaaaaatcaggctgagattcatgggattgaggtcattaaggttgccccggcctatacttctcagagatgctcgcagtgtggctatatctgtaaggaaaatcggtgtacccaagctacattcgagtgcaagcagtgcggctacaagacacacgcagactacaacgccgctaagaacataagcacctacgacatcgaaaacatcatcaacaaacagctcgccgtccagagcaagctccactccaagaagtgtatggaggagtacatcgaggagctgggctatttggactga

SEQ ID NO: 2836 - DNA, 1356 bp, Unknown
  Bacillus sp. multi
ctgggtgtgactatcaagatcatgaagtaccagatcctctgccccatgaacgtggactggaccatattcgagaagcacctcagaaatcttacctaccaagtccgtaccattagcaaccgcaccatccagcagctctgggagttcgatgccttgtcgttcgactacttcaaggagcggggcacctaccccacagtccaagacctctatggatgcacccagaagaagatcgacgggtacatataccacaccctacagtctaagtacccagacattcataagggcaacatgagcaccacactccagaagatcattaagacctggaaatctcggcgcaacgagatccggaagggcaagatgtccatccccagcttccgcaatcgcatacccatcgacctgcacaacaatagcgttgacattactaaggaaaaaaacggcgactacatcgcggggatctccctgttctcgcgggacttccataaggagaacgacgacgttccaaagggcaaaatcttcgttaaacttgctacccagaagcagaagtctatgaaggtgatccttgaccggcttatcaatcagacctactccaaaggtgcgtgcatgatccacaagtacaagaataagtggtatctgtcgatcacctacaagttcaatgctatcaaggaaaacaaattcgacaaggaactcatcatgggaattgacttgggtggtatcaacactgtgtactttgccttcaacgagggattcattcgttccaacatcaagtcggacgagattaagatgttcaacgagcgtatccgccagaggcggataaacctgttgaaacaatccaaatactgctccaacggcagaaccgggaaaggacgaacaaagcgcttacagccaatcgacgttctctcaaacaagatcgccaaattccgtaactctacaaaccacaagtatgccaactacatcgtgaagcagtgcttaaagcacaattgcggtcgcatacaaatggaactcctaaagggcatcagcaagaacgaccgcatcctcaaggactggacgtacttcgacctccaggagaagatcaaaaaccaggcggaaattcacggaattgaggttatcaaggtggcaccggcctacacctcccaacgttgctctcagtgcggctacatctgcaaggagaacagatgcacccaggccacgttcgagtgcaagcagtgcggctacaagacccacgcagactacaacgccgccaagaatatctctacctacgacatcgaaaacatcatcaataagcagttggccgtacagtctaagctccatagcaagaaatgcatggaggagtacattgaggagttgggatacctcgattag

SEQ ID NO: 2837 - DNA, 1356 bp, Unknown
  Bacillus sp. multi
ctcggtgtgacgatcaagattatgaagtaccagatcctctgtccgatgaacgtggattggacaatcttcgagaaacacttgaggaatctcacgtaccaagttagaactatcagcaatcgaaccatccagcagctttgggagttcgacgcgctcagtttcgactacttcaaggagcggggcacgtaccccaccgtccaagacttgtacggctgtactcagaagaagattgacggctacatctatcataccctccagtccaagtaccccgacatccacaagggcaatatgtcaaccacccttcagaaaatcattaagacctggaaatccaggaggaatgagatccggaagggaaagatgtccatcccctccttcagaaaccggataccaatcgacctgcacaacaattccgttgatattactaaggaaaaaaatggggactacattgcgggcatctccctcttcagccgcgacttccacaaggagaacgacgacgtgcctaaaggcaaaatcttcgttaaactcgccacccagaaacagaagtccatgaaggtgatcctcgataggctgattaaccagacctactctaaaggtgcgtgcatgatccataagtacaagaacaagtggtatctaagtatcacctacaagttcaacgcgatcaaggagaacaaattcgacaaggagctgataatggggatcgacctcggagggataaacactgtgtacttcgctttcaacgaaggctttatcagatccaacattaagtcggacgagattaagatgttcaacgagcggattcggcaaaggcgcatcaacctactaaagcaatcgaaatattgttctaatgggcgtaccggaaagggacggacaaagcgcctccagcctatagacgtcctaagcaacaagatcgccaagttccgtaactccacaaaccacaagtacgccaactacattgttaagcagtgcttgaagcacaactgcgggcgcatccagatggagctgttgaaggggatcagcaagaatgacaggatcttgaaagactggacctacttcgacctccaggagaagatcaaaaaccaggcggagattcacgggattgaggttatcaaggtggcccctgcatacacatctcagcgctgttcgcagtgcgggtacatctgtaaggagaaccgctgtacccaggcgaccttcgagtgtaagcagtgcgggtacaagactcacgccgactacaacgccgccaagaacatctccacctacgacatcgagaacatcattaacaagcaattggctgtgcagtcgaaattacactccaagaaatgcatggaggagtacattgaggagctgggctacctcgactga

SEQ ID NO: 2838 - DNA, 1356 bp, Unknown
  Bacillus sp. multi
ctcggtgtgaccatcaagatcatgaagtaccaaattctctgccctatgaacgtcgattggacgatcttcgagaagcacctccggaacctcacctaccaagtgcgaaccatcagtaatcgcactatacagcagctctgggagttcgacgctctgagcttcgattactttaaggagcgcggcacgtacccgaccgtccaagacctttatggctgcacgcagaagaagatagacggctacatctaccacaccctccaatccaagtaccctgacatccacaaggggaatatgagcacgacgctccagaagatcattaagacgtggaagtcgaggcgaaatgagatccggaagggaaagatgtccataccgtcgttccgtaacaggatacctatcgaccttcacaacaactctgttgacattacgaaggaaaaaaacggggactacattgcgggtatctccttattcagtcgagatttccacaaggagaacgacgacgttccgaaaggcaagatattcgtcaagctggccacccagaagcagaagtctatgaaggtgattctggacagacttattaaccagacatactccaaaggtgcgtgcatgatccacaagtacaagaacaagtggtatctcagcataacgtacaagttcaacgctattaaggagaacaagttcgacaaggaattgataatggggattgacttgggtgggattaacacggtgtacttcgcgttcaacgaggggtttatccggtcaaacatcaagagcgacgagatcaagatgtttaacgagcgcatcaggcagagacggatcaacctgctaaagcagtccaagtactgctcaaatgggcgtactggaaaggggaggactaaacgactacagccaattgacgttctgtccaacaagattgccaagttccgcaacagtacgaaccacaagtacgccaactatatcgttaagcagtgcctcaaacacaactgcggtcggatacagatggaactgctaaaagggatcagcaagaacgaccgcatcttgaaagactggacttacttcgacctccaggaaaaaatcaagaaccaggcggagattcacggcatcgaagtcatcaaggtcgcgccagcctacacgagccagaggtgctcgcagtgcgggtacatctgcaaggagaatcggtgcacacaggccactttcgagtgcaagcagtgcgggtacaagacccacgccgactacaacgcggccaagaacatatccacttacgatattgaaaacatcatcaacaaacaacttgctgttcagagcaagctgcatagcaagaaatgcatggaggagtacatcgaggagttgggttatctcgactag

SEQ ID NO: 2839 - DNA, 1356 bp, Unknown
  Bacillus sp. multi
cttggggtgactattaagatcatgaagtaccagatcctgtgccccatgaacgttgactggaccatattcgagaagcacctgaggaacctcacctaccaagtccgcaccattagcaaccggacgatccagcagctctgggagttcgacgccttgtccttcgactacttcaaggagcggggaacctaccccaccgtacaagacctttacggctgcacgcagaagaaaatcgacggctacatctatcataccctccaaagtaagtatcccgacattcacaagggcaatatgtcaaccaccctccagaagattatcaagacatggaagtcacgccggaatgagatcaggaaggggaagatgtccatcccctccttccgaaaccgcatcccaatcgacctccacaacaacagcgtggacatcactaaggagaagaacggggactacattgcgggaatcagcctgttcagccgggactttcacaaggagaacgatgacgttcctaagggcaagatattcgtgaagttggcaacacagaagcagaagtctatgaaggtcatcctggaccgcctcatcaatcagacatacagcaaaggtgcctgcatgatacacaagtacaagaacaagtggtatctgtcgattacttacaagttcaacgctatcaaggagaacaagttcgacaaagagctaatcatggggatcgacctcggtgggatcaacacagtgtacttcgctttcaacgagggcttcatccgatccaacatcaagtctgacgagattaagatgttcaacgaacgaatcagacaaaggcgcattaacttgctaaaacagtccaagtactgctccaacgggcgaactggaaagggacgcacaaagcgtctccagccaattgacgtgctcagtaacaagatcgctaagttccgcaactccaccaaccacaagtacgccaactacattgtgaagcagtgcctgaaacacaactgcgggcgtatccagatggagcttctcaaggggatttccaagaatgacaggatactgaaagactggacctacttcgacctacaggagaagatcaaaaaccaggccgagatccacggtattgaagtgattaaggtggctcctgcttacacaagtcagcggtgctcacagtgcggctacatctgcaaggagaaccggtgcactcaggcaaccttcgagtgcaagcagtgcggatacaaaacccatgccgactacaacgcggccaagaacatctctacttatgacatcgagaacattatcaacaagcaattggctgttcagtctaagctgcacagcaagaaatgcatggaggagtatatcgaggaactgggttaccttgactga

SEQ ID NO: 2840 - DNA, 1335 bp, Unknown
  Bacillus sp. multi
atgaagtaccagattctctgcccgatgaacgttgactggacaatcttcgagaagcacctcagaaacctgacctaccaagttcggacaatctccaatcggaccatccagcagctctgggagttcgacgcactctcattcgagtatttcaaggagcgcggcacatatcctaccgtccaagacctctacgggtgcacgcagaagaaaatcgacgggtacatctatcacaccctacagtccaagtaccccgacatccacaaggggaatatgtccactaccttgcagaagattatcaagacatggaagtctcggaggaacgagatccgcaagggcgagatgtccatcccatccttccggaaccgcataccgattgacctccacaacaacagcgttgacatcatcaaggaaaaaaatggggactacattgccgggatctcactcttcagcagagactttcacaaggagaacggagacgtgccgaagggcaaaatcttcgttaagctggccacccaaaagcagaagtctatgaaggttatcctggacagacttatcaaccagacttactctaagggtgcctgcatgattcacaagtacaagaacaagtggtacttgagtattacttacaagttcaacgccatcaaggagaacaagttcgacaaggagctgattatggggatagacatgggcggcatcaacacagtttacttcgctttcaacgagggcttcatacgaagtaacattaagtccgacgagatcaagatgttcaacgagcgtattcgccagcggcgcattaacttgcttaaacaatccaagtactgctccaacagccggactgggaagggccgcaccaagcgtcttcagcccatcgacgttctgtccaacaagattgccaaattccgaaactctaccaaccacaagtacgcgaattacattgtgaagcagtgccttaaacacaactgcggacgcattcaaatggaacttctgaaagggatctctaagaacgacaagatcctcaaggactggacctacttcgacctacaggagaagatcaaaaaccaggcggagatccacggcatcgaagtgattaaggtggtgcctgcatacacctcccagagatgcagccagtgcggctacatctgcaaggaaaaccgctgcacccaagccaccttcgagtgcaagcagtgcggctacaagacccatgctgactacaacgccgctaagaacctgtcaacttacgacatcgagaacatcatcaacaagcagcttgccgtgcagtctaaactccacagcaagaagtgtatggaggagtacatcgaggaattgggatacctggactaa

SEQ ID NO: 2841 - DNA, 1335 bp, Unknown
  Bacillus sp. multi
atgaagtaccagattctgtgccccatgaacgtggactggactatcttcgagaagcacctcaggaacctcacctaccaagtgaggaccatcagcaaccggaccatccagcagttgtgggagttcgacgcactgagtttcgagtactttaaggaacgtggaacctaccctaccgtgcaagacctttacggttgtacgcagaagaaaatcgacggctatatctatcacaccttacaatccaagtacccagacattcataaggggaatatgagcactacactccagaagattatcaagacctggaaaagcagacgcaacgagatccgaaaaggcgagatgagtatcccatccttcagaaaccggatacccattgacctccataacaactccgttgacatcatcaaggagaagaacggtgactacatcgccggtatcagcctgtttagcagagacttccacaaggagaacggcgacgtccctaaggggaaaatcttcgtaaaactggctacccagaagcagaagtccatgaaggttatcctcgaccgccttatcaaccagacctactctaaaggggcttgcatgatccacaagtacaagaacaagtggtatctgtctattacctacaagttcaatgcgatcaaggagaacaagttcgacaaggaacttatcatgggaatagacatgggcggcatcaacaccgtttacttcgccttcaacgagggcttcatcagatccaacatcaagtccgacgagatcaagatgttcaacgagcgcatcaggcagaggaggatcaacctgctcaagcagtccaagtactgctccaactcccgaaccgggaaggggcggaccaagcgccttcagcccatcgacgtgctgtccaacaagattgccaagttcagaaactctacgaaccacaagtacgcaaactacatcgtgaagcagtgcttaaagcacaactgcgggcgcattcagatggagcttctcaagggcatcagcaagaacgacaagattctaaaggactggacctacttcgacctccaggagaagatcaaaaaccaggccgagatccacggcatcgaagttattaaggttgtcccggcttacacctcgcaaaggtgttcgcaatgcgggtacatctgcaaggaaaatcgctgcacccaggcaacgttcgagtgcaagcagtgcgggtacaaaactcacgccgactacaacgccgccaagaacctctcaacctacgacatcgagaacatcatcaacaagcaactagcagtacaatctaagctccactccaagaagtgtatggaggagtatatcgaggagctgggttacctggattga

SEQ ID NO: 2842 - DNA, 1335 bp, Unknown
  Bacillus sp. multi
atgaagtaccagatcctgtgcccgatgaacgttgactggactatcttcgagaaacacctccgcaacctcacctaccaagtcagaaccatctcaaatcgcacgatccagcagctctgggagttcgacgcgctctccttcgaatattttaaggagcgcggcacctatcccaccgtccaagacctctatgggtgcacgcagaagaaaatagacggttacatctatcacaccctacagtccaagtacccagacatccacaaggggaatatgagcactacccttcaaaaaatcatcaagacctggaaatcacgtcgtaacgagatcaggaaaggtgagatgtcaattcccagcttccgtaatcgcatccctatagacctccacaacaactccgtggacatcatcaaggagaagaatggggactacatcgctgggatcagcctgttctcacgcgacttccacaaggagaacggcgacgtgccaaagggcaaaatcttcgttaaactcgccacacagaagcaaaagtccatgaaggtgatcttggaccgtctcatcaaccagacctacagcaagggagcctgcatgatccacaagtacaagaacaagtggtatctgagcattacttacaaattcaacgccatcaaggaaaacaagttcgacaaggaactaatcatggggatcgacatgggcggtattaacacagtttacttcgctttcaacgaggggttcattcgctccaacatcaagtcagacgagatcaagatgttcaacgagcgcatccggcagaggcggatcaacctgctcaaacagagcaagtactgttcaaattcaaggactggcaaggggcgtacaaagcgacttcagcctattgacgtcctgagcaacaagatagccaagttccgcaatagcaccaaccacaagtacgcgaactacattgtgaagcagtgcctgaaacacaattgcgggcgaatccagatggaactccttaagggcatctccaagaacgacaagatcctcaaagattggacatactttgacctccaggagaagatcaaaaaccaggcagagatccacggaattgaggttattaaggtggtgcccgcctacacaagccagagatgctctcagtgcggctatatctgcaaggagaaccgatgtacccaggcaacgttcgaatgtaagcagtgcggttacaagactcacgcggattacaacgctgccaagaacctctccacctacgacatcgagaacatcatcaacaagcagttggccgttcaatctaagttgcattccaagaaatgcatggaggagtacatcgaggaactcgggtacttagactga

SEQ ID NO: 2843 - DNA, 1335 bp, Unknown
  Bacillus sp. multi
atgaagtaccagatcctctgccccatgaacgtggactggacaatcttcgagaagcacctcagaaacctcacctaccaagtacgaacaatctccaaccgcaccatccaacagctctgggagttcgacgcactttcgttcgagtatttcaaggaacgcggaacttaccccaccgtccaggatctatacgggtgcacacagaagaaaatcgacgggtacatctaccacaccctccagtcaaagtacccggacattcacaagggcaatatgagcaccacgctccagaagattatcaagacttggaaaagtaggcgcaacgagatccgcaagggcgagatgagtatcccctcattccgtaaccggattccaatcgacctccacaacaacagtgtggacatcattaaggagaagaacggggactacattgctgggatctcactgtttagtagggacttccacaaggagaacggcgacgttccgaagggcaaaatcttcgtcaaactggccacacagaagcagaaatctatgaaggtgatcctcgaccgcctcatcaaccagacctacagcaagggagcttgcatgatccataagtacaaaaacaaatggtatttgagtattacttacaagttcaacgccattaaggaaaacaagttcgacaaggaactgattatggggatcgacatgggcggtattaacacagtgtactttgccttcaacgagggattcatccgcagtaacatcaagagcgatgagattaagatgttcaacgaacgaatccgccagcgccggatcaacctactcaagcaaagcaagtactgttccaactcccgtactggaaaggggcggactaagcgacttcagcctattgacgtgctgagcaacaagatcgctaagttcagaaactctaccaaccacaagtacgcaaactatatcgtgaagcagtgcctaaagcacaactgcggacggattcagatggagttactcaagggtatcagtaagaacgacaagatattgaaggactggacctacttcgacctccaggagaagatcaaaaaccaggccgaaattcacgggatcgaggttatcaaggtcgttccggcctacactagccagcgttgctcgcagtgcggctacatctgcaaggagaaccgctgtacccaggccacgttcgagtgcaagcaatgcggctacaagacccacgccgactacaacgcggccaagaacttaagtacctacgacatcgaaaacattatcaataagcagctcgccgtgcaaagcaagctgcacagcaagaaatgcatggaggagtatatcgaggaattgggctatctggactga

SEQ ID NO: 2844 - DNA, 1335 bp, Unknown
  Bacillus sp. multi
atgaagtaccagatcctatgcccgatgaacgtggattggactatcttcgagaagcacctgaggaacctgacataccaagttcgtactatcagtaatcggacaatccagcagctctgggagtttgacgcgctcagcttcgaatatttcaaggagcgcggcacctaccccacggtccaagacctctatggctgcacgcagaagaaaatcgacggctacatctaccacacccttcagtccaagtaccccgacatccacaaggggaacatgagcaccacgcttcaaaaaatcatcaagacctggaaaagcagacgcaacgagatccgcaagggcgagatgagtatcccgtccttccgtaaccgcatccctatcgacctccacaacaacagcgttgacatcatcaaggagaagaacggtgactacatcgcgggtatatcactattcagtagggacttccataaggagaatggtgatgtccctaagggcaagatattcgtgaaactggccacccaaaagcagaagtctatgaaggtgatccttgaccgcctgataaaccagacctacagcaagggtgcttgcatgatccacaagtacaagaacaagtggtatctgtccatcacttacaagttcaacgctattaaggagaacaaattcgacaaggagctgattatgggaattgatatgggcgggatcaacaccgtttactttgccttcaacgaggggttcatccggtcaaacatcaagtctgacgagatcaagatgttcaacgagcggattcggcagcgccggatcaacctactcaagcagtccaagtactgctcaaacagtaggacagggaaggggcgtaccaaaaggctccagcccattgacgtgctcagcaacaaaatcgccaaattccgtaactccacaaaccacaagtacgcgaactacatcgtgaagcagtgcttaaagcacaactgtgggcgaatccagatggaactgttgaagggcatcagcaagaatgacaaaatcttgaaagactggacgtacttcgacttacaggaaaaaatcaagaatcaggcggagatccacggtatcgaggtcatcaaggtcgttccagcatacaccagtcagagatgctcacagtgcggctacatctgtaaggaaaatcgctgcacacaagctaccttcgagtgcaagcagtgcgggtacaagactcatgccgactacaacgctgccaagaacctgagtacctacgacatcgagaacattatcaacaaacagctcgcggtgcagagcaaactccatagcaaaaaatgcatggaggagtacatcgaggagctgggataccttgactga

SEQ ID NO: 2845 - DNA, 1356 bp, Unknown
  Bacillus sp. multi
ctcggggttactatcaagatcatgaagtaccagattctctgccccatgaacgttgactgggcgatcttcgagaaacacctacgttccctcacgtaccaagtaagaactatcagcaaccgcaccatccagcagttgtgggagttcgatgccctgtccttcgactatttcaaggagactgggacttcgccaaccgtacaagacctctatggctgcacccagaagaaaattgacggctatatctaccacaccctccagtcaaagtacccggacattcacaaggggaatatgagtacgaccttgcaaaaaatcatcaagacatggaaatcgaggagaaacgagatccgcaagggagagatgtctatcccctctttccgcaaccgcatccctatcgacctgcacaacaactccgtggacattactaaggagaagaatggcgactacatcgcgggcatatcgttattcagccgggacttccacaaggagaacagtgacgtcccaaagggcaaaatcttcgtgaagctggccacacagaaacaaaagtcgatgaaggtcatcctcgacaggcttatcaaccagacctactcaaaaggtgcctgcatgatccacaagtacaaaaacaagtggtatcttagtatcacgtacaaattcaacgccatcaaggaaaacaaattcgacaaggagttaatcatggggattgacatgggagggatcaacacggtgtacttcgccttcaacgaggggttcatccgttcaaacatcaagtctgacgagatcaagacattcaacgagcgaatccggcagcgccggattaaccttctcaaacagtcgaagtattgcagcaactctcgtatcggcaaagggcggactaagcgacttcagcccattgacgtcctttcgaacaagatcgccaagttccgaaactccacgaaccacaagtatgctaactacatcattaagcagtgcctaaaacacaactgcgggcggattcagatggaactgctcaagggcatactcaagaacgacaaggtgctcaagaactggacttacttcgatctccaggagaagatcaaaaaccaggcaaagatacacgggattgaagttattaagatcgccccagcctacacctcacagagatgctcacagtgcggctacatctgtaaggagaaccgctgcactcaagcaatgttcgaatgcaagcagtgcggatacaagacccacgcagactacaatgcggccaagaatatctcaacgtacgacatcgagaacatcatcaacaagcagctcgcagtgcagagcaagctgcactccaagaaatgcatggaggagtacattgaggagctgggatacctggactaa

SEQ ID NO: 2846 - DNA, 1356 bp, Unknown
  Bacillus sp. multi
ctcggtgtgaccattaagatcatgaagtaccagatcctctgcccgatgaacgtggactgggccatcttcgagaagcacctacgctcactcacgtaccaagttagaacaataagtaaccgcaccatccagcagctttgggagttcgacgccctctcgttcgactacttcaaggaaaccggcacatccccaacggtacaagacctttatggatgcacccaaaaaaagatcgacgggtatatctatcacacgctccagtccaagtaccccgacatccacaaggggaatatgtccacgacacttcagaaaatcatcaagacttggaaatcacgacggaacgagatccggaaaggtgagatgtccataccctccttccgcaacaggatacccatcgacctgcacaacaactcagttgacattacgaaggagaagaacggcgactatatcgcgggcatctcactgttcagccgtgacttccacaaggagaacagcgacgtcccaaagggcaagatattcgttaagctcgccacccagaagcagaagtccatgaaggttatcttggaccggcttatcaaccagacgtacagcaagggcgcttgcatgatacacaagtacaaaaacaaatggtatctctccatcacctacaagttcaacgcgattaaggagaacaaattcgacaaggaacttatcatggggatcgacatgggcggtatcaacactgtgtacttcgccttcaacgaggggttcattcgctccaacatcaagtcggacgagatcaagaccttcaatgagcgtatccgccagaggcggatcaacctactcaaacaatccaagtactgctccaactcccgcatcgggaaggggcgcactaagaggctacagcctattgacgtccttagcaacaagatcgccaagttccgcaactccaccaaccacaagtatgcgaactacatcatcaagcagtgccttaagcacaactgcggtcgcatccagatggagctgctcaagggcatccttaagaacgacaaggttctcaagaactggacctacttcgacctacaggagaagatcaaaaaccaggcaaagatccacgggatcgaagtgattaagattgcaccagcctacaccagccagcggtgttctcagtgcgggtacatctgcaaggagaaccggtgcacccaagctatgttcgagtgcaagcagtgcgggtacaagacccacgccgactacaacgcagccaagaatatcagcacctacgacattgagaacatcatcaataagcagctcgccgtccagagcaagctgcattccaaaaagtgtatggaggagtatatcgaggaactgggttacttggactaa

SEQ ID NO: 2847 - DNA, 1356 bp, Unknown
  Bacillus sp. multi
ctcggtgtcacgattaagatcatgaagtaccagattctctgccccatgaacgtggactgggccatcttcgagaagcacttgagatcattgacataccaagtccgtactatctccaaccggaccatccaacaactctgggagtttgacgctctgagcttcgattacttcaaggagaccggcacgtccccgacagtacaagacctgtacggctgcacccagaagaaaatcgacggctacatctaccacaccctccagtcaaagtacccagacatacacaaggggaacatgagcaccaccctccagaagattatcaagacttggaagtcaaggcgaaacgagatccgcaagggcgagatgtcaatcccttcattccggaacagaatacctattgacctgcacaacaactcagtggacatcacgaaggagaagaacggtgattacatcgctggaatctcccttttcagccgtgactttcacaaggagaactcagacgtccccaaaggcaagatattcgttaagctggccacccaaaagcagaagtcgatgaaggtcatcctcgaccgtcttatcaaccagacgtactctaagggtgcctgcatgattcacaagtacaagaacaaatggtacttgtcaattacttacaagttcaacgccatcaaggagaacaaattcgacaaagagctgattatgggcatcgacatgggtggcattaacacggtgtacttcgccttcaacgagggcttcattcgtagtaacatcaagtcggacgagatcaagaccttcaacgagcgcatcaggcaaaggaggataaacctactaaagcagtccaaatactgctccaacagccgcattggcaagggtagaacgaagcgtcttcagcccatcgacgtgctaagcaacaagatcgctaagttcagaaactccactaatcataagtacgccaactacattatcaagcagtgcctcaagcacaactgcgggcgcattcagatggaactgttgaagggcatccttaagaatgacaaggtgcttaagaattggacctacttcgacctacaggaaaaaatcaagaaccaggccaagatccacggcatcgaggttattaagatcgccccagcctacacatcacagaggtgcagtcagtgcgggtacatctgcaaggagaatcgttgtacccaggccatgttcgagtgcaagcagtgtggttacaagacccacgcagactacaacgcggccaagaacatcagcacttacgacattgagaacatcatcaacaaacagctcgccgtgcagagcaagctgcacagcaagaaatgcatggaggagtacatcgaggaactcggctacctagactag

SEQ ID NO: 2848 - DNA, 1356 bp, Unknown
  Bacillus sp. multi
ctgggtgtgactatcaagatcatgaagtaccaaatactctgtcccatgaacgtggactgggctatcttcgagaagcacctccgatccttgacataccaagtcaggactattagcaacaggaccatccaacagctctgggagttcgacgctctgtccttcgactacttcaaggagaccggcacgtcgccaaccgtgcaagacctgtacggctgcacgcagaagaaaatcgacggttacatataccacaccctccagtccaagtaccccgacattcacaagggaaacatgagtaccacgctccaaaaaatcatcaagacatggaagtcgcggcgcaacgagatccggaagggagagatgagcatcccttccttcagaaaccgcattcctatagacctgcacaacaactcggtggacattacaaaggagaagaatggggactacatcgcggggatctcactgttctcaagggatttccacaaggagaacagcgacgtccctaagggcaagatattcgtgaagctggccacccagaagcagaagtctatgaaggtgatcttggatcgtctcattaaccagacttacagcaaaggcgcgtgcatgatacacaagtacaagaacaagtggtacttatccataacctacaagttcaacgctatcaaggagaacaagttcgacaaggagttgataatgggaatagacatgggtggtatcaatacggtgtactttgcgttcaacgaggggttcatacggagcaacatcaagtccgacgagattaagaccttcaacgagcgcatcaggcaacggaggatcaacctcttgaaacaaagcaaatattgctccaatagccgcattggcaaagggcgtaccaagcgtttgcagcccatcgacgtcctatccaacaagattgcgaaattccgtaactctacaaaccataagtacgcgaactacatcatcaagcagtgcctaaaacacaactgcgggcgcatccagatggagctgctcaagggtatccttaagaatgacaaggtgctcaagaactggacctacttcgacttacaggagaagatcaaaaaccaggctaagattcacgggatcgaggtcattaagatcgcacccgcatacaccagccagaggtgttctcagtgcggctacatctgcaaggagaatcggtgcacccaggccatgttcgagtgcaagcaatgcgggtacaagactcacgcggactacaacgcagccaagaacatctcaacgtatgacattgagaacatcatcaataagcaacttgctgtgcagtccaagctccactccaaaaaatgcatggaggagtacattgaggaattgggctacctcgactag

SEQ ID NO: 2849 - DNA, 1356 bp, Unknown
  Bacillus sp. multi
cttggagtcaccatcaagatcatgaagtatcagatcctctgccccatgaacgtggactgggccatcttcgagaagcacttgcggagcctcacctaccaagtacgaaccatatccaaccgcactattcaacaattgtgggagttcgatgccctctcgttcgactatttcaaggagaccgggaccagccctaccgttcaagacctgtacggttgtacgcaaaaaaaaatcgacggctacatctaccacactctccaatcgaaataccccgacattcacaagggcaacatgagcaccaccttacagaagattatcaagacatggaaaagccgccgtaacgagatccgaaagggcgagatgagcatcccctcattccgtaaccgcattcctatcgacctccacaacaacagcgtggacatcacgaaggagaagaatggggactacattgctgggatttcactgttctcccgcgacttccacaaggagaactccgacgtgcctaagggcaagatattcgttaaactcgcaacccagaagcagaaatccatgaaggtgatccttgaccgtcttatcaaccagacatacagcaagggtgcttgcatgatacacaagtacaagaacaagtggtatctatctatcacctacaaattcaacgccattaaggagaacaaattcgacaaggagctaatcatgggcatcgacatgggcgggatcaacactgtgtacttcgcctttaacgagggcttcatccgatccaacattaagagcgacgagattaagacattcaatgagcgcattagacagcggcggattaacttactgaaacagtccaagtattgctccaactcgcgcattggcaaggggcgcactaaaaggttgcagcccatcgacgtcttgtccaacaagatcgccaaattccgcaactccactaaccacaagtacgccaactacatcattaagcagtgtctcaaacacaactgcgggagaatccaaatggagctgctcaagggaatccttaagaacgacaaggtgctcaagaattggacgtacttcgacctccaggagaagatcaaaaaccaggcaaagattcacggtatcgaggtcatcaagatcgccccagcatacacatcacaaaggtgctcccaatgcgggtacatctgtaaggagaaccggtgcacccaggctatgttcgagtgcaaacagtgcggatacaagactcacgccgactacaacgccgctaagaacataagcacctatgacattgagaacatcatcaacaagcagttggcggtccagtctaagctacactccaaaaagtgtatggaggagtacatcgaggagttgggctatttggactga

SEQ ID NO: 2850 - DNA, 1356 bp, Unknown
  Bacillus sp. multi
ctcggtgtgaccatcaagatcatgaagtaccagatattgtgccctatgaacgtggactggactatcttcgagaagcacctccggaacctcacataccaagtccgcaccatatccaatcgtaccatccagcaattgtgggagttcgacgccctcagcttcgactacttcaaggagcggggtacatacccgacagtccaagacttgtacggctgcacccagaagaagatagacgggtatatctatcacaccctccaatccaagtacccggacatccacaagggcaatatgagtaccacgctccaaaaaatcatcaagacttggaaatctaggcggaacgagatcaggaaaggagaaatgtccatcccttcctttcgaaaccgcataccaattgacctccacaacaactcagtggacatcatcaaggagaagaatggggactatatcgcgggcatctcgctgttcagcctcgacttccacaaggagaacggcgacgttccaaaagggaaaatcttcgtgaagctgggaacccaaaagcagaaatccatgaaggtcattctggaccggctcatcaatcagacttacagtaaaggtgcctgcatgatccacaagtacaagaacaaatggtatcttagtatcacatacaagttcaacgccatcaaggagaacaagttcgacaaaaagctaatcatggggattgacatgggcgggataaacaccgtgtacttcgccttcaacgaggggtttatcaggagcaacatcaagagcgacgagattaagatgttcaacgagcgtattcgccagagacgcatcaacctcctcaagcagtccaaatactgttctaatagtcgcaccggcaaggggcggacaaagcgcctccagcctattgacgttctgtccaataagatcgctaagttcagaaactcgacaaatcacaagtacgcgaactacatcgtgaagcagtgtcttaaacacaactgtgggcgaatccaaatggaactgctaaaagggataagcaagaacgacaaggtgctcaaagactggacctacttcgatctccaggaaaaaatcaagaatcaggccgaaatctacgggatcgaggttatcaaggtcgttccggcctacacatcgcagcggtgcagccagtgcggttacatctgcaaggagaaccgctgcacacaggccatgttcgagtgtaagcagtgcggatacaagactcacgcggactacaatgcggctaagaacatcagtacctacgacatcgagaacatcatcaacaagcaactcgcagtgcagtccaagctgcacagcaaaaaatgcatggaggagtacatcgaggaattgggctaccttgactag

SEQ ID NO: 2851 - DNA, 1356 bp, Unknown
  Bacillus sp. multi
cttggggtgaccattaagatcatgaagtaccagatcctttgcccgatgaacgtcgattggacgatcttcgagaaacacctcaggaacctcacgtaccaagtccggaccatctcaaaccgcaccatccaacaactttgggagttcgacgcgctctccttcgactactttaaggagcgcggcacgtacccaacggtccaggacttgtacggttgcacccagaagaagatcgacgggtacatctaccacacgctccagtccaagtaccctgacatccacaagggcaacatgagtaccaccctacagaagatcatcaagacgtggaaatcacgccgcaacgagattcgaaaaggcgaaatgagtattccctccttcagaaaccgcatcccaatcgacctccacaacaactccgttgacatcattaaggagaagaacggggactatatcgccgggatcagcctattcagcctcgacttccacaaggagaacggagacgtgccaaagggcaaaatcttcgtcaaactgggcacccaaaagcagaagtccatgaaggtgatactggaccgtcttatcaatcagacctactcgaagggtgcgtgcatgattcacaagtacaagaacaagtggtacttgtctatcacgtacaagttcaacgccatcaaggagaacaagttcgacaagaaactgataatggggatcgacatgggcggtattaacacagtgtacttcgccttcaacgagggattcataaggtcaaacatcaagtcggacgagatcaagatgttcaacgagcgaatccggcaacgacggatcaacttgcttaaacagtccaagtactgctccaactcaaggacaggcaaggggaggaccaagcgactccagccgatagacgtgctgtccaacaagatagccaagttccgtaattccaccaaccacaagtacgccaactacatcgttaagcagtgcctcaagcacaactgcgggcgtattcaaatggagctgctcaaagggatcagcaagaacgacaaggtgcttaaggactggacctacttcgacctacaggagaagatcaaaaaccaggccgagatatacggaattgaggtgattaaggtggtgccagcttacacctcgcagaggtgcagtcaatgcggctacatctgcaaggaaaaccggtgcacccaagcaatgttcgagtgcaagcagtgcggctacaaaacacacgcggactacaacgccgccaagaacatctcaacttacgacatcgagaacattatcaataagcaacttgcggtgcagtccaagttgcacagcaaaaagtgtatggaggagtacattgaggaattgggctaccttgactag

SEQ ID NO: 2852 - DNA, 1356 bp, Unknown
  Bacillus sp. multi
cttggggtgacgatcaagatcatgaagtaccaaatactctgccctatgaacgtggactggacgatcttcgagaagcacctacgcaacctcacttaccaagtccgcactatctcgaaccgcaccatccagcagctatgggagttcgacgcactatcgttcgactacttcaaggagcgcggcacctaccccaccgtccaagacctctacggctgcacccagaagaagattgacggttacatctatcacacccttcaaagcaagtaccccgacattcacaaggggaacatgagtaccacactccaaaaaatcatcaagacatggaaaagcagacgtaacgagatccgcaaaggtgagatgagcatcccttcgttccgaaaccgcatccctattgatctgcacaacaactctgttgacatcattaaggagaagaacggggactacatcgctgggatttcgctgttcagtctcgacttccacaaggagaacggcgatgtgccgaaaggcaagatattcgtgaaactggggacacagaagcagaagtccatgaaggtgattctcgaccgccttatcaaccagacatacagtaagggtgcctgcatgattcacaagtacaagaataagtggtatctgagtatcacatacaagttcaacgctattaaggagaacaaattcgacaagaagctaatcatggggatcgacatgggtgggatcaacaccgtgtacttcgctttcaacgaggggttcataaggtccaacatcaagtccgacgagatcaagatgttcaacgagcgcattcggcagcgtcggatcaacttgctcaagcagagcaaatattgttcgaactccagaaccggaaagggccggaccaaaaggcttcaacccattgacgtgctcagcaacaagattgccaaattccgcaatagcactaatcacaagtacgccaactacattgtgaaacagtgcttgaaacacaactgcgggcggattcaaatggagctgctaaaggggatcagcaagaacgataaggttctcaaagactggacctacttcgacctccaggaaaaaatcaagaatcaggcggagatatacggaatcgaggttatcaaggtggtgcccgcatacacctcccagcgctgctcccagtgcgggtacatctgtaaggagaatcggtgcacacaagcaatgttcgagtgcaagcagtgcggctacaagacccacgcagactacaacgcagccaagaatatcagcacgtacgacattgagaacatcatcaacaagcagctcgcagtccagagcaagttacactccaaaaaatgcatggaggagtatatcgaggagttggggtacttagactga

SEQ ID NO: 2853 - DNA, 1356 bp, Unknown
  Bacillus sp. multi
ttgggagttacgattaagatcatgaagtaccagatcctgtgcccgatgaacgtggactggacgatattcgaaaagcacctccggaacctcacgtaccaagtcagaacaatctccaatcgaaccatccagcagctctgggagttcgacgccctctcattcgactacttcaaggaaagaggaacctaccccaccgtgcaagacttgtacggatgcacgcagaagaaaatcgacggctatatctatcacacgctccagtcgaagtatcccgacatccacaagggcaatatgtccaccaccctacagaaaatcatcaagacttggaaatcacgacgcaacgagatccgaaagggcgagatgtccatcccgtcgttccgtaatcgcattccaatcgacctgcacaacaacagcgtggacatcatcaaggagaagaatggtgactacatcgcgggcatatctctattctccctggacttccacaaggagaacggcgacgtgcctaagggcaagatattcgttaaactaggaacccagaagcagaagtctatgaaggtgattctcgaccgccttatcaaccagacctacagcaaaggagcctgcatgatccacaagtacaagaacaagtggtacttgtctattacttacaagttcaacgcgatcaaggagaacaaattcgacaaaaaactgattatgggaattgatatgggcggtattaacactgtttacttcgccttcaacgaggggttcattcggtccaacattaagtcagacgagattaagatgttcaacgagcgcataagacaacggcggatcaacttgctcaagcagagcaagtattgctccaactcaaggactgggaaggggcgcactaagaggctccagccaatcgacgtcctttccaacaaaatcgccaagttccgcaactctacgaaccacaagtacgcgaactacatcgttaagcaatgccttaaacacaactgtgggcggattcagatggagctgcttaaggggatttccaagaacgacaaagttcttaaggactggacctacttcgacctccaggaaaaaatcaagaatcaggcggagatatacgggattgaggtcatcaaggtggtgcccgcctacacatcccagcgttgcagccagtgcggctatatctgcaaggagaatcggtgcacccaggccatgttcgagtgcaagcagtgcggttacaagactcacgcggactacaacgccgccaagaacattagcacatacgacattgagaacattatcaacaagcagttggcagtacaaagcaaactgcactccaagaagtgtatggaggagtacatcgaggagctggggtacttagactga

SEQ ID NO: 2854 - DNA, 1356 bp, Unknown
  Bacillus sp. multi
ctcggcgtcacgattaagatcatgaagtaccagatcctctgccccatgaacgtggactggacgatcttcgagaagcacctcagaaacctgacttaccaagtccgaactatcagtaatcggaccatccagcagctctgggagttcgacgctctgtccttcgactacttcaaggagcgaggcacatatcccacagtacaagacttgtacggttgcacccagaagaaaatcgacggttacatctaccacaccctacagtccaagtacccggacatccataagggcaacatgagcacgaccttgcagaagatcattaagacatggaagtcaaggcgcaacgagattcggaagggagagatgagcatcccctccttccgcaacagaatccccatcgaccttcacaataacagcgtggacatcatcaaggagaagaatggagattacattgccggtatatccttattctccctagactttcacaaggagaacggggacgtgcccaaaggcaaaatcttcgttaagctggggacgcagaaacagaagtccatgaaggtgatcctggaccggctcatcaatcagacttacagcaagggtgcgtgcatgatccacaagtacaagaacaaatggtacttgtctatcacctacaaattcaacgccatcaaggagaacaaattcgacaaaaagctcatcatgggaatagacatgggcgggatcaacaccgtctatttcgccttcaacgagggcttcattcgttccaacatcaagagcgacgagatcaagatgttcaacgagcgcatacggcagcggcggatcaacttgcttaaacagtcgaaatattgcagcaacagccgtaccgggaaggggaggaccaaacggttgcagccaatcgacgtgctttcaaacaagatagccaagttccgtaactctaccaaccacaagtacgctaactacatcgtgaagcagtgcttgaaacacaactgcggtcgaatccaaatggagcttctcaagggcatcagcaagaacgataaggttctcaaggactggacttactttgacctccaggaaaaaatcaagaatcaggcggagatatacggtatcgaagttatcaaggtggtccccgcctacacttcccaaaggtgcagccagtgcggctacatctgcaaggagaaccgctgcacccaggcaatgttcgagtgcaagcagtgcggatacaagacccacgccgactacaacgccgctaagaacatatccacttatgacattgagaacatcattaacaagcaactagccgtccaatccaaactacacagcaagaagtgtatggaggagtacatcgaggaactcggttatcttgactga

SEQ ID NO: 2855 - DNA, 1335 bp, Unknown
  Bacillus sp. multi
atgaagtaccagatcctctgcccgatgaacgtggactggactatcttcgagaagcacctcaggaacctgacctaccaagtaagaactatctcaaaccggaccatccagcaattgtgggagttcgacgcgctgagtttcgactacttcaaggagcggggcacgtacccaaccgtccaagacctctacggctgtactcagaagaaaatcgacggctacatctatcacacccttcaaagcaagtacccagacatccataagggcaacatgagcaccacgctccaaaaaatcatcaagacttggaaaagtaggcgcaacgagatccgcaagggcgagatgagtattccctccttccgcaaccgcatccctattgacctgcacaacaacagcgtggacatcatcaaggagaagaatggggactacatcgcgggtatctctctattctcaagggacttccacaaggagaacgacgatgtgcctaagggcaagatattcgtcaagttgagcacccagaagcagaagtccatgaaggtcatccttgaccgtcttatgaaccagacatactcaaaaggtgcgtgcatgatccacaagtacaagaacaagtggtacttgtccataacctacaagttcaatgctatcaaggagaacaaattcgacaaggagttgataatggggattgacatgggcggcatcaacaccgtttacttcgcattcaacgagggcttcatccgaagcaacatcaagtcggacgagatcaagatattcaacgagcgcattcggcagcggcgtatcaacctccttaagcagtccaaatattgttccaacagccggacagggaaaggtcggactaagcgccttcagcccattgacgtcctcagcaacaagatagccaaattcagaaacagcaccaaccacaagtacgccaactacatcgtgaagcagtgtcttaaacacaactgcgggcgcatacagatggagctgctgaaagggataagcaagaacgacaaaatcctcaaggactggacctatttcgacctccaggaaaaaatcaagaatcaggctgagatacacgggattgaggttattaagatcgctccagcctatacttcacagaggtgctctcagtgcggctacatctgcaaggagaaccgctgcacccaggccgtcttcgagtgcaagcaatgcgggtacaagacccacgcagactacaacgctgccaagaacatatcaatctacgacattgagaacatcatcaacaagcagcttgcagtccagtcaaagctccacagcaaaaagtgtatggaggagtatatcgaggagctgggctacttggactga

SEQ ID NO: 2856 - DNA, 1335 bp, Unknown
  Bacillus sp. multi
atgaagtaccagatcctctgccccatgaacgtggattggaccatcttcgagaagcacctccgaaacctcacctaccaagtcagaaccattagcaaccgtacgatccagcagctatgggagttcgacgctctcagcttcgactatttcaaggaacgcggcacctaccccacggtgcaagacctttacggttgtactcaaaaaaagatagacgggtatatctaccacacattgcagtctaagtaccccgacatccacaaggggaatatgagcacgaccctccagaaaatcattaagacctggaagtcgaggcgcaacgaaatcaggaaaggagaaatgtcaatcccctccttcagaaaccgcatccctatcgacctacacaacaacagcgtggacattatcaaggagaagaatggtgactacattgctggaatctcattgttcagtagggacttccacaaggagaacgatgatgtgccgaagggcaagatattcgtcaagctgagcacccagaagcagaagtccatgaaggtcatccttgaccgtctcatgaaccagacgtacagcaagggagcgtgcatgatccacaagtacaagaacaagtggtatttgagtatcacctacaagttcaacgccattaaggagaacaagttcgacaaggaactaatcatgggaatcgacatgggcgggattaacacagtgtacttcgctttcaacgagggattcatccgcagtaacattaagtccgacgagatcaagatattcaatgagcgaatccgtcaaaggcgcatcaatctcctaaagcagagcaagtattgctccaactccaggactggcaagggacggaccaagcggctccagcctattgacgtgcttagcaacaagatcgccaagttccgtaacagcaccaaccacaagtacgccaactacatcgtgaagcagtgccttaagcacaactgcgggagaatccagatggagcttctcaaagggattagcaagaacgacaagattctgaaagactggacctacttcgatctacaggaaaaaatcaagaatcaggcggagatccacggaatcgaagtgattaagatagcaccagcttacacttcacaaaggtgctcgcagtgcgggtatatctgcaaggagaaccgctgcacacaggcagtctttgagtgcaagcagtgcgggtacaagactcacgccgactacaatgcagccaagaacatctcaatctacgacatcgagaacatcatcaacaagcagcttgctgttcaaagtaagctgcactccaagaagtgtatggaggagtacatcgaggagttgggctacttggattga

SEQ ID NO: 2857 - DNA, 1335 bp, Unknown
  Bacillus sp. multi
atgaagtaccaaatcttatgtcccatgaacgttgactggaccatattcgagaagcaccttcggaacctcacgtaccaagtgcgaacaatctcgaaccgaaccatccagcagctttgggagttcgacgcgctcagcttcgactacttcaaggaacgaggcacatatcctacagtacaagacctctatggctgcacccagaagaagatcgacgggtacatctaccacaccctccagagcaagtaccccgacatccacaagggcaatatgagtacgaccctccagaagatcattaagacctggaaaagtcgtcggaacgagatccgaaaaggtgagatgagcatcccctcctttcgtaaccgcatcccaattgacttgcacaataactccgtggacatcatcaaggaaaaaaacggcgactacatcgcgggtatcagcctcttcagtagggacttccacaaggagaacgacgatgtgcctaagggcaaaatcttcgtaaagctctccacgcagaagcagaagtccatgaaggttatcctggacaggctgatgaaccagacctactcaaagggtgcttgcatgatccacaagtacaagaacaagtggtacttatccataacatacaaattcaacgcgatcaaggagaacaaattcgacaaggaactgattatggggatcgacatgggcgggataaacaccgtgtacttcgccttcaacgagggcttcatccgaagcaacattaagagcgacgagatcaagatattcaacgagcgcatccgtcagcgaaggatcaacttactaaagcagtccaagtattgctccaacagcagaacagggaaggggcgtacaaagcgccttcagcccattgacgtcctaagcaacaagatagcaaagttccgtaattcgaccaatcacaagtacgcgaactacatcgttaagcagtgcttgaagcacaactgcggccgaatccagatggagttgctaaagggcatctctaagaacgataagatcctcaaggactggacttacttcgatctccaggaaaaaatcaagaatcaggcagagatccacggcatcgaggtgattaagatagcccctgcctacacctctcagcgctgctcccagtgcggttacatctgcaaggagaataggtgcactcaggctgtgttcgagtgcaagcaatgcggttacaagactcacgcggactacaacgcagccaagaatatctcaatctacgacatcgagaacatcattaacaagcagttggccgtccagtcgaagctgcactccaagaaatgcatggaggagtacatcgaggaactgggttacctggactag

SEQ ID NO: 2858 - DNA, 1335 bp, Unknown
  Bacillus sp. multi
atgaagtaccagatactctgtcctatgaacgttgactggacgatattcgagaagcacctccgtaacctcacctaccaagtccgaacaatcagcaaccgcaccatccagcagctttgggagttcgacgcactctccttcgactacttcaaggagcggggaacctaccccaccgtccaagacctttatggctgcactcagaagaaaatcgacgggtacatctaccacacgcttcaaagcaagtatccggacattcataagggcaatatgagcaccaccctacagaagatcatcaagacctggaaatctcgccgcaatgagattcgcaaaggtgagatgtcgataccctctttccgcaacagaatacctatcgacttgcacaacaactccgttgacatcattaaggagaagaacggcgactacatcgccggaatcagcctattctcaagggacttccacaaggagaacgatgacgtgcccaaaggaaagatattcgtgaagttatcaactcagaagcagaagtccatgaaggtgatcctggacaggcttatgaaccagacgtacagcaaaggagcctgcatgatccacaagtacaaaaacaagtggtatctaagtatcacatacaaattcaacgccatcaaggagaacaaattcgacaaggagctaatcatggggattgacatgggtgggattaacacagtgtacttcgcgttcaacgaggggttcattcggtccaacattaagagcgacgagatcaagatattcaacgagcgaatcagacagaggcgcatcaacctgctcaagcagtccaagtattgctccaactcccggacaggcaaggggcgcaccaaacggctacagcccattgacgtcctctcaaacaagattgcgaagttccgtaacagcacaaaccacaagtacgctaactacatcgtgaagcagtgcctaaagcacaactgtggacgtattcagatggaactccttaaagggattagcaagaacgacaagattctcaaggactggacgtacttcgacctccaggaaaaaatcaagaatcaggctgagatccacgggatcgaggttattaagatcgcacccgcctacaccagccagcgttgctcccagtgcggctacatctgcaaggagaaccggtgcactcaggcggtgttcgaatgcaaacagtgcggttacaagacgcacgccgattacaacgccgccaagaatatcagtatctatgacatcgagaacatcatcaacaagcagttggcagtccagagcaaactgcactccaaaaagtgtatggaggagtacatcgaggagctgggctaccttgactga

SEQ ID NO: 2859 - DNA, 1335 bp, Unknown
  Bacillus sp. multi
atgaagtaccagatactgtgtcccatgaacgtggattggaccatcttcgagaaacacctccgcaacctcacgtaccaagtccgaactatcagcaaccgcaccatccagcagctctgggagttcgatgccctctccttcgactacttcaaggagcgaggcacgtaccccaccgtccaagatttgtacggttgcacccagaagaagatcgacgggtacatctaccacacccttcagtccaagtaccctgacatccacaagggcaacatgagcacaaccctccagaagattattaaaacttggaaatccagacgtaacgagatccgcaagggcgagatgagcattccatcattccgtaaccgcatcccaatagacctacacaacaattccgtggacattatcaaggagaagaatggtgactatatcgctggtatctccctcttcagcagagatttccataaggagaatgacgacgtgccaaagggcaaaatcttcgttaaactgtccacacagaagcagaagtcgatgaaggtgatacttgaccggcttatgaaccagacatactcaaagggtgcgtgcatgatccacaagtacaagaataagtggtatctatccataacttacaagttcaatgctattaaggagaacaagttcgacaaggagcttatcatggggatcgacatgggtggcattaacaccgtgtacttcgctttcaacgagggcttcatccggtcgaatatcaagtccgacgagatcaagatattcaacgagcgcatccggcagaggcgcatcaatctgctgaaacagagcaaatactgttcaaattcaagaacgggaaaggggaggactaagcgtctccagcccatcgacgtcctgagcaacaagatcgccaagttccgcaactcgactaatcacaagtacgccaactatatcgttaaacagtgcctcaagcacaactgtggtagaattcagatggagttactaaagggaatttccaagaacgacaagattctcaaggactggacatacttcgatctccaggagaaaattaagaatcaggccgagattcacggcatcgaggtgatcaaaattgctcctgcttacacctcccagcgctgtagccagtgcgggtacatctgcaaggagaaccgctgtactcaggccgtcttcgaatgcaagcagtgtggttacaagacccatgccgactacaacgcagccaagaacattagcatatacgacatcgagaacatcatcaacaagcaactcgcagtgcagagcaagctccacagcaaaaaatgcatggaggagtacatcgaggaactgggttacctcgactga

SEQ ID NO: 2860 - DNA, 1335 bp, Unknown
  Bacillus sp. multi
atgaagtaccagatcctgtgcccgatgaacgtggactggacaatcttcgagaagcacctcagaaacctgacctatcaagtacgaaccatcagtaaccgcacaatccagcagctctgggagttcgacgctctctcattcgactacttcaaggagcgtggaacttaccccactgtacaagacctatatggatgtacgcagaagaaaatagacggctacatctaccacaccctccagagcaagtacccagacatccacaaggggaatatgtccactactctccagaagattatcaagacatggaaatcacgccgcaacgagatccggaagggagagatgtcgattcctagtttccgtaacagaataccaattgatctccacaacaactccgtggacatcactaaggagaagaatggggcgtacattgctggaatctcgttttttagtcgtgacttccacaaggagaacggcgacgtgccaaagggcaagatattcgtgaaactgtcaacccagaaacagaagtccatgaaggtgatcctcgaccggctcatgaaccagacctactcgaagggagcttgcatgatccacaagtacaagaacaagtggtatctgtcgatcacctacaagttcaacgccatcaaggagaacaagttcgacaaggagcttatcatggggattgacatgggtgggattaacacagtgtacttcgctttcaacgaggggttcatccgctcgaatatcaagtccgacgagatcaagatgttcaacgagcgcatcaggcagcggcggatcaacctgctaaaacagtcaaagtattgcagcaacagtcggactggaaagggacggacaaaacgcttgcagcctatcgacgtgctgagcaacaagattgccaaattccggaactccaccaaccacaagtacgcgaactacatcgtcaagcagtgtctcaagcacaactgcggacgcatacagatggagttgcttaaggggatcagcaagaatgacaagatccttaaagattggacctacttcgacctacaggaaaaaatcaagaatcaggcagagatacacgggatcgaagttatcaaggtggcacccgcctacacatcccaaagatgtagccagtgcgggtacatctgcaaggagaatcgctgcactcaggccacgttcgagtgcaagcagtgcgggtacaagacccatgcagactacaatgctgccaagaacatctctacctacgacatcgagaatatcatcaacaagcagcttgccgtgcagtctaagctccattccaaaaagtgtatggaggagtacattgaggagttgggctacctggactga

SEQ ID NO: 2861 - DNA, 1335 bp, Unknown
  Bacillus sp. multi
atgaagtaccagatcctttgccccatgaacgtggactggaccatcttcgagaagcacctccgcaacttgacctaccaagtccgaaccataagcaaccgcactatccagcagttgtgggaatttgacgccctatccttcgactacttcaaggagcgcggcacctaccccacggtacaagacctctacggatgcacccagaagaagatcgacggttacatctaccacaccctccaatccaagtatcccgacatccataaggggaatatgagcactaccttgcaaaaaatcattaagacctggaagtcccgacgtaacgagatccgcaaaggcgagatgtcaatcccctctttccgtaaccgcatcccaattgacctccacaacaactcggttgacatcactaaggagaagaatggggcgtatatcgcgggtatctcattctttagccgagatttccacaaggagaacggcgacgtcccgaagggcaaaatcttcgttaagctgagcacccagaaacagaagtccatgaaggtgatcctcgaccggttgatgaaccagacctactcaaaaggtgcgtgcatgatccacaagtacaagaacaagtggtatcttagcataacatacaaattcaatgccatcaaggagaacaagttcgacaaagagttgataatgggcatcgacatgggtgggatcaacacagtgtacttcgccttcaacgaggggttcatacgctcaaacatcaagtcagacgagatcaagatgttcaacgaaaggataagacaaaggcgcatcaaccttctcaagcagagcaagtattgctcgaactcccgcaccggcaaggggcgtacaaagcgtctccagcccattgatgtcctgtcaaacaagatcgccaaattccgtaactccaccaaccacaagtacgccaattacattgtgaagcagtgcctcaaacacaactgcgggcgtatccagatggagttgcttaaagggatcagcaagaacgacaagatacttaaggactggacctacttcgacctccaggagaagatcaaaaaccaggccgagatccacgggatcgaagtgattaaggtggcaccagcctataccagtcaacggtgttctcagtgcggctacatctgtaaggagaaccgttgcacccaggcgactttcgaatgcaagcagtgtggctacaagacccacgctgactacaatgcggccaagaacatatccacttacgatattgagaacatcattaacaaacagctcgctgtgcagtctaaactgcatagcaaaaaatgcatggaggagtacattgaggaactcgggtacttggactag

SEQ ID NO: 2862 - DNA, 1335 bp, Unknown
  Bacillus sp. multi
atgaagtaccagattctgtgcccgatgaacgtggattggacaatcttcgagaagcacttgaggaacctcacctaccaagtacgcaccatctcgaacaggacgattcagcagctctgggagttcgacgcgctatcattcgactacttcaaggagcggggcacctatcccactgtccaagacctttatggttgcacacagaagaaaatcgacggttacatctaccacaccttgcaatcgaagtatcccgacatccacaaggggaacatgagcaccaccctccaaaaaatcattaaaacttggaaaagccgacgcaacgagatccgcaagggagaaatgtccatccccagtttccgcaaccgcatcccgatagacctccacaacaacagcgttgatattactaaggagaagaacggtgcctatatcgctggtatatcgttttttagtcgtgactttcacaaggagaacggggatgttcctaaggggaaaatcttcgtaaaactctcaacccagaagcagaagtccatgaaggtcattctcgaccgtcttatgaaccagacgtactccaaaggggcctgcatgattcacaagtacaagaacaagtggtacttgagtatcacatacaagttcaatgctatcaaggagaacaaattcgacaaagagctaatcatggggattgacatgggagggattaacacggtgtacttcgccttcaatgaggggttcatacgctcaaacatcaagtccgacgagatcaagatgttcaacgagcgaatccggcaaaggcggataaacttgctcaagcagtccaaatattgttccaactcccgaacgggcaagggccgcaccaagcggcttcagccaatcgacgtattgagcaataagatcgccaagttccgtaactccacgaatcacaagtacgcgaactatatcgtgaaacagtgccttaagcacaactgcgggcgcatccagatggaacttctcaagggaatcagcaagaacgacaagatcctcaaagattggacttactttgacctccaggagaagatcaaaaaccaggccgagatacacgggatcgaggtcattaaggtggccccggcctacacgagtcagcggtgcagtcaatgcggctacatctgcaaggagaataggtgtacccaggctaccttcgagtgcaagcagtgcggctacaagacccacgcagactacaacgctgccaagaacatcagcacatacgatattgagaatatcatcaacaagcaactagcggtacagtcgaaactccactccaaaaaatgcatggaggagtacatcgaggaactcggatacctggactga

SEQ ID NO: 2863 - DNA, 1335 bp, Unknown
  Bacillus sp. multi
atgaagtaccagatcctctgccctatgaacgtggactggacgatcttcgagaagcacctccgcaacctcacgtaccaagtgcggaccatctcaaaccgtacgatccagcagctctgggagttcgacgccttgtcgtttgactacttcaaggagcgtggaacctaccccaccgtccaagacctatatggctgtactcagaagaagatagacggctacatctaccacacccttcagagcaagtaccctgatatacacaaggggaatatgagcaccacgctacaaaaaataatcaaaacttggaaaagccgccgcaacgagatcaggaaaggtgaaatgagcatccccagctttcgcaaccggattccaatcgacctccacaacaactccgttgatattacgaaggagaagaatggagcttacattgctgggatctcgttctttagtagggacttccataaggagaacggtgacgtacctaagggcaaaatcttcgtcaagttgagcacccagaagcaaaagtccatgaaggttatcctcgaccgccttatgaaccagacctactcaaaaggagcttgcatgatccacaagtacaagaacaagtggtacttgagtatcacttacaagttcaatgctatcaaggagaacaagttcgacaaggagttgataatggggatagacatgggtgggatcaacaccgtgtacttcgcattcaacgaggggttcattcgaagtaacattaagagtgacgagatcaagatgttcaacgagcgcatcaggcagagacgtatcaacctcctcaagcagtctaagtattgctcaaacagtaggacaggaaagggccgcaccaagcgactccaacccattgacgtcctgagcaacaagattgctaagttccgcaacagcacgaaccacaagtacgccaactacatcgtgaagcagtgcctcaagcacaactgcggcagaatccagatggaactgttgaaaggaatcagcaagaatgacaagatactcaaggactggacgtacttcgacctccaggaaaaaatcaagaatcaggccgagattcatgggatcgaggttatcaaggtcgctccagcctacaccagccagagatgcagccagtgcgggtatatctgtaaggaaaatcgttgtactcaggctactttcgaatgcaagcagtgcggctacaagactcacgccgactacaacgccgccaagaacatctctacctacgacatcgagaacatcattaacaagcagctcgctgtgcagtccaagttgcattccaagaaatgcatggaggagtatatcgaggagctgggatacctcgactag

SEQ ID NO: 2864 - DNA, 1335 bp, Unknown
  Bacillus sp. multi
atgaagtaccagatcctatgccctatgaacgtggactggaccatcttcgagaaacacctccgcaacctgacctaccaagtgaggaccatcagcaaccgtaccatccaacaattgtgggagttcgacgctctgagcttcgactacttcaaggaacgtggtacatatccgactgttcaagacctgtacggatgcacccagaagaaaatagacggctacatctaccacacccttcagtccaagtaccccgacattcacaagggcaatatgtccaccaccttgcagaagatcatcaagacgtggaaaagtcgccgcaacgagatacgcaagggcgagatgtccattccatccttcagaaatcggattccaattgatctgcacaacaacagcgtggacattacgaaggagaagaacggggcctatatcgctggtatatccttttttagtcgtgacttccacaaggagaatggggacgtgccaaagggcaaaatcttcgtaaagctctcaacccagaagcagaagtccatgaaggtgattcttgacagactcatgaaccagacctacagcaagggagcctgcatgattcacaagtacaagaacaagtggtatctatccatcacgtacaagttcaacgctatcaaggagaacaaattcgacaaggagctgattatggggattgacatgggtggtatcaacaccgtgtacttcgcgttcaacgaggggttcatccgatccaacatcaagagcgacgagattaagatgttcaacgagcgcataagacagaggaggatcaatctgttgaaacagtccaagtactgttccaactctaggacggggaagggccgtaccaagaggctccagcctattgatgtgctgagcaataagatagccaaattccggaacagcaccaaccacaagtacgccaactacatcgtgaagcagtgtctcaagcacaactgcggtcggattcaaatggagctattgaagggcatcagtaagaatgacaagatcctcaaggactggacctacttcgacctccaggaaaaaatcaagaaccaggcagagatccacggtattgaagtgattaaggttgcgcccgcctatacctcccagaggtgttcacagtgcgggtatatctgcaaggagaaccgctgcacccaggccacattcgagtgcaagcagtgcggatacaagacccacgctgactacaacgccgccaagaacatatccacctacgacatcgagaacatcattaacaagcagctcgcggtgcagtcaaagctccatagcaaaaagtgtatggaggagtacatcgaggaactcgggtacttggactag

SEQ ID NO: 2865 - DNA, 1335 bp, Unknown
  Bacillus sp. multi
atgaagtaccaaatcctctgccccatgaacgtggactggacaatcttcgagaaacacctcagaaacctcacctaccaagtccgaaccatctccaaccgtaccatccagcagctctgggagttcgacgccctcagcttcgactacttcaaggaacgtggtacttatcctaccgtccaagacctctacggctgtacccagaagaaaatcgacggctacatctaccacaccttacaaagcaagtatcccgacatccacaagggcaacatgagcacgaccctccagaagattatcaagacctggaaatcgaggcggaacgagatccgcaagggcgaaatgtccataccctcattccgcaaccggattcctatcgacttgcacaacaacagtgtggacatcaaaaaggagaagaacggggactatatcgcgggcatctctctattcagtagggacttccataaggagaacagtgacgtgccaaagggcaagatattcgtgaaattggccaccaaaaaacaaaagtccatgaagatcattctcgacagattgatgaaccagacgtacagtaaaggtgcttgcatgatccataagtacaagaataagtggtatctcagcatcacttacaagttcaacgccatcaaggagaacaagttcgacaaggatctcatcatgggcatcgacatgggcgggattaacaccgtttacttcgcattcaatgagggcttcatacgctccaacatcaagtccgacgagattaaggcgttcaatgagcgaatacgccaaaggaggatcaacctcctcaaacagtctaagtattgctccaactctcgcacaggcaaggggagggagaaacgactccagcctatcgacgtgctgtcgaacaagatcgccaaattcagaaatagcaccaaccacaagtacgcgaactacatcattaagcagtgccttaaacacaactgcggtcgcatccagatggaacttctaaaggggataagcaagaatgacaaggtgctcaaagactggacttacttcgacctccaggagaagatccagaaccaggccgagatccacgggatcgaggtcattaaggtggcacccgcctacacctcccagcgctgctcccagtgcggctacatctgcaaggagaaccgttgtacccaagccgtcttcgaatgcaagcagtgcgggtacaagactcatgcggactacaacgcggccaagaacatcgctacctatgacatcgagaacatcatcaacaagcagttggccgttcagtcgaaactgcactccaagaaatgcatggaggagtacatcgaggaactggggtacttggattag

SEQ ID NO: 2866 - DNA, 1335 bp, Unknown
  Bacillus sp. multi
atgaagtaccagatcctctgcccgatgaacgtggattggaccatattcgagaagcacctccgtaacctcacctaccaagtccggaccattagcaaccggaccatacagcagctctgggagttcgacgcgctctccttcgactacttcaaagagcgcggcacgtaccccaccgtccaagacttgtacgggtgcacgcagaagaaaatcgacggctatatctatcacaccttacaatccaagtaccccgacatccacaagggcaatatgtcaacaaccctacagaaaatcatcaagacttggaaatccaggcggaacgagattcgcaagggagagatgtcgatccctagtttccgaaaccgcatccctatcgaccttcacaacaactccgtggacatcaagaaagagaaaaacggcgattacatcgctggaatcagcctcttcagtagagacttccacaaggaaaactctgacgtgcctaaggggaaaatcttcgtaaagctggcgaccaagaagcagaagtccatgaagatcatcctcgacaggctgatgaaccagacctactcgaaaggtgcctgcatgatccacaagtacaagaacaagtggtacttgtctatcacgtacaaattcaatgccattaaggagaacaaattcgacaaggacttgataatgggcattgatatgggagggattaacactgtgtacttcgctttcaacgagggattcattcggagcaacatcaagagcgacgagattaaggctttcaacgagcgcattcggcagcggcggataaacctgttgaaacaaagcaaatattgttccaacagccgaacagggaagggccgggagaagcgcctacagccaatcgacgtcctgagcaacaagatcgccaaattccggaactcgacgaatcataagtacgctaactacatcattaagcagtgcttaaagcacaattgcggtcgcattcagatggaattactcaagggcatcagtaagaacgataaggtgcttaaggactggacctacttcgacttacaggagaagattcagaaccaggccgagatccacggcatcgaggtcattaaggtcgcacccgcatatacaagtcaaagatgctctcaatgcggttacatctgcaaggagaaccgctgcacccaggcagtgttcgagtgcaagcagtgcggctacaagacccacgctgactacaacgcggccaagaatatcgcaacgtacgacattgagaacattatcaacaagcaactcgcggtccaaagcaaattgcacagcaagaagtgtatggaggagtacatcgaggaactcggttacctagactag

SEQ ID NO: 2867 - DNA, 1335 bp, Unknown
  Bacillus sp. multi
atgaagtaccagatcctttgccccatgaacgtcgattggacgatcttcgagaaacacctgaggaatttgacctaccaagttagaacaatctcaaacaggaccattcagcagttgtgggagttcgacgccctctccttcgactacttcaaggagcgcggcacctaccccactgtgcaagacctatatggttgcacccagaagaaaatcgacggttacatctaccacaccctgcaatccaagtatccagacatccacaaggggaatatgagcacaactctccaaaaaatcatcaagacttggaaatcacgccgcaacgagatacgcaagggcgagatgagcatcccctctttccgcaaccggattcctattgacctgcacaacaacagcgtggatatcaaaaaagagaagaacggggactatatcgccggtatatccctcttcagtcgagacttccacaaggagaactccgacgtgcctaagggcaaaatcttcgtcaagctggccaccaaaaaacaaaagtccatgaagatcatcctggaccgactgatgaaccagacttacagcaagggtgcgtgcatgattcacaagtacaagaacaagtggtatctgtccataacctacaaattcaacgccattaaggagaacaaattcgacaaagacctgattatggggattgacatgggcgggataaacaccgtgtacttcgcattcaacgagggcttcatccggtccaacatcaagtcggacgagatcaaggcgtttaacgagcgcatccggcagcgccggattaacctactcaaacaatccaaatattgttcaaattcccgtactggaaaaggccgcgagaaacggttgcagccaattgacgtgctttccaacaagattgctaagttccgcaacagcacaaaccacaagtacgccaactatatcattaagcagtgcctgaaacacaactgtgggcgaatccagatggagctgctcaagggaatctccaagaatgacaaggttcttaaggactggacatacttcgacctacaggagaagatacagaaccaggcagagatccacgggatcgaggtcattaaggtggctccagcctataccagtcagaggtgctctcaatgcgggtacatctgcaaggagaaccgctgcacccaggccgttttcgagtgcaagcagtgcggctacaagacccacgctgactacaacgccgctaagaacattgcaacgtacgacatcgagaacatcatcaacaagcagttggctgtgcagtccaaattgcattccaagaaatgcatggaggagtacatcgaggagttgggctatcttgactga

SEQ ID NO: 2868 - DNA, 1335 bp, Unknown
  Bacillus sp. multi
atgaagtaccagatactctgcccgatgaacgtggattggaccatattcgagaagcacctgagaaacctgacctaccaagtccgtacaatctcaaacagaactatacagcagctctgggagttcgacgcgctgagctttgactatttcaaggaaagaggaacataccctacagtccaagacttgtacggctgcacccagaagaaaatcgacggttacatataccacacgctccagagcaagtaccctgacatccacaaggggaacatgagcaccacgcttcagaagatcattaagacctggaagtcacgccgtaacgagatcaggaagggcgaaatgtctatcccatccttccgcaaccgaatccccatcgacttgcacaacaactccgtggatattaaaaaggaaaaaaacggcgactacatcgccgggatctcactgtttagcagagatttccacaaggagaactccgacgtcccgaagggcaagatattcgttaagctcgccaccaagaagcagaagtccatgaagatcatcctggataggcttatgaaccagacctactctaagggtgcgtgcatgatccacaagtacaaaaacaaatggtatttgagtatcacatacaagttcaacgctatcaaggagaacaagttcgacaaagacctgattatgggaatcgacatgggtgggatcaataccgtttactttgctttcaacgaggggttcatacgcagcaacatcaagagtgacgagatcaaggcgttcaacgagcgaatacgtcaacgacggatcaacttgctcaagcagagcaaatactgctcaaattcccgcaccgggaagggacgcgagaagcgcctacaacctatcgacgtccttagcaataagattgccaagttccgcaatagcactaatcacaagtatgcaaactacatcatcaagcagtgcttaaaacacaactgcggtcgaatccagatggagttgctaaaggggataagtaagaacgacaaggtgttgaaggactggacctacttcgacctccaggaaaaaatccagaaccaggcagagatccacggcatcgaggtcatcaaggtggccccggcctacacaagccagcggtgctcacagtgcgggtacatctgcaaggagaaccgctgcacacaggcggttttcgagtgcaagcagtgcggatacaagacacacgccgactacaacgcggctaagaacatcgctacctacgacattgagaacattatcaataagcagctcgcagtacagtcaaagctccactccaagaaatgcatggaggagtacatcgaggaactgggctacctcgactag

SEQ ID NO: 2869 - DNA, 1335 bp, Unknown
  Bacillus sp. multi
atgaagtaccaaatactttgccccatgaacgtggactggacgatcttcgagaagcacctccgcaacctcacctaccaagttcgcaccatcagcaaccgcactattcagcaattgtgggagttcgacgccctcagcttcgactacttcaaggagcgcggcacctacccgaccgtccaagacctttatggctgcacccagaagaagattgacgggtacatctaccacaccttgcagtcgaagtaccccgacatccacaagggcaatatgagcactacattgcagaaaatcattaagacctggaaatcgcgccggaacgagatccgcaagggcgagatgagcatcccctcattccgcaaccgtatccccatcgaccttcacaacaactccgtggacattaagaaggaaaaaaatggggactacatcgcgggtatatccctcttcagccgcgacttccacaaggagaactcagacgtcccaaaggggaaaatcttcgtgaagttagccaccaaaaaacaaaagtcgatgaagatcatcctcgacagacttatgaaccagacctactccaaaggggcctgcatgattcacaagtacaagaacaagtggtatcttagtattacttacaagttcaacgctattaaggaaaacaaattcgacaaagacttgataatgggaattgacatgggcggtatcaacaccgtgtacttcgccttcaacgaggggttcatccgatccaacatcaagtcggacgagattaaggcgttcaacgagcgcataagacaaaggaggatcaacttgctcaagcagtccaagtactgttcgaactcccgcaccggcaagggccgcgagaagcgtcttcagcctattgacgtcctgagcaacaagatagccaaattccgtaatagcacaaaccacaagtacgccaactacatcatcaagcagtgtcttaagcacaactgtggccggattcagatggaattgctcaaagggatcagcaagaacgacaaggtgctgaaagattggacctacttcgatctacaggagaagattcagaaccaggccgagatacacggcattgaggttatcaaggtcgccccagcctacaccagtcaaaggtgctcccagtgcggctacatctgtaaggaaaaccgttgtacccaggctgtcttcgagtgcaagcaatgtggctacaagactcacgcggactacaacgctgccaagaacattgctacttacgatattgagaacattatcaataagcaattggccgtccagagtaaactgcattccaagaagtgtatggaggagtatatcgaggagcttggatacctggactga

SEQ ID NO: 2870 - DNA, 1356 bp, Unknown
  Bacillus sp. multi
ttgggcgtgacgattaagatcatgaagtaccagatcctttgcccgatgaacgtggactggaccatcttcgagaagcaccttcgcaatctcacttaccaagtacggactatcagtaatcgcaccatccagcagttgtgggagtttgacgccctgtcattcgaatactttaaagagcggggcacctaccctaccgtacaagacctctacggatgcactcagaagaagatagacgggtatatctatcacaccctccagagcaagtacccggacatccacaaaggcaatatgagtacgacccttcagaagattatcaagacttggaaatccagacgcaacgagatccgaaaaggagagatgtctatcccctccttccgaaaccgtattccaatcgacctgcacaacaactccgttgacattatcaaggaaaaaaacggagactacatcgctggtatctctctgttctctcgtgacttccacaaggagaacggagacgtgcctaagggcaagatattcgtaaagctcgctacccagaagcagaagtctatgaaggtgatcctcgaccggctcattaaccagacctacagtaagggcgcgtgcatgattcacaagtacaagaacaagtggtatctgtccattacctacaagttcaatgccatcaaggagaacaagttcgacaaggagcttatcatggggattgacatgggtggtattaacacagtgtacttcgcattcaatgaggggttcattcgctccaacatcaagtccgatgagatcaagatgttcaacgaaaggatcaggcagaggcgcatcaaccttctaaagcagtccaaatactgttcgaactcccgtaccgggaagggccgtactaaacgcctccagcctattgacgttctgtccaataagatagccaagttccgcaacagcacgaaccacaagtacgcgaattacatcgtcaagcagtgcctcaagcacaactgcggacgcatacagatggaactcctcaagggtatttccaagaacgacaagatccttaaagattggacctactttgacctacaggaaaaaatcaagaatcaggcggagatccacggaattgaagttattaaggtggtgcccgcttacaccagtcagcgatgtagccagtgcgggtatatctgcaaggagaaccggtgcacccaggccaccttcgagtgtaagcagtgcggctacaagacacacgccgactacaacgctgccaagaacctgtccacctacgacatcgagaacattatcaacaaacagcttgccgtgcagagcaagttgcacagcaaaaagtgtatggaggagtacatcgaggagttgggctacctggattga

SEQ ID NO: 2871 - DNA, 1356 bp, Unknown
  Bacillus sp. multi
ctgggcgtaaccatcaagatcatgaagtaccagatcctctgcccgatgaacgtggactggaccatattcgagaagcacctgaggaacctcacttatcaagttcggaccatctcgaaccgcaccattcagcaattgtgggagttcgacgccctcagctttgaatacttcaaggagcgcggaacctaccccactgtccaggacttgtacggctgcacgcaaaaaaagatcgacggctacatctaccacacccttcagtccaagtacccagacatacacaagggaaacatgagcacaacgttgcagaaaatcatcaagacctggaaatcgagacggaacgagatccgtaagggagaaatgtccatcccgagctttcgcaaccgcatccctatcgacctccacaacaacagcgtggacatcatcaaggagaagaacggcgattacatcgccggtatttccctgttcagtagggacttccacaaggagaacggcgacgtgcctaagggcaagatattcgtaaaactcgctacccagaagcagaagtctatgaaggttatccttgacaggcttattaaccagacctacagcaaaggtgcgtgcatgattcacaagtacaagaataagtggtacttgtctatcacctacaagttcaatgctatcaaggagaacaaattcgataaggagctgattatggggatcgacatgggcggtatcaacaccgtgtacttcgccttcaacgaggggttcattcgaagcaacattaagtcggacgagattaagatgttcaacgaacgtattagacagcgccgcatcaacctgttgaaacaaagcaaatactgctccaacagccgcacaggcaaaggccgcaccaagcggttgcagcctatcgacgtgctgtccaacaagattgccaaattccgtaactctaccaatcacaagtatgcgaattacattgtgaagcagtgcttaaaacacaactgcgggcgaatccaaatggagcttctaaaggggatcagcaagaacgacaaaatcctgaaagactggacctacttcgatctacaggagaagatcaaaaaccaggcggagattcacggaattgaagttattaaggttgttccagcctacaccagccaacggtgctctcagtgcggctatatctgcaaggaaaatcgctgcacgcaagcaaccttcgaatgcaaacagtgcgggtacaagacccacgcggactacaacgcggccaagaacctttcgacctacgacattgagaacatcatcaacaagcaacttgccgtgcagtccaaactccattccaagaaatgcatggaggagtacatcgaggagctgggctaccttgactag

SEQ ID NO: 2872 - DNA, 1356 bp, Unknown
  Bacillus sp. multi
ctcggcgtgacgatcaagatcatgaagtaccagatcctctgtcccatgaacgtggattggactatcttcgagaagcacctccgcaacctcacctaccaagtcaggaccatctccaacaggactattcaacagctctgggagttcgacgccctttccttcgaatacttcaaggaaagaggcacgtaccccaccgtccaagacctctacggatgcacacaaaaaaagattgacggctacatctaccacactctccagagtaagtaccccgacatccacaagggcaacatgagtaccaccctccagaagatcatcaagacgtggaaatctcgtcggaacgagatccgcaaaggagaaatgtcgatacccagcttccgcaacagaatccccattgacctgcacaacaactcagtggacatcatcaaggagaagaacggagattacatcgctggtatctcgttattctctagggacttccacaaggagaacggcgacgtgccgaagggcaagatattcgtaaaactggcaacccaaaagcaaaagtcgatgaaggtgatactcgacagactcattaaccagacgtacagcaagggtgcttgcatgatccacaagtacaagaacaaatggtacttgtcaatcacgtacaaattcaacgccatcaaggaaaacaaattcgacaaggagctgattatgggaattgatatgggagggattaacacggtttacttcgcgttcaacgagggcttcatacggtccaacatcaagagcgacgagattaagatgttcaacgaacgcatccggcagcggcggattaacctacttaagcagagcaaatactgctccaacagccgaaccggcaaggggaggactaaacgccttcagcccattgatgtcttgagcaacaagattgccaagttccgaaactccacaaaccacaagtatgctaactacatcgtaaagcagtgcttgaagcacaactgcgggaggatacagatggagctgttaaaggggatcagcaagaatgacaaaatcctgaaagactggacctacttcgacctccaggagaagatcaaaaaccaggcagagatacacgggatcgaagtcatcaaggtggtgccagcctacacaagccagagatgcagccagtgcgggtatatctgcaaggagaaccgatgcacgcaagctaccttcgagtgcaagcagtgcggctacaaaacacacgccgactacaacgctgccaagaacctgagcacttacgacatcgagaacatcatcaacaagcagctcgctgtacagtcgaagctccactccaagaaatgcatggaggagtacattgaggagcttggatacttggactag

SEQ ID NO: 2873 - DNA, 1356 bp, Unknown
  Bacillus sp. multi
ctcggggttaccatcaagatcatgaagtaccagatcctctgccccatgaacgtggattggaccatattcgagaagcacctccggaaccttacttaccaagtccgcacaatctcgaacaggacgattcagcagctctgggagttcgacgccctatccttcgaatacttcaaggagcggggaacctaccccaccgtgcaagacctctacggctgcacacagaagaaaatagacgggtacatctaccacactttgcagtccaagtaccccgacatccacaagggcaacatgagcactaccctccaaaaaatcatcaagacatggaaatccaggcggaacgagatcaggaagggcgagatgtccattccttccttccgcaacagaatccccattgacctgcataacaactccgtggacatcatcaaggagaagaacggtgactacattgccgggataagcctattctccagggacttccataaggaaaacggtgacgtgccgaaggggaaaatcttcgtcaagctggccacgcagaagcagaaatctatgaaggtgattctggaccgcttgataaaccagacttactcgaaaggcgcttgcatgatccacaagtacaagaacaagtggtacttgtccattacctacaagttcaacgcgattaaggagaacaaattcgacaaggagctgattatgggaatagacatgggcggcattaacacagtgtacttcgcgttcaacgaggggttcatacggtccaacatcaagtcggacgagattaagatgttcaacgagcgtatccgtcagcgacggataaacctcctgaaacagtccaagtactgctcgaactcaagaaccggaaaagggaggacgaaacgcttgcagcccattgacgttcttagtaacaagattgccaaattccgtaactcgactaatcacaagtacgccaattacatcgtaaagcaatgtcttaagcacaactgcggccgaatccagatggagttgctcaagggaatttccaagaacgacaaaatcctcaaagactggacctacttcgacctccaggagaagatcaaaaaccaggctgagatccacgggatcgaagtgattaaggtggtcccggcatacaccagccaacggtgctctcaatgcgggtatatctgtaaggagaaccgctgcacccaagcaaccttcgagtgcaaacagtgcggttacaagacccacgccgactacaacgcggctaagaacctatccacctacgacatcgagaacatcatcaacaagcagctcgcggtgcaatcgaagttgcactccaaaaaatgcatggaggagtacatcgaggagctgggctacttggactga

SEQ ID NO: 2874 - DNA, 1356 bp, Unknown
  Bacillus sp. multi
ctaggggtgacgatcaagatcatgaagtaccagatcctctgccccatgaacgtggattggaccatattcgagaagcacctccggaaccttacctaccaagtccgcaccatctccaaccgaacgatacagcagctttgggagttcgacgccctctccttcgagtacttcaaagagcgtggcacgtaccctaccgtacaagacctctacggctgcactcagaagaaaatcgacgggtacatctaccacaccctccaaagcaagtaccctgacatccacaagggcaatatgtcaactaccctccagaagatcattaagacctggaaaagtcgtcggaatgagatcaggaaaggagagatgtccatcccctccttccgaaatcgcattcccattgacctccacaacaacagcgtggacatcatcaaggaaaaaaacggggactatatcgccggaatcagtctgttcagtcgggacttccacaaggagaacggcgacgtcccgaagggaaagatattcgtgaaattggccacccagaagcagaaatctatgaaggtgatcctcgaccgtctcatcaaccagacttactcgaagggcgcgtgcatgatccacaagtacaagaacaagtggtatttgagtattacctacaagttcaatgccatcaaggaaaacaaattcgacaaggagttgataatggggatcgacatgggcggcattaacactgtttacttcgccttcaacgaaggcttcatacgcagcaacatcaagtcagacgagattaagatgttcaacgaaaggataaggcaacggcgtatcaacctacttaaacaaagcaaatattgcagtaactctaggacggggaaggggcgtaccaagaggttacagccaattgacgtgctcagtaacaagatcgccaagttccgcaactctactaaccacaagtacgccaactacatcgtgaagcaatgtcttaagcacaactgtggacgaatccagatggagttgctcaagggcataagcaagaacgacaagatccttaaagactggacatacttcgatctacaggagaagatcaaaaaccaggccgagatccacggtatcgaagtcatcaaggtcgtgcccgcctacaccagtcagaggtgcagccagtgcggttacatctgtaaggagaaccgatgcactcaggcgaccttcgaatgcaagcagtgcgggtacaagactcacgccgactacaacgctgccaagaacctctctacctatgacatcgagaacatcatcaacaagcaactggccgtgcaatctaagctacactccaaaaaatgcatggaggagtacattgaggagctgggctaccttgactag

SEQ ID NO: 2875 - DNA, 1335 bp, Unknown
  Bacillus sp. multi
atgaagtaccagatcctctgccctatgaacgtggactggatcatcttcgagaagcacttaaggaacctgacataccaagttagaacgatctcgaaccgtacaatccaacagctctgggagtttgacgccctgtcattcgactacttcaaggcgcgcggcacctaccctactgtccaggacttgtacggcgggactcagaagaagatcgacggctatatctatcacactctccaatccaaataccccgacatccacaagggcaacatgagcaccacccttcagaagattatcaagacctggaaatcgcgccgaaacgagatcaggaagggcgagatgtcgatcccatccttccgaaaccgcattccaatagacatacacaacaatagcgtggacataactaaggaaaaaaatggcgactacatcgcggggatcagtctgttctcgcgcgactttcacaaggagaacggcgacgtgccgaaggggaagatattcgttaagctcgccacccaaaagcagaagtcgatgaaggtgatcttggaccgtctgataaaccagacttactctaaaggcgcgtgcatgatccacaagtacaaaaacaagtggtatctcagtatcacctacaaattcaacgctctcaaggagaacaaattcgacaaggagctgattatgggaattgatatgggtggtattaacaccgtttacttcgctttcaacgagggcttcatcaggaacaacatcaagtccgaggagattaagatgttcaacgagcgcattcgacagaggcgcatcaaccttctcaaacagtccacctattgctctaattctcgcaccgggaagggacggaccaaacgattgcaacccattgacgtcctgagcaataagatcgccaagttccgtaatagtaccaaccacaagtacgctaactacatcatcaagcagtgtctaaagcacaactgcgggcgcatacagatggagctgctaaagggcatctctaagaacgacaagatactcaaagactggacctacttcgacctccaggaaaaaatcaagaatcaggccgagatccacggaatcgaagtcattaaggtcgccccagcatacacctcccagcggtgtagccagtgcgggtacatctgcaaggagaaccgctgcacacaggccatgttcgagtgcaaacagtgcgggtacaagactcacgcagactacaacgcggccaagaatatcgcaacctacgacatcgagaacatcatcaacaagcaactcgcagtgcagtcgaagctccattccaagaaatgcatggaggagtatatcgaggaattgggttacctggactag

SEQ ID NO: 2876 - DNA, 1335 bp, Unknown
  Bacillus sp. multi
atgaagtatcagatactctgccctatgaacgtggactggatcatcttcgagaagcaccttcgcaaccttacctaccaagtgcgaaccatcagcaaccgtacgatccagcaactttgggagttcgacgccctcagtttcgactacttcaaagccaggggaacttaccccaccgtccaagacctctacggaggcactcagaagaagatagacggctatatctaccacaccctgcaatcgaagtaccccgacatccacaaggggaatatgagtacaaccctccagaagatcatcaagacatggaagtccaggcggaacgagatccgcaaaggcgagatgtctatcccatccttccgaaacagaatacctatcgacatccacaacaactccgttgatattactaaggaaaaaaatggcgactacatcgccgggatctcgctgttcagccgcgatttccataaggagaacggcgacgtcccaaagggaaagatattcgtcaagctggcgactcagaagcagaagtctatgaaggtgatcttggaccggctgattaaccagacctacagcaagggagcgtgcatgattcacaagtacaagaacaagtggtacttgagcatcacctacaagttcaatgccttgaaggaaaacaagttcgacaaggagctaatcatggggatagacatgggcgggataaacaccgtgtacttcgctttcaacgagggcttcatccggaacaacattaagagcgaggagatcaagatgtttaacgagcggattcgccagcgaaggatcaacttgctaaagcagtcaacctactgctcaaacagccgcaccggcaagggtcggaccaaacgcttgcaacctatcgacgtcctctcaaacaagatcgccaagttccgcaacagtaccaatcacaagtacgccaactacatcattaagcagtgccttaagcacaactgtggacgaatccaaatggagctacttaaagggattagcaagaatgataagatcctcaaggactggacgtacttcgatctacaggagaagatcaaaaaccaggcagagatccacggtatcgaagtcatcaaggtggctcctgcctacacatcccagagatgctcgcagtgcgggtatatctgtaaggagaaccggtgcacacaggcaatgttcgagtgcaagcagtgcgggtacaagacacatgcagactacaatgccgccaagaatatcgccacgtacgatattgagaacatcatcaacaaacagttggccgtgcagtctaagttgcattccaagaagtgtatggaggagtacatcgaggagttgggttacctggattga

SEQ ID NO: 2877 - DNA, 1335 bp, Unknown
  Bacillus sp. multi
atgaagtaccagatcctctgccctatgaacgtggactggatcatcttcgagaaacacctacgcaaccttacctaccaagtcaggaccatcagtaacaggactattcagcagctttgggagttcgacgctctgtctttcgactacttcaaggcccgtggcacatatccaacagtacaggatctgtacggcggcacccagaagaagattgacgggtacatctaccacaccctccagtcaaagtacccagacatccacaaggggaatatgtcaactaccctccagaagatcatcaagacttggaaatctcgtcgtaacgagatccgcaagggcgagatgtctataccgtccttccggaacagaatcccaattgacattcacaacaatagcgtggacatcactaaggaaaaaaatggcgactacatcgccggtatctcgttgttctcacgcgacttccacaaggagaatggcgacgtgcctaagggcaagatattcgtcaaactcgctactcagaagcagaagtccatgaaggtgatcctggacagacttatcaatcagacctactcgaaaggtgcctgcatgatccacaagtacaagaacaagtggtatctctcgatcacttacaagttcaacgcgcttaaggagaacaagttcgacaaggaactgattatgggaatcgacatgggcgggataaacaccgtgtactttgcgttcaacgaggggttcatccgtaacaacatcaagtccgaggagatcaagatgttcaacgagcgcataagacagaggcgcatcaacctgctcaaacagtccacctattgcagtaatagtagaaccggcaagggtcgcacaaagaggttgcagcctattgacgtgctcagcaacaagatagccaagttccgtaactcaacaaaccacaagtacgcgaactacatcatcaagcagtgcctgaaacacaactgcggacggatacaaatggagttacttaagggcatcagcaagaacgacaagatattgaaggactggacatacttcgacctccaggagaagatcaaaaaccaggccgagatccacggcatcgaggttatcaaggtcgctccggcttacacctcccaaaggtgctcacagtgcgggtacatctgcaaggagaatcgctgcactcaggctatgttcgagtgcaagcaatgcgggtacaagacccacgcggactacaacgcagccaagaacatcgccacctacgacatcgagaacattatcaataagcaacttgccgttcagtccaagctccactccaaaaagtgtatggaggagtacattgaggaattgggctacttagactga

SEQ ID NO: 2878 - DNA, 1335 bp, Unknown
  Bacillus sp. multi
atgaagtaccagatcctctgccccatgaacgtggactggatcatcttcgagaaacaccttcgcaacctcacgtaccaagtgcggaccatctccaaccgcaccatccagcaattgtgggagttcgacgccctatcattcgactacttcaaggctaggggcacgtacccgaccgttcaagacctttacggcggcacacaaaaaaaaatcgacggctacatctaccacacgcttcagagcaagtatcccgacattcacaagggaaacatgagcaccacgctccagaagatcattaagacttggaaatcacggcggaacgaaatacgaaaaggcgagatgtcgatcccttcgttcagaaaccgaatacccattgacattcacaacaacagtgttgacattacgaaggagaagaacggggactacatcgctggaatatcgctcttcagtcgggacttccacaaggagaacggcgacgtgccgaaaggaaagatattcgtcaaactggcaacccagaaacagaaatccatgaaggtcatcctggacaggctcattaaccagacttacagcaaaggtgcctgcatgatccacaagtacaagaacaagtggtatctctccattacttacaagttcaatgcacttaaggaaaacaagttcgacaaggagcttatcatggggatcgacatgggcggtattaacaccgtgtactttgcattcaacgagggcttcatacgcaacaacatcaagagcgaggagatcaagatgttcaacgaacgaatccggcagagacgtatcaacctcctaaagcagagcacctattgcagtaattcacggacaggcaaggggcgcactaagcgcttgcaacctatcgacgtgctctcgaacaagatagcgaaattccgtaactctactaaccacaagtacgctaactatatcatcaagcagtgcctcaagcacaactgcggtagaatccaaatggagctgctcaagggcatcagtaagaatgacaagatactcaaggactggacttacttcgatctccaggagaagatcaaaaaccaggccgagattcacgggatcgaggttattaaggtggccccggcctataccagccagcgttgctcccaatgcggttacatctgcaaggaaaaccggtgcacccaagccatgttcgaatgcaagcaatgcggctacaagacccacgctgactacaacgccgccaagaatatcgctacctacgacattgagaacatcatcaacaagcaattggccgttcagtcaaagttgcacagcaaaaagtgtatggaggagtacatcgaggaacttggctacctcgactga

SEQ ID NO: 2879 - DNA, 1335 bp, Unknown
  Bacillus sp. multi
atgaagtaccagatcctctgccccatgaacgtggattggattatcttcgagaaacaccttcggaacctcacgtaccaagtccgaacgatttccaatcggacgatccagcaactttgggagttcgacgccttatcctttgactacttcaaggccaggggaacctacccgaccgtccaagacctttacggtggcacgcagaagaagatcgacggctacatctatcataccctccagtccaagtacccggacatacacaaggggaatatgtccacaacgctacagaaaatcatcaagacctggaagtctcggcgcaacgagatcaggaagggtgagatgtccatcccttcgtttcgcaaccgcattcctatcgacatacacaacaactccgttgacattactaaggaaaaaaacggggactacatcgcgggtatcagcctcttcagcagagatttccacaaggagaatggggacgtgccgaaggggaaaatcttcgtaaagttggctacccagaagcagaagtccatgaaggtgatccttgaccggctcattaaccagacgtactctaagggtgcctgcatgatccacaagtacaagaataagtggtacttgtcaatcacatacaaattcaacgcgcttaaggaaaacaagttcgataaggagctgattatggggattgatatgggagggattaacacagtgtactttgccttcaacgagggcttcatacggaacaacatcaagagtgaggagatcaagatgttcaacgaacgcatccggcagcggaggatcaacctcctcaagcagtcaacatattgctccaactcccgtaccgggaagggccgcaccaagcgtcttcagccgattgacgttcttagtaacaagattgccaagttcagaaacagcacgaaccacaagtacgcgaactacatcatcaagcaatgtctaaagcacaactgcggacggatacagatggagttgctcaagggcatcagcaagaacgacaagattctcaaagactggacttacttcgacttacaggaaaaaatcaagaatcaggccgagatccacggcatcgaggtcatcaaggtcgcgcctgcttacacctcgcagaggtgctcacaatgcgggtatatctgtaaggagaaccgttgcacccaggccatgttcgagtgcaagcagtgcggctacaagacgcacgctgactacaacgcagccaagaatatcgcaacctacgacattgagaacatcatcaacaaacaactggcggtgcagtcgaaactccactccaagaagtgtatggaggagtacatcgaggagttgggttacctggactga

SEQ ID NO: 2880 - DNA, 1335 bp, Unknown
  Bacillus sp. multi
atgaagtatcagatcctatgccccatgaacgttgactggaccatcttcgagaaacaccttcgcaacctcacgtaccaagttcgaacaatctccaaccgcacgatccagcagctctgggagttcgatgcgctgtcgttcgactacttcaaggcgcgagggacgtacccgaccgtccaagacctatatggctgtactcagaagaaaatagacgggtatatctatcacaccttgcagagcaagtacccggacatccacaagggcaatatgagcaccacgcttcagaagatcatcaagacttggaaatcacggcgcaacgagatccgcaagggcgagatgagcatccctagtttccggaaccgtattcctatagacttgcacaacaactctgtggacatcactaaggaaaaaaacggcgactacattgctgggatctcccttttcagccgggacttccacaaggaaaatgacgacgtgccaaagggcaagatattcgttaagctcgctaccaaaaagcagaagtccatgaagataattctggacaggctcatgaaccagacatactcgaagggagcctgcatgattcacaagtacaagaacaagtggtatctaagtatcacctacaaattcaacgcgatcaaggagaacaaattcgacaaggagctgattatgggcatcgacatgggcgggatcaacacaatctacttcgcattcaacgaagggttcatccgttccaacatcaagagcgacgagatcaagacgttcaacgaacgcatccgtcagcgtcgtatcaatttgcttaatcagagcaagtattgctccaactctaggacggggaaggggcgcactaagcgactacaacccatcgacgtgctgtccaacaagatcgctaagttccgcaattccacaaaccacaagtacgcaaactacatcatcaagcagtgcctaaaacacaactgcggtcgtatccagatggagctgctcaagggtatctccaagaacgacaaggtgctcaaggactggacgtacttcgacctacaggagaagatcaaaaaccaggccgagatacacggcatcgaggtcatcaagatagccccagcatacaccagccagaggtgctcccagtgcggctatatctgtaaggagaatcgctgcacacaggatatgttcgaatgcaagcagtgcggttacaagacccacgcggactacaacgctgccaagaatatcagcacgtacgggatcgagaacattatcaataagcagttggcagtacagtcgaaattgcatagcaaaaagtgtatggaggagtacatcgagaaactcggctacctggactag

SEQ ID NO: 2881 - DNA, 1335 bp, Unknown
  Bacillus sp. multi
atgaagtaccaaatcctctgccctatgaacgtggactggacgatcttcgagaagcacttgagaaacttaacctaccaagtgaggacgatctccaacaggaccatccagcagctctgggagttcgacgcgctgtccttcgactacttcaaggcccgtggcacctatcccacagtccaggatctatacggttgtacgcagaagaaaatcgacggctacatctaccacaccctacagtctaagtatcccgacatccacaagggcaatatgagcacgacgcttcaaaaaatcatcaagacatggaaatcacgccgtaacgaaatcaggaagggcgagatgtctataccgtcgttccgcaaccgcatccctattgaccttcacaacaatagcgttgacataactaaggagaagaatggggactacattgcggggatctcactgtttagtagggacttccacaaggagaacgacgacgtgcctaaggggaaaatcttcgtaaaactcgccaccaaaaaacagaagtccatgaagatcatacttgaccgacttatgaaccagacctactcaaagggagcttgcatgatccacaagtacaagaacaagtggtatttgagcattacctacaagttcaatgcgatcaaggagaacaaattcgataaggagctgataatggggattgacatgggcggcatcaacaccatctatttcgcctttaacgaggggttcatccgctcaaacattaagtccgacgagatcaagaccttcaacgagcggataagacaacggaggatcaacctcctcaaccagagcaaatactgctccaactcccgtaccgggaagggccggaccaagcggctccagcctatagacgtcctctcgaacaagatcgccaagttcagaaacagcaccaaccacaaatacgcaaactacatcattaagcagtgccttaagcacaactgcggacgtattcaaatggagctgttgaaggggatcagtaagaacgacaaggtgctcaaagactggacctacttcgacctccaggaaaaaatcaagaaccaggccgagatccacggaatcgaagtcatcaagatcgcacccgcatatacttcccagagatgtagtcaatgcgggtacatctgcaaggagaaccgctgcacacaagatatgttcgaatgcaagcagtgcggctacaagacacacgcggactacaacgcagccaagaacataagtacctacggcattgagaacattatcaacaagcagctcgccgtgcagtccaaattgcactccaagaaatgcatggaggagtacatcgagaagctcggttacctggactag

SEQ ID NO: 2882 - DNA, 1335 bp, Unknown
  Bacillus sp. multi
atgaagtaccagatcctatgcccgatgaacgtggattggaccatcttcgagaagcacctccgaaacctgacctaccaagttcgtacgatcagcaatcggacaatccagcagctctgggagttcgacgccctgagcttcgactacttcaaagctaggggcacctatccgactgtccaagacctatatggctgcacccagaagaaaatcgacgggtacatctaccacaccctccagagcaagtacccggacatccacaaggggaacatgagtaccaccttgcagaagattatcaagacctggaaatcccgccggaacgaaattcgtaagggagagatgagtattccatccttccgtaaccgcatccctattgatctgcacaacaactccgttgacatcactaaggagaagaacggcgactacatcgccgggatctcgttgttcagccgcgacttccacaaggaaaacgacgacgtgccgaagggcaaaatcttcgtcaaactggccaccaaaaagcagaagtctatgaagatcatcctagaccgtctcatgaaccagacatactctaaaggggcctgcatgatccacaagtacaagaacaaatggtatcttagtatcacgtacaagttcaatgccatcaaggagaacaagttcgacaaggagcttatcatggggatagacatgggcgggatcaacacgatatactttgccttcaatgaggggttcatacggtccaacatcaagtccgatgagatcaagacgttcaacgaacgaatacggcagaggcggattaacctcctgaaccagagcaagtactgttcaaattctcgtacgggcaaggggcgcaccaagaggctccagccgattgacgtcctttccaacaagatcgccaaattccgtaacagcaccaaccacaagtatgctaactacattatcaagcagtgcctaaaacacaactgcgggcgcatacaaatggagcttctcaaggggatctccaagaacgataaggtgctcaaggactggacttacttcgacctacaggagaagatcaaaaaccaggcggagattcacgggatcgaggttattaagatagccccggcatatacttctcagaggtgctcccagtgcggctacatctgcaaggagaaccgctgcactcaggatatgttcgagtgcaagcagtgcggctacaagacccacgctgactacaatgcggccaagaatatcagtacctacggcattgagaacatcatcaacaagcagctcgcggtgcagagcaaactccacagcaagaagtgtatggaggagtacatcgagaaactgggctacttagactga

SEQ ID NO: 2883 - DNA, 1335 bp, Unknown
  Bacillus sp. multi
atgaagtatcagatactgtgtccgatgaacgtggactggacgatattcgaaaagcacttgcggaacctcacctaccaagttcgaacaatatccaacagaacgattcagcagctctgggagttcgatgccctgtcgttcgattacttcaaggcacgaggcacataccccacggtacaagacctgtacggctgcacccagaagaagattgacggctacatctaccacacgctccagtcgaagtaccccgacatacacaaggggaacatgagcaccacgttgcaaaaaatcattaagacttggaaaagtcgaaggaacgagatccgcaagggcgagatgtctattccgtcgttccggaatcgcatccctatcgacttgcacaacaacagtgtggacatcacgaaggaaaaaaacggggactatatcgctgggatctctctgttcagtagggacttccataaggagaacgacgacgtgccaaaaggcaagatattcgttaagctcgccaccaagaagcagaagtcgatgaagatcatcctcgaccgtctgatgaaccagacctactctaagggagcctgcatgatacacaagtacaagaacaagtggtatctgtcaattacctacaagttcaacgccattaaggagaacaaattcgacaaggaactgattatggggatcgacatgggtgggattaacactatctatttcgcgttcaacgagggcttcatccggtcgaacatcaagagcgacgagatcaagaccttcaacgagcgaatccggcagcggaggatcaatctcctgaaccagtccaaatattgttccaatagtcgcaccgggaagggtcgaactaagcgtctgcaacctatcgacgtgctgagtaacaagatcgccaaattccgtaacagcactaaccacaagtacgccaactacatcattaagcagtgcctaaaacacaactgcgggcgcatccagatggagctgttgaagggtatctccaagaatgataaggtgttgaaggactggacctacttcgatctccaggaaaaaatcaagaatcaggccgagatccacggcattgaggtcattaagatcgccccagcttacacaagtcagaggtgcagccagtgcgggtacatctgtaaggaaaaccgttgtacccaggatatgttcgagtgcaagcagtgcggctacaagacccacgctgactacaatgcagccaagaacatctccacctacggtattgagaacatcatcaacaagcagttggccgtccagtctaagctccacagcaaaaagtgtatggaggagtacatcgagaagctcggctatttggactag

SEQ ID NO: 2884 - DNA, 1335 bp, Unknown
  Bacillus sp. multi
atgaagtatcagatcctatgcccgatgaacgtggattggaccatcttcgagaagcacctccggaacctgacctaccaagtacgcactatttcaaaccgcaccattcagcagctctgggagttcgacgcgctttccttcgactacttcaaggccaggggcacatacccgaccgtacaagacctctatggatgcacccagaagaaaatcgacggctacatctaccacaccctccagagtaagtacccggacatacacaaggggaatatgtcaacgaccttgcagaagattattaagacctggaaatctcgtcgcaacgagatcaggaagggcgagatgtccataccctcattccgcaatcgcatcccaattgacctccacaacaactccgtggacatcactaaggagaagaatggcgactacatcgcgggtatctcgcttttcagccgcgacttccacaaggaaaacgacgatgtgccgaaggggaaaatcttcgttaagctggccaccaaaaagcagaaatctatgaagatcatcttggacaggctcatgaaccagacctactcgaagggcgcgtgcatgatacacaagtacaagaataagtggtacttatcaatcacttacaaattcaacgcgatcaaggagaacaaattcgacaaggagttgataatgggcatcgacatgggtggcattaacactatctactttgccttcaacgagggcttcattcggagcaacatcaagtcagacgagatcaagaccttcaacgagcgtatcaggcagcgccgcatcaaccttctcaaccagagcaagtattgttccaactctaggaccggcaagggccgcactaagaggttgcagcccattgacgtgctctcgaacaagatcgccaagttcagaaactctaccaatcataagtacgcaaactatatcattaagcagtgcttgaagcacaactgcgggcgcatccaaatggaattgctcaagggcatctctaagaacgacaaggtgcttaaggactggacctacttcgacctacaggagaagatcaaaaaccaggcagagatacacgggattgaggtcatcaagatcgctcccgcctacaccagccagcggtgctctcagtgcggctacatctgcaaggagaaccgatgcacccaggatatgttcgaatgcaagcagtgcggatacaaaacccacgccgactacaacgcggccaagaatatctcgacctacgggatcgagaacattatcaacaagcagcttgctgttcaaagcaagctccacagcaagaagtgtatggaggagtatatcgagaagctcggataccttgactag

SEQ ID NO: 2885 - DNA, 1356 bp, Unknown
  Bacillus sp. multi
ctcggggtgaccatcaagattatgaagtaccagatactctgccccatgaacgtcgattggaccatcttcgagaagcacctcaggaacttgacctatcaagttcgcaccatctccaacaggaccatccaacaattgtgggagtttgacgcgctgtctttcgactacttcaaggcgcgcggaacctaccccaccgtacaagacctttatggctgcactcaaaaaaagatcgacgggtacatctaccacactctccagagcaagtaccccgacattcacaagggcaatatgtccacaaccctccagaagatcattaagacttggaaatcgcgtcgaaacgagatccgcaagggagagatgagtatcccgtcgtttcgtaaccggattccaattgacttgcacaacaactctgtggaaattactaaggagaagaatggcgactacatcgccgggatctcgctattctcccgcgacttccacaaggagaatggcgacgtgcctaagggcaaaatcttcctcaaactgggcacgcaaaagcagaagtctatgaaggtcatcctagaccggctgattaaccagacttactctaagggagcgtgcatgatacacaagtacaagaacaagtggtatctctcgatcacttacaaattcaacgctatcaaggaaaacaaattcgacaaggagcttatcatggggatagacatgggcggcatcaacacggtgtacttcgccttcaatgagggcttcataaggagtaacatcaagagcgacgagattaaggcgttcaacgagaaaatccgccagcggaggataaacctcttgaagcagagcaactactgctcaaattccaggaccggaaaggggcgggcaaaacggctccagcccattgacgtactttccaacaagatcgccaaattccgtaacagtacaaatcacaagtacgccaactatatcattaagcagtgcctcaagcacaactgcgggcggattcagattgaattacttaagggtattagcaagaatgacaaggtgcttaaggactggacctacttcgacctacaggagaagatcaaaaaccaggcggagatccacggaatcgaggttattaaggttgccccagcctacacctctcagagatgctcgcagtgcgggtacatctgtaaggagaaccgatgcacccaggcaatgttcgagtgcaagcagtgcggttacaagacccacgctgactacaacgccgccaagaacataagcacgtacgacatcgagaacatcatcaacaagcagttggctgttcaatccaagctccactccaaaaaatgcatggaggagtacatcgaggaactaggctacctcgactag

SEQ ID NO: 2886 - DNA, 1356 bp, Unknown
  Bacillus sp. multi
ctgggagtgaccatcaagattatgaagtaccagattctgtgcccgatgaacgtggactggaccatcttcgagaagcacctccgcaacctcacgtaccaagtacggaccatctcgaaccgcaccatccagcagctctgggagttcgacgccctctccttcgactactttaaggcgcggggcacctaccctaccgtccaggacttgtacggctgtacccagaagaagattgacgggtacatctaccacactctccaatccaagtaccccgacatccacaagggcaatatgtccacaaccctccaaaaaatcatcaagacttggaagtcacggaggaacgagatcaggaaaggagaaatgtctatcccctcctttcggaatcggattcccattgacctacacaacaactcggtggagatcactaaggaaaaaaatggggactacattgccgggatctcactattcagccgggatttccataaggaaaacggcgacgtgcctaagggcaaaatcttcctgaaactcggaacccagaagcagaagtcgatgaaggtcatcctcgatagactgataaaccagacttactcaaaaggagcgtgcatgatccacaagtacaagaacaagtggtacttgagcataacctacaaattcaacgcgatcaaggagaacaaattcgacaaggagcttatcatggggatcgacatgggtggtatcaacacggtttactttgcattcaacgagggcttcatacgttcgaacatcaagagcgacgagatcaaggcgttcaacgagaaaatccgacagaggcgcattaacctcctcaagcagagcaactactgctcaaatagtaggacggggaagggtcgagccaagcgccttcaacccatcgacgttctcagcaacaagatagccaagttccgcaacagcactaaccacaagtacgccaactacatcattaagcagtgcctcaagcacaactgcggtagaatccaaatcgaactactcaagggtatttccaagaatgacaaggttctcaaggactggacgtacttcgatctccaggagaagatcaaaaaccaggcagagatccacgggatcgaggttattaaggtggcccctgcctacacgagccagcgttgctcgcagtgcggctacatctgtaaggagaaccgctgtactcaagccatgttcgagtgtaagcagtgcgggtacaagacacacgccgactacaacgcagccaagaacatctccacttatgacatcgaaaacattatcaacaagcagcttgccgtgcagagcaagttgcactccaaaaagtgtatggaggagtacatcgaggagttgggctacctcgactga

SEQ ID NO: 2887 - DNA, 1356 bp, Unknown
  Bacillus sp. multi
cttggggtgaccattaagatcatgaagtaccagatcctatgcccgatgaacgtggactggacgatcttcgagaagcacctccgcaatctcacctatcaagtccgcacaatctccaatcgcacaatccagcagctctgggagttcgatgcactgtcattcgactacttcaaagcgcgtggcacctaccccaccgtacaagacctctatggctgtacgcagaagaagatagacggctatatctaccacactctccagtctaagtaccccgatattcacaagggaaacatgagtaccaccttgcagaagattatcaagacatggaaaagtcgtcggaacgagatacgcaaaggggaaatgtctatcccctccttccgcaaccgaatcccaatcgacttgcacaacaactccgtggagattactaaggagaagaacggggactatatcgccggaatctccctgttctccagggacttccacaaggaaaacggggacgtgccgaagggcaagatattcctcaagctcggcacccagaaacagaagtctatgaaggtgatcttagaccggcttatcaatcagacctactcgaagggcgcgtgcatgatccacaagtacaaaaacaaatggtatctcagcataacgtacaagttcaacgccatcaaggagaacaaattcgacaaggaactcattatggggatcgacatgggtggtatcaacactgtgtacttcgcattcaacgagggcttcatcagaagtaacattaagtccgacgagatcaaggcgttcaacgagaaaatccggcagaggcgcatcaatctattgaagcagagcaactactgctccaactcacgaaccggaaagggccgcgctaagaggctccagccaattgacgtcctcagcaacaagatcgccaagttccgcaactcgacaaaccataagtacgcgaactacatcatcaagcagtgcttaaagcacaactgtgggcgaatccagattgaactcctcaagggtatatctaagaacgacaaggttctaaaggactggacctacttcgacctacaggaaaaaatcaagaatcaggccgagatacacggaattgaggttatcaaggtggcccctgcatacactagccagcggtgctcccagtgcgggtacatctgcaaggaaaatcgttgcacccaggccatgttcgagtgcaagcagtgcgggtacaagacccacgctgactacaatgctgccaagaacataagcacgtacgacatcgagaacatcatcaacaagcagctcgccgtccagagcaagctccactccaaaaaatgcatggaggagtacatcgaggaactgggctaccttgactga

SEQ ID NO: 2888 - DNA, 1356 bp, Unknown
  Bacillus sp. multi
ctgggtgtgacgatcaagatcatgaagtaccagatcctttgccccatgaacgttgactggaccatattcgagaaacaccttcggaatctcacctaccaagtccgaaccatctcgaaccgcaccatccagcagctctgggagttcgacgcgctctccttcgattacttcaaagcgcgaggcacatatcccactgtccaagacctgtacgggtgcacgcagaagaaaatcgacgggtacatctaccacaccctccagtccaagtaccccgacatccacaaagggaatatgagtaccacgcttcaaaaaatcatcaagacatggaaatctcggcgcaacgagatccgtaaaggcgagatgagtatcccttccttccggaaccgcatcccaattgacctccacaataactcggtggagatcacaaaggagaagaatggagactacatcgcggggatctctctattcagtcgagacttccacaaggagaacggggacgtgcctaaaggcaaaatcttccttaagctcggaacacagaagcagaagtccatgaaggtcatcctcgaccggcttattaaccagacatacagcaaaggggcgtgcatgatccacaagtacaagaacaaatggtacttgtcaattacctacaagttcaatgcgattaaggagaacaagttcgataaggagcttatcatgggaatagacatgggagggatcaacactgtgtacttcgctttcaacgaggggttcattcgttccaacatcaagtctgacgagattaaggcgttcaacgagaaaatcagacagcggcggataaacctgctcaagcagtccaactattgcagtaacagcagaactgggaaggggcgcgctaagcgtctccaaccgatagacgtgctcagcaacaagattgctaagttccgaaatagcacaaaccataagtatgcgaactacatcatcaagcagtgccttaagcacaactgcgggcggatacagattgagttgctaaaggggatctccaagaacgataaggtgctcaaagactggacatacttcgacctacaggaaaaaatcaagaatcaggccgagatacacggaattgaggtgattaaggtggctccagcctacacctcacagcggtgctcccagtgcggctacatctgtaaggaaaaccgctgcacccaagcaatgttcgagtgcaagcagtgcggctacaagacccatgcggactacaacgcggccaagaacatctcaacatacgacatcgagaacatcattaacaagcagcttgctgtgcagtccaagctccactccaaaaagtgtatggaggagtacattgaggagctgggctacctggattga

SEQ ID NO: 2889 - DNA, 1356 bp, Unknown
  Bacillus sp. multi
ctgggtgtcaccattaagattatgaagtaccagatcctctgcccgatgaacgtggattggacgatcttcgagaaacacctcaggaaccttacctaccaagtcagaaccatcagtaaccggaccatccagcaactctgggagttcgacgccctcagcttcgactacttcaaggcacgtggcacgtaccccacggtccaagacctctacggctgcactcagaagaaaatcgacggctacatctaccacaccttgcaatccaagtaccctgacattcacaaggggaatatgtccactactttgcagaagatcattaagacttggaagtcccgtcgtaacgagatccgaaagggtgaaatgagcatcccctccttccgaaatcgcatcccaatcgacctccacaacaattccgttgagatcacgaaggaaaaaaatggcgactacattgccgggatctcgctgtttagccgagatttccacaaggaaaacggtgacgtgcccaaaggcaagatattcttgaaactcggcactcagaagcagaagtcgatgaaggtgatcctggacaggcttatcaatcagacttactcaaaaggggcgtgcatgatccacaagtacaagaataagtggtatctcagcatcacgtacaagttcaacgccatcaaggagaacaagttcgacaaggagctgattatggggatcgacatgggtgggattaacaccgtgtactttgctttcaacgagggcttcatccgcagcaatatcaagtcggatgagatcaaggcgttcaacgaaaaaatccgtcaacgccgcatcaacctgcttaaacaatccaactactgctccaacagccgcaccggcaagggacgagcgaagcgattgcagcctatagacgttcttagcaacaagatagccaaattccgcaatagcacgaaccacaagtatgccaactacatcatcaagcagtgcttgaaacacaactgcgggcgtatccaaatcgagttactcaaggggataagcaagaatgacaaggttctcaaagactggacctacttcgacctacaggagaagatcaaaaatcaggccgagattcacggaatcgaggtcattaaggtggctcccgcctacaccagtcaacgatgctctcaatgcggttacatctgtaaggagaaccgatgcacacaggccatgttcgagtgtaagcagtgcgggtacaaaacgcacgcagactacaacgccgccaagaacataagcacctacgacattgagaacatcattaacaagcagcttgcagtccagtcaaagctgcactccaagaaatgcatggaggagtacatcgaggagcttggctaccttgactga

SEQ ID NO: 2890 - DNA, 1338 bp, Unknown
  Bacillus sp. multi
ctcggcgtgacgatcaagatcatgaagtaccaaatactctgtccgttgaacgtggattggacgatcttcgagaagcaccttcgcaacctcacctaccaagtgcgtactatctcgaaccgaaccattcaacagttgtgggagttcgacgcgctgtcattcgactatttcaaggaacgcggaacatacccaaccgtgcaagacctgtacggttgcacgcaaaaaaagatcgacgggtacatctaccacacgcttcagagtaagtatccagacatccacaagggcaatatgagcactacactccagaagattatcaagacatggaaatcccgacggaacgagatcaggaagggcgagatgagcatcccttccttccgcaaccgcatccctattgacctccacaacaactctgtggacattactaaggagaagaatggagactacatcgccgggatctcgctcttcagtagagacttccataaggagaacgacgacgtgcctaagggcaaaatcttcgtgaaactcgctacccagaagcagaagtccatgaaggtgatcttggaccgccttatcaatcagacctacagtaaaggagcgtgcatgatccacaagtacaagaataagtggtatctgtccattacctacaagttcaacgcgattaaggagaacaaattcgacaaagagcttatcatggggattgatctcggcggtattaacactgtttactttgccttcaacgaggggttcatccggagcaacatcaagtcagacgagattatccgccagagacgcatcaacctcctcaagcaatccaagtattgttcaaactcacgtacaggaaagggccgtacgaagcgtctccagccaatcgacgtgctgagtaacaagattgcaaagttcagaaactccactaaccacaagtatgccaactacatcgtgaagcagtgcctcaaacacaactgtggtcggatacagatggagttgctcaaggggataagcaagaacgacagaatcctcaaagattggacctactttgacctccaggaaaaaatcaagaatcaggctgaaatccacgggatcgaggtgattaaggtggccccggcttacacctctcagcgttgcagccagtgcgggtatatctgcaaggagaaccgctgcacgcaagccatgttcgagtgcaagcagtgcgggtacaaaacccatgctgactacaacgccgctaagaacatcagcacatacgacatcgagaacatcatcaacaagcagctcgcagtgcaaagcaaactgcacagcaagaagtgtatggaggagtacattgaggaacttggctacctcgactga

SEQ ID NO: 2891 - DNA, 1338 bp, Unknown
  Bacillus sp. multi
ctgggcgttacgatcaagatcatgaagtaccagattctgtgccccttaaacgtggactggaccatcttcgagaagcacttacggaacctcacgtaccaagtgcggacaatctcaaaccgcacgatccaacagctctgggagttcgatgccctctcattcgactatttcaaggagcgcggcacctaccccaccgtccaagacctttacggctgcactcagaagaagatcgacgggtacatctaccacacgctccagtctaagtacccagatattcacaaggggaacatgagcacaaccctccagaagatcatcaagacatggaagtcaagacggaacgagatccgtaagggcgagatgtccatcccctctttccgcaaccgaatccccatcgacctccacaacaactcagtggacatcactaaggaaaaaaatggggactacatcgccggaatctccctgttcagccgagactttcacaaggaaaacgacgacgtgccaaagggcaagatattcgtgaagctggcaacgcagaagcagaagtccatgaaggtcatcttggataggctcatcaaccagacttactcgaagggtgcttgcatgattcacaagtacaagaacaagtggtacttgtctatcacctacaagttcaacgccatcaaggagaacaagttcgacaaggagctgataatgggaattgacctcggtgggattaacacagtgtactttgcattcaacgaggggtttatcaggagcaatatcaagagtgacgagatcatacgccaaagacgcatcaacctcctcaagcagagcaagtactgctcaaattccaggaccgggaagggtaggactaagaggcttcagcccatcgacgtgctgagcaacaagatagcaaagttcagaaactctaccaatcacaagtacgccaactacatcgtgaagcaatgcctcaagcacaactgtgggaggatacaaatggagctgctaaagggcataagcaagaacgacaggatcttaaaggactggacgtactttgacctccaggagaagatcaaaaaccaggccgagattcacgggatcgaggtgattaaggttgccccggcctacacgagccagaggtgctctcagtgtggttacatctgtaaggagaataggtgcacccaggctatgttcgagtgcaagcagtgcggttacaagacccacgcagactacaatgccgccaagaatatcagtacctacgacattgagaacattatcaataagcagcttgctgttcagtctaagctacactccaagaagtgtatggaggagtacattgaggaattggggtatctcgactga

SEQ ID NO: 2892 - DNA, 1338 bp, Unknown
  Bacillus sp. multi
cttggcgtcacgatcaagattatgaagtaccagatcctctgccctctgaacgtggactggacaatcttcgagaaacacctccgcaacctcacgtatcaagttcgtactatctccaaccgtaccattcagcaattgtgggagttcgacgcattatccttcgattacttcaaggaacgcggcacgtaccccaccgtgcaagacctatacggctgtacccagaagaaaatcgacgggtacatctaccacactttgcaatccaagtacccagacatacacaagggcaacatgagcacgaccttgcaaaaaatcatcaagacttggaaatccaggcgcaacgaaatccgtaagggagaaatgagcataccgtctttccggaaccgcatccctattgacctccataacaacagtgtggatattacaaaggagaagaatggggactacatcgccggaatatcgctgtttagccgcgactttcacaaggagaacgacgacgtgccaaagggcaagatattcgtgaagctggcaacgcagaagcagaagtcgatgaaggtgatccttgaccgcctcatcaaccagacctacagcaaaggtgcctgcatgattcacaagtacaagaacaagtggtatctgtccatcacctacaagttcaacgctatcaaggagaacaagttcgacaaggaactaatcatgggaattgacttgggagggatcaacaccgtgtactttgccttcaacgaggggttcattcgctccaacatcaagagtgatgagatcatacgccagcgtcgcattaacttgctgaaacagtccaagtactgctcaaatagccgaacgggcaagggccgcacgaagcgactccagccaatagacgtcctttccaacaagattgctaagttcagaaacagtacgaatcacaagtacgccaactacatcgtgaagcagtgcttgaagcacaactgcgggcgtatccagatggagctgctcaaagggatctccaagaacgaccgaatactcaaggactggacgtacttcgacctccaggaaaaaatcaagaaccaggcagagatccacggaatcgaagttatcaaggtcgcaccggcctacacctcccagcggtgctcacagtgcgggtatatctgtaaggagaatcgttgcacccaggcgatgttcgagtgcaagcagtgcggctacaaaacacacgccgactacaatgctgccaagaacatcagcacgtacgatattgagaatatcatcaacaagcaactcgctgtgcagtcgaagctacacagcaagaagtgtatggaggagtacattgaggaattgggttaccttgactaa

SEQ ID NO: 2893 - DNA, 1338 bp, Unknown
  Bacillus sp. multi
cttggagtgacgatcaagatcatgaagtaccagatcctgtgcccgcttaacgtcgattggacgatattcgagaagcacctccgcaacttgacataccaagttagaactatcagcaacagaaccatccagcagctctgggagttcgacgcactgtccttcgactacttcaaggagcgaggcacctaccctaccgtacaagacctttatggctgcactcaaaaaaagattgacgggtacatctaccacaccctccagagcaagtacccagacatacacaaaggcaacatgagcacgacgcttcagaagattatcaagacttggaaatctaggcgaaacgagatccggaagggagagatgagcattccatcgttccgcaaccgcatacccattgaccttcacaataactccgtggacatcacaaaggagaagaatggggactacatcgcgggcatatccctgtttagtagggacttccacaaggagaacgatgacgtccctaagggcaagatattcgtgaagttggccacccaaaagcagaagtccatgaaggtgatcctggacaggctcatcaaccagacttacagcaagggtgcttgcatgatccacaagtacaagaacaagtggtacttgtccatcacttacaagttcaatgccatcaaggaaaacaagttcgacaaggagctgattatggggatcgacctcggtgggatcaacaccgtgtacttcgcattcaacgagggattcatacggtcgaacatcaagtcagacgagatcataaggcaaaggcgtatcaacctcctcaaacagtccaagtactgtagtaacagccgtaccgggaaaggccgcacaaagcgactccagcccattgatgtgctcagcaacaagattgcgaagttccgtaactcgactaaccacaagtacgcgaactatatcgttaaacagtgcctcaagcacaactgtggccggattcagatggaattgctcaagggcatctctaagaacgaccgcatactcaaggactggacttacttcgatctccaggaaaaaatcaagaaccaggccgagatccacgggatagaggttatcaaggtcgctccggcctacacttcgcagcggtgcagccagtgcggctacatctgtaaggagaatcgctgcactcaagccatgttcgagtgcaagcagtgcgggtacaagacacacgcagactacaatgccgccaagaacatcagcacctacgatattgagaatatcatcaacaagcagttagcagtgcagagcaagctacactccaaaaagtgtatggaggagtacatcgaggagctaggctacctcgattaa

SEQ ID NO: 2894 - DNA, 1338 bp, Unknown
  Bacillus sp. multi
ctgggcgtgaccattaagatcatgaagtaccagatcctctgcccgttaaacgttgactggaccatcttcgagaagcacctacggaacctcacttatcaagttcgaaccatctccaaccgcaccatccagcagctctgggagtttgacgctctgtcgttcgactacttcaaggagcgcggcacctaccccacggttcaagacctatacggctgcacgcagaagaaaatcgacgggtacatctatcacaccctccagagcaagtacccggacatacacaaggggaacatgagcaccacgctccagaagatcattaagacgtggaaaagtcgccgtaacgagattcgcaagggcgagatgtcgatcccatccttccggaaccgtattccaattgacctgcacaacaactccgtggacattactaaggaaaaaaacggggactatatcgctggaatcagcctattcagtagggacttccacaaggagaacgacgacgtgcctaagggcaagatattcgtaaaactcgccactcagaagcagaagtctatgaaggtgatcctggaccgtcttattaaccagacgtacagcaaaggagcttgcatgatccacaagtacaagaacaagtggtatttgagcatcacctacaaattcaacgcgattaaggagaacaaattcgacaaggagctaatcatgggaatcgacctcggtgggatcaacacagtttactttgcattcaacgagggcttcattagatccaacattaagtctgacgagatcattcggcagaggaggatcaacctgctaaaacagtccaagtactgttcaaacagccggacagggaaagggagaacaaagcgtctccagccaatagacgttcttagtaacaaaatcgccaagttccgtaacagtacaaatcacaagtacgcgaactatatcgtgaaacagtgcttgaaacacaactgcgggcgaatccagatggagctgcttaaggggatcagtaagaacgaccggatactcaaagactggacctatttcgatctacaggagaagatcaaaaaccaggccgagattcacggcatcgaggtgattaaggtggccccagcctacactagccagcggtgctcccagtgcggctatatctgtaaggaaaaccgttgtacccaggccatgttcgaatgcaagcagtgcggctacaaaacgcacgcggactacaacgccgccaagaacatctctacctacgacatcgagaacatcatcaacaagcagttggccgtgcagagcaaactgcattccaaaaagtgtatggaggagtacatcgaggagctgggctacttggactga

SEQ ID NO: 2895 - DNA, 1356 bp, Unknown
  Bacillus sp. multi
ctcggagtcacgattaagatcatgaagtaccaaatcctttgccccatgaacgtggattggaccatcttcgagaagcacctcaggaatctgacctaccaagtccgcaccatctcaaatcgcacgatccagcagctctgggagtttgacgcgctgtcattcgactatttcaaggccatcggaacttacccgaccgtccaagacctttatggctgcactcagaagaaaattgacgggtacatctaccacaccttgcagtccaagtaccccgacatccacaagggcaatatgagtacaaccttgcaaaaaatcatcaagacctggaaatcccgccgtaacgagatccggaagggcgaaatgtctatcccgagcttccgtaaccgcatccctattgatctccacaacaactccgtggacattactaaggagaagcacggcgattacatcgctggcatctctctattcagtcgggacttccacaaggaaaacaatgacgtcccaaagggaaagatattcgttaaactggcgacacagaagcagaagtctatgaaggtgatcctggacagattgatgaaccagacctactcaaagggagcttgcatgatctacaagtacaagaacaagtggtacttgtctatcacctacaagttcaacgccttgaaggagaacaagttcgacaaggagttgataatgggaattgacatgggcgggatcaacaccgtgtacctagcgttcaacgaagggttcatccgtagtaacatcaagagcgacgagatcaagatgttcaacgagcgtatccgtcagcggcgcatcaatttgctcaagcagtccaaatactgttcaaattcccgcaccgggaagggccggaccaagcggttacagccaattgatgtactatcgaacaagatagccaaattccgcaactctactaaccacaagtatgctaactacatcattaagcagtgcttgaagcacaactgcgggcgcatccagatggagctacttaaggggatcagcaagaatgataaggtgctcaaagactggacgtacttcgacctccaggagaagatcaaaaaccaggctgagattcacggaatcgaggtgattaaggtggcacccgcctacaccagtcagaggtgcagccagtgcggctacatctgcaaggagaaccgttgtacccaagcgatgttcgagtgcaaacagtgcggctacaagacgcacgcagactacaacgccgctaagaacatctctacttacaacatcgagaacatcatcaacaaacagcttgccgtgcagagtaaactccacagcaaaaaatgcatggaggagtacatcgaggaattgggctatttggactaa

SEQ ID NO: 2896 - DNA, 1356 bp, Unknown
  Bacillus sp. multi
cttggtgttacgattaagattatgaagtaccagatcctctgccccatgaacgtggactggacaatcttcgaaaagcacctccggaacctcacataccaagtgcgaacgataagtaaccggactatacagcagctctgggagttcgacgccttgtcgttcgattacttcaaggcaatcggcacgtaccccacggttcaagacctctacggctgcacccagaagaagattgacggttacatataccacactttgcagtcgaagtacccagacatccacaagggcaacatgagcaccacccttcaaaaaatcatcaagacttggaaatcacgtcgcaacgagattcgcaagggcgagatgtcaatcccgtccttccgcaaccgcattccaatcgacctccacaacaactccgttgacattacaaaggagaagcacggcgactatatcgctgggatttcactattctccagagacttccacaaggaaaacaatgacgtgccgaagggcaagatattcgttaagttggccacccagaagcagaagtccatgaaggtgatcttggaccggctgatgaaccagacctactctaaaggtgcgtgcatgatctacaagtacaagaacaagtggtacttgagcatcacctacaagttcaacgccttgaaggagaacaagttcgacaaggaactgataatgggcatcgacatgggagggatcaacacagtgtacctggctttcaacgagggcttcattcggagcaacatcaagagcgacgagatcaagatgttcaacgagcgaatccgacagcgccgtattaaccttctaaagcagtccaaatattgcagtaattcacgtacagggaaggggcgcacaaaacgccttcagccaattgacgtccttagcaacaagatcgccaagttccgaaacagtaccaaccacaaatacgccaactacatcattaagcagtgtctaaaacacaactgcggccgtatccagatggagctacttaagggtatatccaagaacgacaaggtgctcaaggactggacttacttcgatctccaggagaagatcaaaaaccaggcagagatccacgggatcgaggtcattaaggttgcaccagcctacaccagccagcgctgctcacaatgcgggtatatctgtaaggaaaaccggtgcactcaggcaatgttcgagtgcaagcagtgcgggtacaagactcacgctgactacaacgcggccaagaacatatcgacctacaacatcgagaacatcatcaacaagcaactggcggtccagagtaagctccactccaagaagtgtatggaggagtatatcgaggaactgggctacttggattag

SEQ ID NO: 2897 - DNA, 1356 bp, Unknown
  Bacillus sp. multi
ctcggcgtgacgatcaagattatgaagtaccagatcctctgtcccatgaacgtggactggacgatcttcgagaaacaccttcggaacctcacataccaagtgagaaccatctccaatcgaacaatccagcagctctgggagttcgacgccctctccttcgactacttcaaggcaatcggcacatacccaaccgtccaagacctctacgggtgcacacagaagaagattgacggctacatctaccacactctccagtctaagtaccccgacatccacaaagggaacatgagtaccaccttgcagaagatcatcaagacctggaaatctaggcgtaacgagatccgcaaaggtgagatgtcgatcccctcgttccgcaaccgtatccctatcgacttacacaacaacagcgtggacataacaaaggagaagcacggcgattacatcgcgggtatttccctgttctcacgtgacttccacaaggagaacaacgacgtgcctaagggcaagatattcgtaaagctggcaacacaaaagcagaagtccatgaaggtgattctcgaccggcttatgaaccagacctactcgaagggtgcttgcatgatctacaagtacaaaaacaaatggtacttgagtatcacatacaagttcaatgcccttaaggagaacaaattcgacaaggagttaatcatgggaatcgacatgggcgggatcaacaccgtttacctcgctttcaatgagggcttcatacggtcaaacatcaagtcagacgagatcaagatgttcaacgaaaggatcagacagcgccgcatcaacctcctcaagcagtccaagtactgctccaatagtcgtacaggcaaggggcggaccaagcgtttgcaacccatcgacgtgctctccaacaagatcgctaagttccgtaacagcacaaaccacaaatacgctaactacattatcaagcaatgcctcaagcacaactgcggtcgcatacaaatggagcttctaaaggggatcagcaagaatgataaggtcttgaaagactggacctacttcgacttacaggagaagatcaaaaaccaggcggagatccacgggattgaggttattaaggtcgccccggcctacacgagtcagcgctgctcccagtgcgggtatatctgcaaggagaaccggtgcacccaggcgatgttcgagtgcaagcagtgcggctacaagacccacgcagactacaacgcggctaagaatatctctacctacaatatcgagaatatcatcaacaaacagttagctgtgcagagcaaactgcactccaaaaaatgcatggaggagtacatcgaggagctgggttacctagactaa

SEQ ID NO: 2898 - DNA, 1356 bp, Unknown
  Bacillus sp. multi
ctcggcgttacgattaagatcatgaagtaccagattctctgccccatgaacgtggattggacaatcttcgagaagcacctccgtaatctcacctaccaagtgcggactatatccaaccggacaatccagcagctctgggagttcgacgcactgtccttcgactacttcaaggcgattggaacctacccaaccgtccaagacctgtacggttgcactcagaagaaaatcgacgggtacatctaccacactcttcagtcgaagtaccccgacatccacaagggcaacatgagcactacattgcagaagattatcaagacttggaaaagtaggcgtaacgagatccgtaagggagagatgagcatcccgagctttcggaaccgcatccccatcgacttgcacaacaacagcgtggacatcactaaggagaagcacggagactatatcgcgggcatctcattgttcagtagggatttccacaaggaaaacaatgacgtgccgaagggcaaaatcttcgtgaaactggctacacagaagcagaagtctatgaaggtcattcttgacaggcttatgaaccagacctatagcaagggcgcttgcatgatctacaagtacaagaacaagtggtacttatccatcacctacaagttcaacgccctaaaggagaacaagttcgacaaggagctgattatgggaatagacatgggcgggatcaataccgtttacttggccttcaacgaggggttcattcgttccaacattaagtctgatgagatcaagatgttcaacgagcggatacgacaacgccgcatcaacctcctaaagcaatccaagtactgctcaaacagccgcaccggcaaaggtcgtactaaacgccttcagccaatcgacgtgctgagcaacaaaatcgccaagttccgcaactccacgaaccacaagtacgccaactacatcatcaagcagtgccttaaacacaactgcggtcgtattcaaatggaactcctcaagggcatctctaagaacgacaaggttctcaaagattggacctacttcgacctccaggaaaaaatcaagaaccaggccgagattcacgggattgaagtgattaaggtcgctccagcatacacaagccagaggtgcagccaatgcggttacatctgcaaggagaaccgctgtactcaggctatgttcgagtgcaagcagtgcgggtacaaaacccacgccgactacaacgccgccaagaatatctccacgtacaacatcgagaacatcatcaataagcagttggccgtgcagtctaagctccacagcaagaagtgtatggaggagtacatcgaggagctgggctatttggactag

SEQ ID NO: 2899 - DNA, 1356 bp, Unknown
  Bacillus sp. multi
ctcggggtcaccatcaagatcatgaagtaccagatactgtgtcccatgaacgtggactggaccatcttcgagaagcacctgaggaacctcacctaccaagtcagaactatctccaaccgcaccatccagcagctctgggagttcgacgctctcagtttcgactatttcaaggccatcggcacctacccaactgttcaagacttgtacgggtgtactcagaagaagatagacgggtatatctatcacaccctacagtcaaagtaccctgacatacacaaggggaatatgagcactacactccaaaaaatcatcaagacatggaaaagccgccgaaacgagatccgcaaaggcgagatgtccatcccttccttccgcaaccgcatacctattgacctccacaacaactcagttgatattactaaggagaaacacggtgactacatcgcggggatttcacttttcagtcgggacttccacaaggagaacaacgacgtgcctaaaggaaagatattcgtgaagttagcaacacaaaagcagaagtcgatgaaggtgatccttgaccgcctgatgaaccagacatactcaaaaggagcctgcatgatctacaagtacaagaacaagtggtacttgagtatcacttacaaattcaacgcattgaaggaaaacaaattcgacaaggagcttatcatgggcatcgacatgggcggcatcaacacggtttatcttgcctttaacgagggattcattcggtcaaacatcaagtccgacgagattaagatgttcaacgagcggataaggcagcggcgtattaacttgctcaaacaatccaagtattgctcaaactcccgcaccggaaaaggacggactaagcggctccagccaatcgacgtgctcagcaacaagattgcgaagttccgcaactcgaccaaccacaagtacgccaactacattatcaagcagtgcctcaagcacaactgcgggcgcatccagatggaattacttaagggaatcagtaagaacgacaaggtgcttaaagactggacctacttcgatctacaggaaaaaatcaagaatcaggctgagattcacgggatcgaggttattaaggttgctcccgcctacacctcccagcggtgctcccagtgcggctacatctgcaaggagaaccggtgcacccaagcgatgttcgagtgcaagcagtgcggttacaagacccacgcggactacaatgctgccaagaacatctcaacatacaacatcgagaacattatcaataagcagcttgccgtgcagagcaagctacactccaaaaagtgtatggaggagtacatcgaggagttgggctacctcgactga

SEQ ID NO: 2900 - DNA, 1335 bp, Unknown
  Bacillus sp. multi
atgaagtaccagatcctctgcccgatgaacgacgactggaccatcttcgagaaacacctgagaaacctcacgtaccaagtgcggacgatctcaaatcggaccattcagcaactctgggagttcgatgccctctcctttgactacttcaaggcgcgcgggacttaccctacagtccaagacttgtacggatgcactcagaagaagatcgacgggtacatctatcacaccctacagtcgaagtaccccgacatccacaagggcaatatgagtacaacattgcaaaaaatcatcaagacatggaagtcacggcgcaatgagattcggaagggcgagatgtccattccttccttccgcaatcgaaagcccatcgacctccataacaactccgttgacatcactaaggaaaaaaacggggactacattgcggggatttcccttttcagtagggatttccacaaggaaaacggcgacgtaccaaagggcaaaatcttcctaaaactaggaactcagaaacagaagtctatgaaggttatcctggatcgacttatcaatcagacctactctaaaggtgcctgcatgatccacaagtacaagaacaagtggtacttgtccattacctacaagttcaacgccattaaggaaaacaagttcgacaaggagctgattatgggcattgacatgggcggtatcaacaccgtgtacttcgccttcaacgagggcttcatccgttccaacatcaagtccgacgagattaaggctttcaacgagcgcatccgccagcgccgcatcaatctgctcaagcagtccaagtactgttcgaactcccgtactgggaaaggacgggagaagcgactccagccgatagacatgctcagtaacaagatagccaagttccgcaactctaccaaccacaagtacgccaactatatcatcaagcagtgccttaaacacaactgcggccgtattcagatggagcttctcaagggcatctccaagaacgacaaggtgctcaaggactggacatacttcgacctccaggaaaaaatcaagaatcaggcggaaatccacggtatcgaagtcatcaaggtcgctccggcctacacatcacagcgatgtagtcaatgcgggtacatctgtaaggagaacagatgcacccaagatatgttcgaatgcaagcagtgcggctacaagacccacgctgactacaacgccgccaagaacatctctacctacaacatcgagaacattatcaacaagcaacttgccgtgcagtcaaagctccactccaagaagtgtatggaggagtatatcgaggagttgggctacctggactag

SEQ ID NO: 2901 - DNA, 1335 bp, Unknown
  Bacillus sp. multi
atgaagtaccagattctctgccccatgaacgacgattggaccatcttcgagaagcacctccgaaacctgacgtaccaagtcaggacgatctcaaaccggaccatccagcagctctgggagttcgacgccctgtccttcgactacttcaaggcgcgaggaacgtaccccaccgtgcaagacctctacggctgcacccagaagaagatcgacggctatatctaccacaccctccagtccaagtaccccgacattcacaaggggaatatgagcactacactccaaaaaatcatcaagacttggaaatctcggcgtaacgagatccgcaagggcgagatgagcatcccatccttcagaaacaggaagcctattgatctccacaacaattcagtggacattacgaaggaaaaaaacggggattacatcgctggtatctccctgttctcaagggacttccacaaggagaatggcgatgtcccaaagggcaaaatcttccttaaactgggaacgcagaagcagaagtccatgaaggtcatcctcgaccgcctcatcaatcagacgtacagtaaaggagcgtgcatgatccacaagtacaagaacaagtggtatctatcaatcacgtacaaattcaacgccatcaaggagaacaagttcgacaaggagctaatcatgggcattgacatgggtggcatcaatacggtgtactttgccttcaatgaggggttcatccgctcaaacatcaagtctgatgagattaaggctttcaacgaacgaatccgtcagaggcgtatcaacctcttaaagcagagtaagtattgttcgaactctaggacaggcaaggggagggagaaacggcttcaacccatcgacatgctcagcaacaagatcgccaaattccgcaacagcaccaaccacaagtacgctaactacatcatcaagcagtgcctcaagcacaactgcgggcggatacaaatggaactgctaaaggggatctccaagaacgacaaagtgttgaaagactggacgtacttcgatctacaggagaagatcaaaaaccaggcagagattcacgggatcgaggttatcaaggtggccccggcttacacctcacaaaggtgtagtcagtgcggctatatctgcaaggagaaccgatgcacccaggatatgttcgagtgtaaacagtgcggatacaagacacacgccgactacaacgcggccaagaatatctcgacatacaacatcgagaacatcattaacaaacaactcgccgttcagagcaaattgcattccaaaaagtgtatggaggagtacatcgaggagctgggttacctagactag

SEQ ID NO: 2902 - DNA, 1335 bp, Unknown
  Bacillus sp. multi
atgaagtaccagatcctctgccctatgaacgatgactggaccatcttcgagaagcacctgaggaacttgacgtaccaagtaagaactatctccaaccgcaccattcagcagctctgggagttcgacgcactgtcattcgactatttcaaggcgcgcggaacataccctaccgtccaagacctttatggctgtacccagaagaaaatcgacggctacatctaccacacccttcagtctaagtaccccgacatccacaagggcaatatgtcaacaactttgcagaagatcattaagacgtggaaatctcgacggaacgagattcgcaagggcgaaatgtccatcccctctttccgcaacaggaagcctatcgacctccacaacaacagcgtggacatcacgaaggaaaaaaatggggattacatcgccgggatcagtctgttctccagagacttccacaaggagaatggagacgtcccaaaagggaagatattcttgaagctgggaacccaaaagcaaaagtctatgaaggttatcctggatagactgataaaccagacatacagcaagggagcttgcatgatccacaagtacaagaacaaatggtatctctcgattacctacaagttcaacgccattaaggagaacaagttcgacaaggagctgataatgggaatcgacatgggagggatcaacaccgtgtacttcgctttcaacgaggggttcatccgtagtaacatcaagagcgacgagatcaaggcgttcaacgagcgtatccgtcaacgccgcatcaacctgctcaagcagagcaagtactgttccaactctaggacggggaaaggccgggagaagcgcctccagccaattgacatgctgagcaacaagattgcgaagttccgaaactctacaaaccacaagtacgcaaactacatcatcaagcagtgtctcaagcacaactgcggccggatacagatggagctgttgaagggcatatccaagaacgataaggtgcttaaagattggacctatttcgacctacaggaaaaaatcaagaaccaggcagagatccacggtattgaggtcatcaaggtggccccggcttacacctcccaaaggtgcagccagtgcgggtacatctgcaaggaaaaccggtgtacccaggatatgttcgaatgtaaacagtgtggctacaaaactcacgccgactacaacgcggccaagaacatctcgacttacaacatcgagaacattatcaataagcaactcgccgtgcagagcaaactgcacagcaagaaatgcatggaggagtacatcgaggagctggggtacttggactag

SEQ ID NO: 2903 - DNA, 1335 bp, Unknown
  Bacillus sp. multi
atgaagtaccagatcctctgccccatgaacgacgactggaccatcttcgagaagcacttgaggaacctgacctaccaagtaaggacgatctccaaccgaaccatccagcagctctgggagttcgacgccctttccttcgactacttcaaggcgcgaggcacatatcccactgtccaagacctatacgggtgtacgcagaagaaaattgacggttacatctaccacaccctccagagcaagtaccccgacattcacaaggggaatatgtccacaacacttcagaagatcatcaagacttggaaatctaggcgcaacgagattcgaaaaggtgagatgtccatcccctcctttcgcaaccgtaaacccattgaccttcacaacaacagcgttgatattactaaggagaagaacggtgactacatcgccggtatttcgcttttcagtcgggacttccacaaggagaacggtgatgttccgaagggcaagatattcttgaaactcggcactcaaaagcagaagtccatgaaggtgattcttgacaggctgattaaccagacgtacagcaagggcgcttgcatgattcacaagtacaagaacaagtggtacttatccatcacttacaagttcaacgctatcaaggagaacaagttcgacaaggagttgataatggggatcgacatgggagggataaacacagtgtactttgccttcaacgagggcttcatccgcagcaacatcaagtccgacgagattaaggcgttcaacgagcgcatacgacaacgccgcattaacctcctcaagcagtccaagtattgttcaaacagccgtacggggaagggacgggagaagcggctccagccgattgacatgctatccaacaagatcgctaagttccgaaacagcaccaatcacaagtacgcaaactacatcattaagcagtgccttaagcacaactgcggtcgcattcagatggaattgttaaaggggataagcaagaacgacaaagttctcaaggactggacgtacttcgacctccaggaaaaaatcaagaatcaggctgagatccacggcatcgaggtgattaaggtcgccccagcctatacctctcagcggtgcagccagtgcgggtatatctgcaaggaaaatcgctgtactcaggatatgttcgaatgcaagcagtgcggctacaagacacacgcggactacaacgccgccaagaacatctcaacatacaacatcgaaaacatcatcaacaaacagctcgcggttcagagcaaattacacagcaagaaatgcatggaggagtacatcgaggagctgggttaccttgactga

SEQ ID NO: 2904 - DNA, 1335 bp, Unknown
  Bacillus sp. multi
atgaagtaccagatcctctgcccgatgaacgacgactggaccatcttcgagaagcacctccgtaacttgacttatcaagtccgtactatctcaaatcgcacgatccaacagttgtgggagttcgacgcattgagctttgactacttcaaggcccgaggaacgtatccaaccgtacaggacttgtacggatgcactcagaagaaaatcgacggctatatctaccacacgctccagtccaagtaccctgacatccacaagggcaatatgagtaccaccttgcagaaaatcatcaagacctggaagtcaagacgtaatgagatccgcaaaggggagatgagtatcccatcattccggaaccgtaaacccattgatctccacaacaacagcgtggacattacgaaggaaaaaaacggcgactacatcgccggaatctcactctttagccgggacttccacaaggaaaacggagacgtcccaaagggcaagatattcctgaaactgggaacccagaagcaaaagtccatgaaggtgatccttgaccgactcattaaccagacgtactctaaaggtgcctgcatgatccataagtacaagaacaaatggtatctgtcgatcacatacaaattcaacgccatcaaggagaacaagttcgacaaggagctaatcatgggcatcgacatgggagggatcaacactgtgtacttcgcattcaatgagggcttcatccggtccaacattaagtccgacgagattaaggcgtttaacgaaaggataagacaaaggcgcatcaatctgctaaagcagtccaaatactgttcaaactcccgcacgggcaaggggcgtgagaagcggctccagccgattgatatgctgtcaaacaagattgccaagttccgcaactcaacgaaccacaagtacgcgaactacatcattaagcagtgcctcaagcacaactgcggacgcatacaaatggagctgttgaaagggattagcaagaacgacaaggtgttgaaagactggacctacttcgacctacaggaaaaaatcaagaaccaggcggagattcacggcatcgaggtcattaaggtggctccagcctacaccagccaaaggtgctcacagtgcggctatatctgcaaggagaaccgctgtactcaagatatgttcgaatgcaagcagtgcggctacaagacccacgccgactacaacgccgccaagaacataagcacctacaacatcgagaacatcatcaacaagcagttggccgtgcagagcaaactgcacagcaagaagtgtatggaggagtacatcgaggagctgggttatctggactga

SEQ ID NO: 2905 - DNA, 1356 bp, Unknown
  Bacillus sp. multi
cttggcgtgactatcaagatcatgaagtaccagatcctctgcccgatgaacgttgactggacgatcttcgagaaacacctccgcaaccttacttaccaagtcaggactatttccaacaggaccatccagcagctctgggagttcgacgcgctctccttcgactacttcaaggctcgcggaacttaccccaccgtccaagacttgtacggttgcacccagaagaaaatcgacgggtatatctatcacaccctccagtctaagtaccctgacatccacaagggcaacatgagcaccaccctccagaagattatcaagacctggaaatcccgaaggaacgagatcggcaagggcgaaatgtccatcccgtccttccggaaccggattcctattgacctgcacaacaacagcgtcgagattacaaaggagaagaacggggattacattgccggaatctccctattctcgcgcgacttccataaggagaacggcgacgtgcctaaggggaaaatcttcctcaagttggggacgcagaagcagaagtccatgaaggtcatcttggaccggctcatcaatcagacctactctaaaggagcttgcatgatccataagtacaagaataagtggtatctgtctatcacctacaagttcaatgcgatcaaggagaacaaattcgacaaggaactgattatggggatcgacatgggtgggatcaacaccgtgtactttgcattcaatgagggcttcatccggagcaacatcaagtccgacgagatcaaggcgttcaacgagaaaatccgccagagacgcatcaacctgttaaagcagagcaactactgctcaaacagccgaacgggaaagggtagggccaagcggcttcagccaattgatgtcctttcaaacaagattgccaaattccgcaacagtaccaaccacaagtatgccaactacatcatcaagcagtgccttaagcacaactgtggccgcatccagatcgagctgctcaaggggatctccaagaacgataaggttctgaaagactggacttacttcgatctacaggagaagattaaaaaccaggccgagattcacgggattgaagtgattaaggttgctcctgcctacacgagccagcgctgtagtcagtgcggctacatctgtaaggaaaatcgctgcacccaggccatgttcgagtgcaagcaatgcggatacaagacacacgccgactacaacgccgccaagaacatcagtacctacgacatcgagaacatcatcaacaagcagcttgctgtgcagtccaagctccattccaaaaaatgcatggaggagtacattgaggaactgggctacctcgactag

SEQ ID NO: 2906 - DNA, 1356 bp, Unknown
  Bacillus sp. multi
cttggagtcaccatcaagatcatgaagtaccagattctctgtcccatgaacgtcgattggaccatcttcgagaagcacctccgcaacttgacttaccaagtgcgtaccatctcaaaccgtacgatccagcaactatgggagtttgacgcgctgagcttcgactacttcaaggcccgtggaacgtatccgaccgtgcaagacctctacggctgcacccagaagaaaatcgacgggtacatctaccacaccctgcaatccaagtacccggacatacacaagggcaacatgagcacaacgttgcagaagattatcaagacgtggaaatcgagaaggaatgagatcgggaagggcgagatgagtatcccctccttccggaacaggatacccattgacttgcacaacaactccgtcgaaattacaaaggagaagaatggcgactatatcgcgggaatttcgctcttcagcagagactttcacaaggagaacggggacgtgcctaaagggaagatattcctcaagctgggaacgcaaaagcaaaagtctatgaaggttatcttggaccgcctgattaaccagacttactcgaaaggtgcgtgcatgattcacaagtacaagaacaagtggtacttgtcaatcacttacaaattcaatgcgatcaaggagaacaagttcgacaaggagcttatcatggggatagacatgggagggatcaacaccgtgtactttgcattcaacgagggattcattcgctcgaacatcaagtcagacgagattaaggcgttcaacgagaagatacgccagcgtcgcattaacctccttaaacagtccaactattgctctaattctcgcaccggcaaggggcgtgcgaagcgcttgcaacctatcgacgtgctctcaaacaagatagccaagttccgaaacagcacgaaccacaagtacgcaaactacatcatcaagcaatgcctaaagcacaactgcgggaggatacaaatcgagcttctcaaggggatttccaagaacgacaaggtgctcaaggactggacctacttcgacctccaggaaaaaatcaagaatcaggccgagatacacggaattgaggtgattaaggttgcaccagcatacacatcgcagaggtgcagccagtgcgggtacatctgcaaggagaaccgctgcacccaggcgatgttcgaatgcaagcagtgcggctacaagacacacgctgactacaacgccgctaagaacatctctacctatgacattgagaacatcatcaacaagcaactcgctgtccaatcgaagttgcattccaaaaaatgcatggaggagtacatcgaggagcttggctacctcgactag

SEQ ID NO: 2907 - DNA, 1356 bp, Unknown
  Bacillus sp. multi
ctcggagtgactatcaagatcatgaagtaccagatcctgtgcccgatgaacgtggactggaccatcttcgagaaacaccttcggaaccttacttaccaagttcgcacaatctccaacagaacgatccagcagctctgggagttcgacgccctgagcttcgactatttcaaggcgcgcggcacctaccccacagtccaggacttgtacgggtgcacacagaagaaaatcgacgggtacatctaccacacccttcaatccaagtaccccgacatccacaaggggaacatgagtaccactctccagaagatcattaagacctggaagtctcgccgaaacgagatcggcaagggtgagatgtctatcccgtcgttccgcaaccgcatacccatcgaccttcacaacaactcggtggagatcactaaggaaaaaaatggggactatatcgctggaatttccttattctcccgcgatttccacaaggaaaatggggacgtgcctaagggcaagatattcttgaagctcggaacacagaagcagaagtccatgaaggtgattcttgaccgcctgattaaccagacctatagcaagggagcttgcatgattcacaagtacaagaacaagtggtatctcagcattacatacaagttcaacgctatcaaggagaacaagttcgacaaggagttgataatggggattgacatgggcgggattaacacagtgtacttcgctttcaacgagggcttcatccggtcgaatatcaagagcgatgagattaaggcgtttaacgaaaaaatccgtcaaaggcgcatcaacttgctaaagcagtcaaactactgctcaaactcacgtaccgggaagggacgtgctaagcgtcttcagccaatcgacgtcctgtcgaacaagatagctaagttccgcaacagcactaatcacaaatacgctaactacatcatcaagcagtgcctcaagcacaactgcgggcgcatccagatcgaattgcttaaggggatctctaagaatgacaaggtgctcaaggactggacatacttcgatctccaggagaagatcaaaaaccaggcggagatccacgggatagaggttattaaggttgctccagcctacacaagccagaggtgctcccagtgcgggtacatctgcaaggagaacagatgcacacaggccatgttcgagtgcaagcagtgcggctacaagacacacgctgactacaacgccgccaagaacataagcacctatgacattgagaacattatcaacaaacaacttgcagtgcagtctaagttgcatagcaagaaatgcatggaggagtacatcgaggagctgggatacctcgactag

SEQ ID NO: 2908 - DNA, 1356 bp, Unknown
  Bacillus sp. multi
ttgggcgtaactatcaagattatgaagtaccagattctgtgtcccatgaacgtggactggacgatattcgagaaacacctccgaaaccttacctaccaagttcgaaccatctccaaccgtaccatccagcagctctgggagttcgacgccctctccttcgactatttcaaggcccgtggcacctacccgaccgtccaggatctgtacggatgcacccagaagaagatcgacggctatatctaccacactttgcagtccaagtacccggacattcacaaggggaacatgagtaccaccctccagaagattatcaagacatggaagtcccgaaggaacgagatcggaaagggcgagatgtccataccgtcctttcgcaaccgaataccaatcgacttgcacaacaacagcgttgagatcactaaggagaagaacggcgattacattgcgggcatctcgctgttcagcagagatttccacaaggaaaacggcgatgtgcctaagggcaagatattcttgaaactgggaacacaaaagcagaagtcgatgaaggttatccttgaccgcctgattaaccagacctacagcaagggcgcgtgcatgatccataagtacaagaacaagtggtacttatccatcacgtacaagttcaacgcgattaaggagaacaaattcgacaaggaactgataatggggattgacatgggcggcatcaacactgtgtacttcgcgttcaacgaagggttcattcggagcaacattaagagcgacgagattaaggcgtttaacgaaaaaatccgacaaagacgtatcaacctgctcaagcagtcgaactactgctcgaactcccgcaccgggaagggaagggccaagcgccttcagccgattgacgtgctgtccaacaagattgcgaagttccgaaattcaacgaaccacaagtacgcgaactacatcatcaagcagtgcctaaagcacaattgcggccggatacagatagagctgttgaaagggatctccaagaatgacaaggttctgaaagattggacttacttcgacttacaggagaagatcaaaaaccaggcagagatccacggaatcgaggtcatcaaggtggcccctgcctacacatctcaaaggtgctcacagtgcgggtacatctgtaaggagaaccgctgcactcaggctatgttcgagtgcaagcagtgcgggtacaagacacacgcagattacaacgcggccaagaacatatcgacctacgacatcgagaacatcattaacaagcaactagccgttcaatcgaagctacacagcaaaaaatgcatggaggagtacatcgaggagcttggctacctggactga

SEQ ID NO: 2909 - DNA, 1356 bp, Unknown
  Bacillus sp. multi
ctcggcgttacgattaagatcatgaagtaccagatactctgtcctatgaacgtcgattggactatcttcgaaaagcacctccgtaatctcacctaccaagtccggaccatatccaaccggaccatccagcaattgtgggagtttgacgccctgtccttcgactacttcaaggcacgcggcacgtaccccacggtgcaagacctgtacggttgcacccaaaaaaagatagacggctacatataccataccctgcaatcgaaatacccggacatccacaaggggaatatgtccactacactccagaagattatcaagacttggaaatctcgtcggaatgagattggaaaaggcgagatgtccatcccctcctttcggaacaggatacctattgacttgcacaacaactcagtcgagatcacgaaggagaagaatggcgactacatcgccggaatttcactgttctcccgcgacttccacaaggagaatggtgacgtcccaaaagggaaaatcttccttaagctcggcacgcagaagcagaagtctatgaaggtgatcttggaccggctgattaaccagacctacagcaagggtgcctgcatgatccacaagtacaagaataagtggtatctatccatcacgtacaaattcaacgcgatcaaggagaacaagttcgacaaggagcttatcatgggaatcgacatgggtggcatcaataccgtgtactttgccttcaacgaagggtttatccgtagcaacatcaagagtgacgagatcaaggctttcaacgagaaaatccgccaacgacggatcaaccttctcaagcagtcaaactactgctcgaactcacggactgggaaggggagggccaagcgtctccaacctatagacgtgctcagtaacaagatagccaaattccgcaatagcactaatcacaagtacgccaactacatcatcaagcaatgccttaagcacaactgcggacgcatccagatcgagctactcaaggggatttccaagaacgacaaggtgcttaaagactggacatacttcgatctccaggagaagatcaaaaaccaggctgagatccacggcatcgaggtcatcaaggtcgctccagcatacacctcacaacgttgctcacagtgtggctatatctgtaaggaaaatcgctgtacgcaagccatgttcgagtgcaaacagtgcggatacaagacccacgccgactacaacgccgccaagaacattagcacgtacgatattgagaacatcatcaacaagcaactagccgtgcagagcaagctccacagcaaaaaatgcatggaggagtatatcgaggaactgggataccttgactag

SEQ ID NO: 2910 - DNA, 1335 bp, Unknown
  Bacillus sp. multi
atgaagtatcagatcctttgccccatgaacgttgactggaccatattcgagaagcacctccgcaacctgacataccaagtgcggaccatctcgaaccgcaccatccagcagctttgggagttcgacgccctgtcgttcgattacttcaaggaaagaggaacataccccaccgtccaagacctctatgggtgcacgcagaagaagatagacgggtatatctaccacacccttcagtcgaagtaccctgacatccacaagggcaatatgtcaactactctccaaaaaatcatcaagacttggaaatcccgtcggaacgagatacggaagggagagatgagtatcccgagtttccggaaccgtattccaattgacctgcacaacaacagcgtggacatcaaaaaggaaaaaaacggagactacatcgccggaatttcactattcagtagggacttccacaaggagaactcagacgtacctaagggcaagatattcgttaaactggccaccaaaaagcagaagtcgatgaagatcatacttgaccgtctcatgaaccagacctactcaaaaggtgcttgcatgatacacaagtacaagaacaagtggtacttgtccatcacttacaaattcaacgccatcaaggagaacaagttcgacaaagacctaatcatggggatagacatgggtggcattaacactgtgtacttcgctttcaacgaggggttcatccggtccaacattaagagcgacgagatcaaggcgttcaatgagcgcatccgccaaaggcgtatcaatctgctcaagcagagcaagtattgttccaactcccgaatgggaaaggggcgcgagaaacgcctccagcctattgacgtccttagcaacaagatagcaaagttccgtaacagcaccaaccacaagtacgccaactatatcatcaagcagtgcctcaagcacaactgcgggcgtatccaaatggaactgctaaaagggatctccaagaacgacaaagtgctgaaagactggacctactttgacttacaggagaagattcagaaccaggccgagattcacggtatcgaagtcatcaaggtggctcctgcatacacatcacagcggtgctcccagtgcggctacatctgcaaggagaatcggtgcacccaggcagtgttcgagtgcaagcagtgcggttacaagacgcacgcagactacaacacggccaagaacatcgccacatacgacattgagaacatcatcaacaagcagctcgccgtgcagtccaaactacactccaagaaatgcatggaggagtacatcgaggagttggggtacttggactaa

SEQ ID NO: 2911 - DNA, 1335 bp, Unknown
  Bacillus sp. multi
atgaagtaccagatactctgccccatgaacgtggactggacgatcttcgagaaacatctgagaaacctgacgtaccaagttcggactatctccaaccgcaccattcagcagctctgggagttcgacgcgctctccttcgactacttcaaggaacgaggaacttatcccaccgtccaagacctctatgggtgcactcagaagaagatagacggctacatctatcacacccttcagagcaagtaccctgacatccacaagggcaatatgagcactaccctccagaagattatcaagacatggaaaagtcggcgaaacgagatccgcaagggtgaaatgagtattccgtccttccgcaaccgcatcccgattgacttgcacaacaactccgtggacatcaagaaagagaaaaacggagactacatcgccggtatcagcctgttctcacgggacttccataaggagaacagcgacgttcctaaagggaagatattcgtgaagttggctaccaaaaagcagaagtcgatgaagatcatattggaccgcctgatgaaccagacttactctaagggcgcgtgcatgatccacaagtacaagaacaaatggtatctatctattacctacaagttcaatgccattaaggagaacaaattcgacaaagacctcataatggggatcgacatgggcgggataaacaccgtgtactttgctttcaatgagggcttcatccggtccaacatcaagtctgacgagatcaaggcgtttaacgagcggatcagacagcggaggatcaaccttctcaaacagtccaagtattgctcgaactctcgcatgggcaaggggagggagaagcgacttcagccaatcgacgtcctgtccaacaagatcgccaaattccgtaatagcacaaaccacaagtacgccaactacatcattaagcagtgcttgaaacacaactgcggtcgtatccaaatggaactgttgaaggggatctctaagaatgacaaggtgctcaaggactggacatacttcgacctacaggaaaaaatccaaaaccaggccgaaatccacgggatagaggttattaaggtggctcccgcctacacatctcagcggtgcagccagtgcgggtatatctgtaaggagaaccggtgcacccaggcggtcttcgaatgtaagcagtgcggttacaagacccacgctgactacaacacggctaagaacatcgcaacatacgacatcgagaacatcatcaacaagcagttggcagtgcagtctaagctgcactccaagaagtgtatggaggagtacattgaggagttgggttatctggactga

SEQ ID NO: 2912 - DNA, 1335 bp, Unknown
  Bacillus sp. multi
atgaagtaccagattctatgccccatgaacgtggactggaccatcttcgagaagcacctaaggaacttgacctaccaagtaagaacaatctctaatcggaccatccagcagctatgggagttcgacgccctcagcttcgactacttcaaggaacggggcacctaccctacggtccaagacctatacgggtgtacgcagaagaaaatcgacggctatatctatcacaccctccaatccaagtaccctgacattcacaagggcaatatgagcactaccctccagaaaatcatcaagacttggaagtcgcggcggaacgagattcgcaaaggagagatgtccattccatccttccgcaaccgcatccccatcgacttgcacaacaactctgtggacatcaaaaaagagaaaaatggcgactacatcgcgggcatctccctgttcagcagagactttcacaaggagaactctgatgtcccgaagggcaaaatcttcgttaagctcgccaccaagaaacaaaagtccatgaagatcatcctggaccgtcttatgaaccagacctactcaaaaggagcctgcatgatccacaagtacaagaacaagtggtacttgagcatcacgtacaagttcaacgctattaaggagaacaaattcgacaaagacttgataatgggaatagacatgggcggtatcaacacggtgtacttcgccttcaatgaggggttcatacgctcgaacatcaagtccgacgagattaaggctttcaacgagcgaatccggcaaagacggatcaacctccttaagcagagtaagtattgcagtaatagccgaatggggaaaggaagggagaaacggctccaacccatcgacgtccttagcaacaagatagccaaattccgtaacagcactaaccacaagtacgcgaactacatcatcaagcagtgccttaagcacaattgcggacggattcagatggagttgctcaaggggatctccaagaacgacaaagtgcttaaagactggacctacttcgatctccaggagaagatacagaaccaggcggagatccacggcattgaggtgattaaggtggctcctgcctacacctctcagcgatgctcacagtgcggctacatctgcaaggagaatcggtgcactcaagcggtcttcgaatgcaagcagtgcggttacaagacccacgccgattacaacacagctaagaacatcgctacatacgacatcgagaacatcatcaacaagcagttggccgtgcagagcaagttgcactccaaaaaatgcatggaggagtacatcgaggagctgggttatcttgactaa

SEQ ID NO: 2913 - DNA, 1335 bp, Unknown
  Bacillus sp. multi
atgaagtaccagatcctctgccccatgaacgtggattggacgatcttcgagaagcaccttcgaaacttgacctaccaagttcgcaccatctcgaaccggaccattcaacagctctgggagttcgatgcactctccttcgactacttcaaggagcggggaacgtaccccaccgttcaagacctttacggttgcacccagaagaaaattgacggctacatctaccatactctccagtcgaagtacccggacatccacaaggggaacatgagcaccaccctccagaagattatcaagacttggaagtctaggcgcaacgaaatccgcaagggagagatgtcgatcccctcctttcgcaatcgcatccccattgacctgcacaacaacagcgtggacatcaaaaaagagaagaatggtgattacatcgccgggatctcactcttcagtcgggatttccacaaggagaacagcgacgtgccgaagggcaaaatcttcgtgaagctcgctaccaaaaagcagaagtccatgaagatcatccttgacagactgatgaaccagacttactcaaaaggagcctgcatgattcacaagtacaagaacaagtggtatctgtcaattacctacaagttcaatgctattaaggaaaacaaattcgacaaagacctgattatgggaatcgacatgggtggcatcaataccgtttactttgccttcaacgagggcttcatacggtccaacatcaagagcgacgagatcaaggcgttcaacgagcgtattcgacagaggcgcatcaatctcctaaagcagtccaagtattgctccaacagccggatgggaaaggggcgtgagaagcggttgcagcccatcgacgtgctgagcaacaagatcgccaaattccgtaacagcaccaaccacaagtacgcaaactacatcatcaagcagtgcctcaaacacaactgcggccgtattcagatggagttgctcaagggtatatctaagaacgacaaggtgctgaaagactggacctacttcgatctccaggagaagattcagaatcaggccgagattcacggaattgaagtcatcaaggtggctcctgcctacacatcccaaaggtgcagccagtgcggttacatctgtaaggagaaccgctgcactcaggctgtgttcgagtgcaagcagtgcgggtacaagacccacgccgactacaacaccgctaagaacatcgctacatacgacatcgagaacatcattaacaagcaattggccgttcagagcaagctgcacagcaaaaagtgtatggaggagtacatcgaggagttgggttaccttgactag

SEQ ID NO: 2914 - DNA, 1335 bp, Unknown
  Bacillus sp. multi
atgaagtaccagattctgtgccccatgaacgtggactggacaatcttcgagaagcacctgagaaacctaacctaccaagtacgcacaataagcaaccggacgatccagcagctttgggagttcgatgccctcagtttcgactatttcaaggaaagaggaacttaccccacagtccaagacctctacgggtgcacgcaaaaaaagatagacggctacatataccacaccctccagagcaagtacccggacatccacaaggggaacatgagcaccaccctccagaaaatcatcaagacctggaagtcaaggcgcaacgagatccgcaaaggagagatgtcaattccgtccttccggaaccgcatcccaattgacctgcacaacaactccgtggacattaagaaagagaagaacggggactacattgccgggatttcgttgttctcaagggacttccacaaggaaaacagtgacgtgccaaagggcaagatattcgttaaactcgccaccaaaaaacagaagtccatgaagataatccttgacagattgatgaaccagacatactcgaagggcgcgtgcatgatccacaagtacaagaacaaatggtatctctccatcacgtacaagttcaacgctattaaggagaacaaattcgacaaggatcttatcatgggcattgacatgggcggcatcaacaccgtgtactttgccttcaatgagggcttcattcgttccaacatcaagagcgacgagatcaaggcgttcaacgagcgtatccggcagagacgcattaacctattgaagcagtcaaagtattgctccaactcccgcatgggcaaaggccgcgagaagcgcctgcaaccgattgacgtgctctcaaacaagatagcaaagttcagaaacagcactaaccataagtacgctaactatatcatcaagcagtgcttgaaacacaactgcgggcgcatccaaatggagctgctcaagggcatctccaagaatgacaaggtgctcaaagactggacgtacttcgacctacaggagaagatacaaaaccaggctgaaattcacggcatcgaggttattaaggtggccccggcttacacctcacagcggtgcagccagtgcgggtatatctgcaaggagaaccgctgcacccaggctgtgttcgaatgcaagcagtgtggctacaaaacccacgccgattacaacaccgccaagaacattgccacttacgacatcgagaacattatcaacaagcagcttgcggtgcagtctaagttgcacagcaagaagtgtatggaggagtacatcgaggagttgggctacctagactag

SEQ ID NO: 2915 - DNA, 1335 bp, Unknown
  Bacillus sp. multi
atgaagtaccagatcctgtgccccatgaacgtggactggaccatattcgagaagcaccttcgtaacctaacctaccaagttcggacgatctccaaccgtaccatccagcagctctgggagttcgacgccctctccttcgattacttcaaggcacgcggaacgtaccccaccgtccaagacctttacggatgcacacagaagaagattgacggctacatataccacaaacttcaatcgaagtacccggacatccacaaggggaatatgagcaccactctccaaaaaatcatcaagacctggaaatcccgccgcaatgagatccgcaagggtgagatgtcgattccctcctttcgaaatcgcatccctatagacctacacaacaacagcgtggagattactaaggaaaaaaacggggactatatcgccggtatctctctgttctcacgggacttccacaaggagaacggggacgtaccaaagggcaagatattcttgaaactcggcactcagaagcagaagtctatgaaggtgatcttggacaggcttatcaaccagacctactctaagggcgcttgcatgatccacaagtacaaaaacaagtggtatctctcaataacctacaagttcaacgctatcaaggagaacaaattcgacaaggagctgataatgggcatcgacatgggcgggattaacactgtctatttcgcgttcaacgagggattcataaggtccaacattaagagcgacgagattaaggctttcaacgaaaaaatccgccagcggaggatcaacctgttgaaacagtccaactactgctcaaactccagaactggaaagggccgggccaagcggcttcaaccgatagacgtacttagcaacaagatcgccaagttccgtaactcgacaaaccataagtacgccaattacatcatcaagcagtgcctcaagcacaattgcgggcgaatccagattgaactgctcaagggtatctccaagaacgacaaggtgctcaaggactggacctacttcgacctacaggagaagatcaaaaaccaggccgagatccacggaatcgaggtcatcaaggtggctcctgcatatacttcccagcggtgctcgcagtgcggctatatctgcaaggagaaccgctgcactcaagccatgttcgagtgcaagcagtgtggttacaagacgcacgctgactacaatgcagccaagaatatctcaacctacgacatcgagaacatcatcaacaagcagcttgccgtgcagtccaagctacactccaagaagtgtatggaggagtacatcgaggagcttggctatctcgactga

SEQ ID NO: 2916 - DNA, 1335 bp, Unknown
  Bacillus sp. multi
atgaagtaccagattctctgcccgatgaacgtggattggactatcttcgagaaacacctgaggaacctgacctaccaagtccgaaccatcagcaaccgtacgatacagcagttgtgggagttcgatgccctctcctttgactacttcaaggcgcgcggcacctaccctacggtccaggatctctatggttgtactcagaagaaaattgacgggtatatctatcacaagttacaatcgaaatacccggacattcacaaggggaacatgagcactacgctccagaagattatcaagacgtggaaatctcggcgcaacgagatccgcaagggcgagatgagtatcccctcctttcgcaaccgaatccctatcgacctccacaacaactctgtggaaatcactaaggagaagaatggcgactacatcgctgggatttcactattcagtcgggacttccacaaggagaacggtgacgtgccgaagggcaaaatcttcctgaaacttgggactcaaaagcagaagtcgatgaaggtgatactggataggcttattaaccagacatacagtaagggtgcgtgcatgatccacaagtacaagaacaagtggtatttgagcatcacttacaaattcaacgccatcaaggagaacaagttcgacaaggagctgattatggggattgacatgggtggtatcaacaccgtttactttgccttcaacgagggcttcatacgatccaacattaagtcagacgagatcaaggcgtttaacgaaaaaatccgtcagcgccgtatcaacctcttgaaacagtccaactattgcagtaacagtagaactgggaaaggccgcgctaagcgtcttcagccaatcgacgtcctgagcaacaagatcgctaagttccgcaactccaccaaccacaagtacgcgaactacatcattaagcagtgtctaaagcacaactgtggtcggatacagatcgagttacttaaaggaatatccaagaacgacaaagtgctcaaggactggacctacttcgacctccaggagaagatcaaaaaccaggcagagatccacggcatcgaggtgattaaggttgccccggcatacacatctcagcgttgctcgcaatgcgggtacatctgcaaggagaaccggtgtacccaggccatgttcgagtgcaagcagtgcgggtacaagacgcacgcagactacaacgcggccaagaacatctccacctacgatattgagaacattatcaacaagcagttggccgtgcagagcaagctccacagcaaaaaatgcatggaggagtacatcgaggagttgggctacttggactga

SEQ ID NO: 2917 - DNA, 1335 bp, Unknown
  Bacillus sp. multi
atgaagtaccagatcctctgccccatgaacgtggattggacaatcttcgaaaagcacttgcgtaacctgacctaccaagtcagaacaataagcaaccgaacgatccagcagctctgggagtttgacgccctctcgttcgactatttcaaggctcgtggcacctaccctaccgtccaagacctctacggctgcacccagaagaaaatcgacggctacatctaccataagctccagtccaagtatcccgacattcacaaggggaacatgagcaccacactacaaaaaatcatcaagacatggaaatctaggagaaacgagatccgtaagggcgagatgtccattccctcgtttcggaaccgtatccccattgacctccacaacaactccgtcgaaatcacgaaggagaagaatggtgactatatcgcggggatctctctattctcacgcgacttccacaaggagaacggcgatgttccaaaaggcaagatattcctaaagttggggactcagaagcagaagtccatgaaggtgatcttagaccgccttatcaatcagacctacagcaaaggcgcttgcatgatccacaagtacaagaacaaatggtacttgtcaatcacgtacaaattcaacgcgattaaggagaacaagttcgacaaggaacttatcatggggattgacatgggtggcatcaacacagtttacttcgccttcaacgagggcttcatccggagcaacattaagtccgatgagattaaggctttcaacgagaagatacgccagcgccggatcaaccttctcaagcagtccaactactgctccaactctcgtacgggcaagggccgagctaagcgtctccagcccatcgacgtgcttagcaacaagattgcgaagttccgcaacagtaccaaccacaagtacgccaactacatcatcaagcagtgcctcaagcacaactgcgggcgcatccagatagagctgctaaagggtatcagcaagaatgacaaagtgttgaaggactggacctacttcgacctacaggagaagatcaaaaaccaggcggagatccacggcatcgaggttatcaaggttgccccggcctatacctcccagcgttgcagccaatgcggctatatctgcaaggaaaatcgttgtacgcaagccatgttcgagtgcaagcagtgcgggtacaaaacacacgccgactacaatgccgccaagaatatctccacttacgacattgagaacatcatcaataagcagttggccgtgcagtcaaagctacacagcaagaaatgcatggaggagtacattgaggagcttggctatctcgattaa

SEQ ID NO: 2918 - DNA, 1335 bp, Unknown
  Bacillus sp. multi
atgaagtatcagatactttgccccatgaacgtcgattggaccatcttcgagaagcacctcagaaacctcacctaccaagtacgcaccatctccaacagaacgatccagcaactctgggagttcgacgcgctctcattcgactacttcaaggctcgtgggacatatccgacagtccaagacctatacggctgcactcagaagaaaatcgacggctacatctaccacaagctccagtcgaagtaccccgacattcacaagggcaacatgagcaccacattgcagaagatcatcaagacttggaaatctcggaggaacgagatccgcaaaggtgagatgagtatcccgtccttccgcaaccgcatacctatcgacctacataacaactcagttgaaatcactaaggagaagaacggtgactacatcgcgggcatatcgctctttagtcgtgacttccacaaggaaaacggcgacgtcccaaagggcaagatattcctaaaactcggtactcagaagcagaaatccatgaaggtgatcctggaccggctgattaaccagacgtacagcaaaggtgcctgcatgatacacaagtacaagaacaagtggtatctgtctattacctacaagttcaatgctattaaggagaacaagttcgacaaggaactcataatggggatcgacatgggcgggattaacacggtgtactttgccttcaacgagggcttcatccgcagcaacattaagtctgacgagatcaaggcgttcaacgagaagattcgccagcgccggataaacctgctcaagcagtccaactactgctccaactccagaacgggcaaaggtcgggcgaagcggctccagccgatagacgtgctctccaacaagatcgccaagttccgcaatagtacgaaccacaagtacgctaactacatcatcaagcagtgccttaagcacaactgcgggagaatccaaattgagttgctaaagggaatcagtaagaacgacaaagtgttgaaggactggacatacttcgacctccaggaaaaaatcaagaatcaggccgagatccacgggatcgaagtcatcaaggtggccccggcatatacaagccagcggtgttcccagtgcgggtacatctgcaaggagaatcgctgcactcaggcgatgttcgagtgcaagcagtgcggatacaagacccacgcggactacaacgccgctaagaacatcagcacttacgacatcgagaacatcatcaacaaacaactggccgttcagagcaagctgcatagcaagaagtgtatggaggagtacattgaggaactgggatacctcgactag

SEQ ID NO: 2919 - DNA, 1335 bp, Unknown
  Bacillus sp. multi
atgaagtaccagatcctctgccccatgaacgtggactggacgatcttcgagaaacacctccgcaatctcacctaccaagtccggacgataagcaaccgcaccatccagcagctctgggagttcgacgccttgtccttcgattacttcaaggcccgtgggacttaccccacggtccaggatctatacggctgcacgcagaagaaaatcgacggctacatctaccacaagttgcagtccaagtacccggacattcacaaggggaatatgagtacgaccctccagaagatcatcaagacttggaaatcacgaaggaatgagatccggaaaggggagatgagcatcccttcctttcgcaaccgcattccaattgacttgcacaacaatagcgtagagatcacaaaggagaagaacggtgactacatcgccgggatctccctgtttagcagagacttccataaggagaacggcgacgtgcctaaggggaagatattcctgaaactgggaacccaaaagcagaagtctatgaaggtgatcctcgaccgtctgataaaccagacctacagcaagggcgcttgcatgattcacaagtacaagaacaagtggtacttgtctattacttacaaattcaacgcgattaaggagaacaaattcgacaaggaattgataatgggaatcgacatgggtggcatcaacacggtgtacttcgcattcaacgagggcttcatacgcagcaacatcaagagcgacgagattaaggctttcaacgagaaaatccgccagcgacgcattaacctgttgaagcagtccaactactgctcaaattcaaggaccggcaaaggccgtgcaaaacgcctacagcctatcgacgtcctcagtaacaagatagccaaattccgcaactccaccaaccacaagtacgcaaactatatcatcaagcagtgccttaagcacaactgcgggcgcatccagattgagttactaaagggtatcagtaagaatgacaaggtgctcaaggactggacatacttcgatctccaggagaagatcaaaaaccaggcggaaattcacggcatcgaggttattaaggtcgccccggcctatacttcgcagcgatgctcgcagtgcggctacatctgcaaggaaaatcgttgcacccaggcaatgttcgagtgtaagcagtgcggatacaagacgcacgccgattacaacgccgccaagaacatctctacttacgatattgagaacatcatcaacaaacagctcgccgtacagagtaagctccattccaaaaaatgcatggaggagtacatcgaggaactgggttatctggactga

SEQ ID NO: 2920 - DNA, 1368 bp, Unknown
  Bacillus sp. multi
ctgggcgtgacgattaagatcatgaagtaccagattctctgcccgatgaacgtggactggatcatcttcgagaagcacctccgcaacctgacgtaccaagtacgaactatcagcaaccgaaccatacagcagctctgggagttcgacgcactttcctttgactacttcaaggaacggggcacataccccaccgtccaggatctgtacggctgtacgcgcaagaagatagacgtttacatctaccacaccttgcagtccaagtaccccgacattcataagggcaatatgtcaaccaccctccagaagatcatcaagacatggaaatccaggaggaacgagatccggaagggcgagatgagcatcccttcattccgcaaccgtatccctatcgacctccacaacaactctgttgacattactaaggagaagaatggagactacatcgcgggcataagcctgttctccagagacttccacaaggagaacgacgacgtgcctaagggcaaaatcttcgtcaagctggcaacccagaagcagaaatccatgaaggtgatcctggataggctcattaaccagacttattctaagggagcctgcatgatccacaagtacaagaacaagtggtacttgtcaattacctacaagttcaacgccattaaggaaaacaaattcgacaaggagctgataatgggaattgacctcggagggatcaacacggtgtacttcgcattcaacgaggggttcatccgctccaacattaagtctgacgagatcaagatgttcaacgaaaggatcaggcaaaggcggataaacctgctcaaacagtccaagtactgctccaatagtagaaccggcaaggggaggacgaagcgccttcagcctattgacgtgctctccaataagattgcgaagttccgcaacagcacaaaccacaagtacgcgaattacattgtcaagcagtgcctaaagcacaactgtggtagaatccaaatggaactgctaaaaggaatttccaagaacgacaagatcctaaaggactggacctacttcgacctacaggaaaaaatcaagaaccaggccgagattcacgggattgaagttatcaaggtcgcaccggcctacacctcccagcggtgctctcagtgcgggtacatctgcaaggagaaccggtgcactcaggcgacattcgagtgcaagcagtgcgggtacaaaactcacgccgactacaacgccgccaagaacataagtacctacgacattgagaacatcattaacaagcaactagccgtccagtcgaagctccactccaaaaagtgtatggaggagtacatcgaggagtacatcgaggagctgggttaccttgactag

SEQ ID NO: 2921 - DNA, 1368 bp, Unknown
  Bacillus sp. multi
ctgggcgtcactattaagatcatgaagtaccagatcctctgccccatgaacgtggactggatcatcttcgaaaagcacttgcggaacctcacctatcaagtaaggacgataagcaaccggaccatccagcaactgtgggagttcgacgccttgagcttcgactacttcaaggagcgcggaacatatcccacggtccaagacctttacggatgtactcgcaaaaaaatcgacgtttacatctaccatactctacagtcgaagtatccggacatccacaaggggaatatgtcaaccacgctccagaagattatcaagacctggaaatctcgtaggaacgaaatacgcaagggagagatgtccatcccttcgtttcgcaaccgcatcccgattgacttacacaacaactcggtggacatcacgaaggagaagaatggggactacatcgctggcatctccttgttctctagggacttccacaaggaaaacgacgacgtgcctaagggcaaaatcttcgtgaagctggccacgcagaagcagaagtccatgaaggttatcctggaccgactcatcaaccagacctactcgaagggcgcgtgcatgattcacaagtacaagaacaagtggtatcttagcataacttacaagttcaacgccattaaggaaaacaaattcgacaaggagctgattatgggaatcgacttgggtggcatcaataccgtttacttcgccttcaacgagggattcatacgcagtaacatcaagtcggacgagatcaagatgttcaacgagcgaatccggcagaggaggatcaacctcttaaaacagtccaagtactgctccaattcaagaacagggaaggggcgcacgaagcggctccagccaattgacgtgctgtcaaacaagatcgcaaagttccgaaactccacaaaccataagtacgctaactacatcgtgaagcagtgccttaagcacaactgcgggcgaatccaaatggagcttctcaagggaatctccaagaacgataagattctcaaggactggacgtacttcgacctacaggaaaaaatcaagaaccaggccgagatccacgggatcgaggtgattaaggtcgctcctgcttacaccagtcagcgctgttcccagtgcgggtacatctgcaaggagaatcgctgcacccaggcaacgttcgaatgcaagcagtgcgggtacaagacccacgcggactacaacgccgccaagaacatcagcacctacgacattgagaacattatcaataagcagcttgcagtccagtctaagctccactccaagaagtgtatggaggagtacattgaggagtacattgaggaactgggttacttggactaa

SEQ ID NO: 2922 - DNA, 1368 bp, Unknown
  Bacillus sp. multi
ctcggcgttactatcaagatcatgaagtaccagatactctgcccgatgaacgtggattggatcatattcgaaaagcacctccgcaacttgacctaccaagtgcggactatcagtaaccggaccatccagcagctttgggagttcgacgcactcagtttcgactacttcaaggaaagaggcacgtaccccaccgtgcaagacctctacggctgcacccgcaagaagatagacgtttacatctaccacacactccaaagtaagtacccagacatccacaaggggaacatgagcaccactctccagaagatcattaagacttggaaatcgaggcgcaacgagattcgcaagggtgaaatgtcgattccgagcttccggaaccgaatccctatcgacctccacaacaactcggttgacattacgaaggagaagaacggggactacatcgcgggtatctctctattcagccgggacttccacaaggaaaacgacgacgtgccgaagggcaagatattcgttaagctggccacacagaaacagaagtccatgaaggtcattcttgacaggctcattaaccagacgtactctaagggagcgtgcatgatccacaagtacaagaacaaatggtacttgtcaatcacctacaaattcaacgctatcaaggagaacaagttcgacaaggagctgattatgggcattgacctgggcggtatcaacactgtttactttgcgttcaacgaggggtttatccgttccaacattaagtcagacgagatcaagatgttcaacgaacgcatccgccaaaggcggatcaacttactcaagcagtctaagtattgttcgaactcacgaactgggaagggccgcactaagcgactacagccaattgacgtgctatccaacaagatcgccaaattccgcaactctacgaaccacaagtacgctaactacatcgtgaagcagtgcctaaaacacaactgcggacgcatccaaatggaattgttaaagggcatatctaagaacgacaagatcctcaaggactggacctacttcgacctccaggagaagatcaaaaaccaggccgagattcacggcatcgaagtcatcaaggtggcccctgcatacaccagccagagatgctcccagtgcgggtacatctgtaaggagaatcgctgtactcaagcgaccttcgagtgcaagcaatgcgggtacaagacccacgcggactacaacgcagccaagaacatcagcacgtacgacatcgagaacatcatcaacaagcaactggcggtccagagcaagctgcactccaagaagtgtatggaggagtatatcgaggagtacattgaggaactgggctaccttgactaa

SEQ ID NO: 2923 - DNA, 1368 bp, Unknown
  Bacillus sp. multi
ctgggtgtcacgatcaagatcatgaagtaccagatcctctgccccatgaacgtggattggatcatattcgagaagcacctccgtaaccttacctaccaagtacgaacaatcagtaacagaaccattcagcagctctgggagttcgacgcgctgtctttcgactacttcaaggagcgcggaacgtatcccaccgtccaagacctctacggttgcactcgcaaaaaaatcgacgtttacatctatcatacactacaatctaagtatccggacatccacaaggggaacatgagcaccacgttacagaagattatcaagacctggaaatcccggcggaacgagatccgtaagggcgagatgtccatcccttcgttccgtaaccgcatccccatcgacctccacaacaactccgtggacattactaaggagaagaatggcgactatatcgctggcattagcctgttctctagggacttccacaaggaaaacgatgacgttcctaaggggaaaatcttcgttaagctggccacgcagaagcagaagtcgatgaaggtcattctcgaccgccttatcaatcagacctactctaaaggagcctgcatgattcacaagtacaagaacaaatggtacttgtcaatcacctacaaattcaacgccatcaaggagaacaaattcgacaaggagctgataatggggatcgacctgggtgggatcaataccgtgtacttcgcattcaatgagggcttcatccgcagcaacatcaagtcagacgagatcaagatgttcaacgaacggataaggcagcggcgcatcaacctgctcaagcagtccaagtattgcagcaacagccgaactggaaaggggcgcaccaagcgcctccagcccattgacgtgctctcaaacaaaatcgctaagttccgaaactcgacgaaccataagtacgcaaactacatcgtgaagcagtgccttaagcacaactgtggccgtatccagatggagttgctcaagggcatcagtaagaatgacaaaatcttgaaggactggacttacttcgacttacaggagaagatcaaaaaccaggccgagatccacgggatcgaggttattaaggtggctcctgcctacacctcccagagatgctcacaatgcggctacatctgcaaggagaaccgctgcacccaggccaccttcgagtgcaaacagtgcgggtacaaaacgcacgccgactacaatgcagccaagaacatctccacctacgacatcgagaacatcatcaacaaacagcttgccgttcagtctaaactgcactccaaaaagtgtatggaggagtacatcgaggagtatatcgaggaacttggctaccttgactaa

SEQ ID NO: 2924 - DNA, 1368 bp, Unknown
  Bacillus sp. multi
cttggcgtcacgattaagatcatgaagtaccagatcctgtgcccgatgaacgttgactggatcatattcgagaagcacctccgcaacctgacttaccaagtccgaacgatcagcaacagaactatccagcagctttgggagttcgacgcgctctcgttcgactacttcaaggagcgaggcacgtaccccaccgttcaagacctatacggctgcacacgcaagaaaatcgacgtttacatctatcataccctacagtcgaagtatcctgacatccacaagggcaatatgtccacaaccttgcagaagatcattaagacatggaagtcacgccgtaacgagatacgcaaaggcgaaatgtccatcccttcattccgtaaccggattccgattgacctccacaacaacagcgtggacatcacgaaggagaagaacggggactacatcgctggtatctcactcttcagccgcgatttccataaggagaacgacgacgtgccaaagggcaaaatcttcgtgaaactcgcaacgcagaagcagaaatccatgaaggtgatacttgacaggctcatcaatcagacctacagcaagggagcgtgcatgattcacaagtacaagaacaagtggtacttgagcattacttacaagttcaacgcgattaaggagaacaaattcgacaaggagctaatcatggggatcgacctcggcggtattaacacggtttacttcgcgttcaacgagggcttcatccgtagcaacattaagtccgacgagatcaagatgttcaacgagcgtatcaggcagcgtcggatcaacctgctaaaacagtccaaatactgttccaacagccgaaccggcaaggggcgtacgaagcgcttgcagccaatcgacgtgctgagcaacaagatcgccaaattccggaacagcacaaaccacaagtacgcgaactacatcgtcaagcagtgcctcaaacacaactgcgggcgcatccaaatggagttgttaaagggcattagcaagaacgacaagattctcaaagactggacttacttcgacctccaggaaaaaatcaagaaccaggcggagattcacggtatcgaagttattaaggtggccccagcctatacttcgcagagatgctcacagtgcggctatatctgtaaggagaaccgctgcacacaggcaacgtttgagtgcaagcagtgtggctacaaaacccacgccgactacaacgcggccaagaacatctctacctacgacattgagaacatcatcaacaaacaacttgccgtgcagtccaaactccatagcaaaaaatgcatggaggagtacattgaggagtacatcgaggaattggggtacttggactaa

SEQ ID NO: 2925 - DNA, 1335 bp, Unknown
  Bacillus sp. multi
atgaagtaccagatcctctgcccgatgaacgtggactggactatcttcgagaagcacctgaggaatctcacgtaccaagtccgaacgatctccaacaggaccatccagcagttatgggagtttgacgcattgtcgttcgactacttcaaggaacgcggaacctatccaactgtccaagacctttatggctgcacacagaagaaaatcgacggctacatctaccacaccctccaaagcaagtatccagacatccacaaggggaatatgagcactacactccagaagattatcaagacatggaaatccagaaggaacgagatacgcaaaggcgagatgtctgttccctccttccggaaccacatacccatcgacatccacaataactctgttgacattactaaggaaaaaaacggagattacatcgcgggaatctcacttttcagccgtgacttccacaaggagaacggggacgtgcctaaaggcaaaatcttcgtgaagctaagcacacaaaagcagaagtccatgaaggtgatcctggaccgacttatgaaccagacctacagcaagggtgcttgcatgatccacaagtacaagaacaagtggtacttgagcatcacatacaaattcaacgcgatcaaggagaacaagttcgataaggacttgataatggggatcgacatgggtggcattaacacagtgtacttcgctttcaacgaggggttcatccggtcaaacattaagtccgacgagattaaggcgttcaacgagcgcatcaggcagcgccgcatcaacctgcttaaacagagcaaatactgctccaactcccgcactggcaaggggagggagaagcgcctccagccaattgatgtcctcagcaacaagattgccaagttccgtaacagcactaaccacaagtatgctaactacatcatcaagcagtgcctcaagcacaactgtggtcgcattcacatggagttgcttaaggggatctctaagaacgacaaagtgctcaaggactggacctatttcgacctacaggagaagatccaaaatcaggccgagatccacggcatcgaggttattaaggttgctcctgcatataccagccagcgctgctcgcagtgcggctacatctgtaaggaaaatcgctgcacgcaagccgtctttgaatgcaaacagtgcgggtacaagactcacgccgactacaacgccgccaagaatatcgcaacctacgacatcgagaacatcatcaacaagcaattggccgtgcagtctaagctccacagcaagaagtgtatggaggagtacatcgaggagcttggctacctcgactga

SEQ ID NO: 2926 - DNA, 1335 bp, Unknown
  Bacillus sp. multi
atgaagtaccagatcctctgtcccatgaacgtggactggactatcttcgagaagcacttgaggaacctcacgtaccaagttcgcaccatctccaatcggactattcagcagctctgggagttcgacgccctgtcctttgactacttcaaggaacgcggaacgtatccgaccgtacaagacctctatggctgtacgcagaagaagatagacggctacatctaccacaccctgcaatccaagtacccagacatccataagggcaacatgagcaccacgctacagaaaatcatcaagacttggaagtctcgtcgcaacgagatccgcaagggcgagatgtctgtgcccagcttccgcaaccacatccctattgacattcacaacaactcggttgacataactaaggagaagaacggagactacatcgctggtatatccctattctcgcgcgacttccacaaggagaacggggacgttccgaagggcaagatattcgttaagctctctacacagaagcagaagtccatgaaggtgattctggatcgccttatgaaccagacctatagcaagggtgcctgcatgattcataagtacaagaacaagtggtacttatcaatcacctacaagttcaacgctatcaaggaaaacaaattcgacaaagacttaatcatggggatagacatgggagggatcaacactgtttacttcgccttcaacgaggggttcatccggagtaacatcaagtcagacgagatcaaggcgttcaacgagcgcatccgccagaggaggatcaacctcctcaaacaaagcaagtactgctccaactcaaggaccggaaagggacgcgagaagcgcttgcagcctattgacgtcctcagcaataagatcgccaaattccgcaatagcaccaaccataagtacgcgaactacatcatcaagcaatgcttgaaacacaactgcgggcgcatccacatggagctgttaaaaggaatcagcaagaacgacaaggtgctgaaagactggacttacttcgatctacaggaaaaaatccagaaccaggccgagatacacggtatcgaagttattaaggttgctccggcctatacctcccagaggtgcagccagtgcgggtatatctgcaaggaaaaccgctgcacccaggcggtcttcgaatgcaagcagtgcgggtacaaaacccacgcggactacaacgccgccaagaacatcgcaacctacgacatcgagaatatcatcaacaagcagttggctgtgcagagtaagctgcactccaaaaagtgtatggaggagtacatcgaggaactcggatacttggactga

SEQ ID NO: 2927 - DNA, 1335 bp, Unknown
  Bacillus sp. multi
atgaagtaccaaatactgtgccccatgaacgtggactggacgatattcgagaagcaccttcgcaacctcacatatcaagtaagaactatatccaatcggactattcagcaactctgggagttcgacgccttgagtttcgattactttaaggagcggggaacataccctacggtccaagacttgtacggctgcacgcaaaaaaaaattgacgggtatatctatcacacccttcagtcaaagtaccccgacatccacaaggggaatatgagcacaaccctccagaagattatcaagacctggaaatcacgtcgcaatgagatacgcaagggcgagatgtccgtgccctccttccgtaaccacatccctatcgacatccacaacaatagcgtggacatcactaaggagaagaatggggactacatcgccgggatctctctattctcgcgggacttccacaaggagaacggggacgttcctaagggcaaaatcttcgtaaaactaagcacccagaagcagaagtcgatgaaggtgatactcgaccggctcatgaaccagacatactctaagggagcgtgcatgatccacaagtacaagaataagtggtacttgtccattacttacaaattcaacgccatcaaggagaacaagttcgacaaagacctcatcatggggattgatatgggcgggatcaacactgtttacttcgccttcaacgagggcttcattcggagtaacattaagtcagacgagattaaggcgttcaatgagcggatcagacaaaggcgcatcaacctcctaaaacagagcaagtactgttccaatagtcggactggcaaggggcgcgagaagcgtcttcagcccatcgacgtacttagcaacaagatagcaaagttccgaaacagcaccaatcacaagtacgccaactacatcatcaagcagtgcctcaaacacaactgcggtcgtatccacatggaattactcaaggggatcagcaagaacgataaggtcttgaaggactggacctacttcgacctacaggaaaaaatccagaatcaggcggagatccacggcatcgaggttattaaggtggcccctgcctatacgagtcagaggtgctcacagtgcggctacatctgcaaggagaaccgctgcacccaggccgttttcgagtgcaagcagtgcggctacaagacccacgctgattacaatgccgccaagaatatcgctacctatgacattgagaacatcatcaacaagcagctcgccgtgcagtcgaagctgcactccaagaagtgtatggaggagtatatcgaggaactgggatacttggactga

SEQ ID NO: 2928 - DNA, 1335 bp, Unknown
  Bacillus sp. multi
atgaagtaccagatcctgtgccctatgaacgtggactggaccatcttcgagaagcacctgaggaacttgacctaccaagttagaacaataagcaatcgcaccatacagcagctttgggagtttgacgcgctctcattcgactacttcaaggaaaggggaacctacccgaccgtccaagacctctatggctgcacccaaaaaaagatcgacggctacatataccacacactccagtcaaagtaccccgacatccacaagggcaatatgtccaccaccctccagaagattatcaagacttggaaatcacggaggaacgagatacgcaaaggcgagatgtccgtcccctccttccggaaccacatcccaattgacatccacaacaactccgttgacattacgaaggagaagaacggagactacatcgctgggatctcattgttcagtagggacttccacaaggagaacggcgacgtgcctaagggcaagatattcgtcaaactctctacccagaaacagaagtccatgaaggtgatcctcgaccggctcatgaaccagacctacagtaaaggagcgtgcatgatccacaagtacaaaaacaaatggtacttgtcaatcacctacaaattcaacgctatcaaggagaacaagttcgacaaagacctcataatgggaatagacatgggagggataaacacagtttactttgcgttcaacgagggcttcatccgcagcaacatcaagagcgacgagattaaggcgttcaatgagcgcattagacagcgccgcatcaacttgttaaaacagtccaagtactgctccaactctcggacagggaaggggagggagaaacgattgcagcccattgatgtgctcagcaacaagatagcgaagttccgtaattccaccaaccacaagtatgctaactacatcattaagcagtgcctcaagcacaactgcggacgtattcacatggaactgctaaaggggatttccaagaacgacaaggtgctcaaggactggacatacttcgatctacaggaaaaaatccaaaaccaggctgagatccacgggatcgaggttatcaaggtggcacccgcctacacgagtcagaggtgctcgcagtgcggctatatctgtaaggagaaccgctgcacccaggcggtgttcgagtgtaagcagtgcggctacaagactcacgccgactacaacgccgccaagaacatcgcaacttatgacattgagaacattatcaataagcagctcgctgttcagtccaagctccactccaagaaatgcatggaggagtacattgaggagctgggctacttagactag

SEQ ID NO: 2929 - DNA, 1335 bp, Unknown
  Bacillus sp. multi
atgaagtaccagattctctgccctatgaacgtggactggaccatcttcgagaagcacctccggaacctgacgtaccaagtgcgtacaatatccaaccgtaccatccagcagctctgggaatttgacgctctatccttcgactatttcaaggagcgcggaacttatccaacggtccaagacttgtacggctgcacccaaaaaaagattgacggttacatctaccacacacttcagtccaagtaccccgacatccacaagggcaatatgagcacaaccctacagaagattatcaagacttggaaatctcgtcgcaacgagatcaggaagggagagatgtccgtgcccagtttccgcaaccacatccctatcgacatccacaacaattccgttgacatcacaaaggagaagaatggggactacatcgccggtatctccctgttcagtcgagacttccacaaggagaacggcgacgtgccgaagggcaaaatcttcgtgaagctaagtacccagaagcagaagtcgatgaaggtcatcctggacaggcttatgaaccagacctacagcaagggagcctgcatgatccacaagtacaagaacaagtggtacttatctattacttacaaattcaacgcgattaaggaaaacaagttcgacaaagacctcatcatgggaattgacatgggcgggataaacacggtgtactttgcgttcaacgaggggttcatccgctccaacatcaagagtgacgagattaaggcgttcaacgagcgtatccggcagaggcgcatcaaccttctcaagcagtccaagtattgttcgaactctaggaccgggaaggggcgtgagaaaaggctccaacccattgatgttctgtcgaacaagatagccaaattccgtaatagtacaaaccacaagtacgccaactacatcatcaagcagtgcttgaaacacaactgcgggagaatccacatggaactgctcaaaggaatctccaagaacgacaaggtgttgaaggactggacctactttgacctccaggaaaaaatccaaaaccaggccgagattcacgggatcgaagttattaaggtggcccctgcttacacctcacagaggtgctcgcagtgcggctacatctgtaaggaaaaccgttgcactcaggcagtattcgagtgcaagcagtgcgggtacaagacacacgccgactacaacgccgccaagaatatcgcaacctacgatattgagaacatcatcaacaaacagctcgctgtgcagtccaagttgcactccaagaagtgtatggaggagtacatcgaggagctgggctacctggattga

SEQ ID NO: 2930 - DNA, 1338 bp, Unknown
  Bacillus sp. multi
ctcggagtgactattaagatcatgaagtaccagatactctttccactcaacgtggattggaccatcttcgagaagcaccttcgcaacctcacctaccaagtcaggaccatcagtaaccggacgatccagcaactctgggagttcgacgccttgagtttcgactatttcaaggaacgtggaacctacccgaccgtccaagacctttatggctgcactcaaaaaaagattgacggctacatctaccacaccctccagagcaagtaccctgacattcacaagggcaatatgagcacaacgctccagaagatcatcaagacgtggaaatcgaggcggaacgagatacgcaaaggtgaaatgtcgatccctagtttccgaaaccgcatcccaatcgaccttcacaacaactctgtggacattacgaaggagaagaatggggactacatcgcggggatttccttgttcagtcgggacttccataaggagaacgatgatgttccgaagggcaaaatcttcgtgaaactcgccacacagaagcagaagtctatgaaggtgatcctggatagactcatcaaccagacttactctaaaggggcctgcatgatccacaagtacaaaaacaagtggtatctgagcatcacctacaaattcaacgctatcaaggagaacaaattcgacaaggaactgattatgggaattgacctcggtgggatcaataccgtttactttgcattcaacgagggcttcatcaggagcaacattaagtcggacgagattatccgccaacggcggatcaacctactaaagcagtccaaatattgctccaattcacggactggcaagggacggaccaagcggctacagcccatcgacgtgcttagcaacaagatcgccaaattccgtaactccacgaaccacaagtacgcgaactacatcgttaagcagtgccttaagcacaactgcgggcgcattcagatggaactcctcaagggcatctccaagaacgaccgtatcctgaaagactggacgtacttcgatctccaggaaaaaatcaagaaccaggcggagatccacggaatagaggtcatcaaggtggctcccgcctacacctcccagcgctgctcgcagtgcggctatatctgcaaggaaaatcggtgcacccaggccaccttcgaatgcaaacaatgcggctacaagacccatgcagactacaacgctgctaagaacatctccacttacgacatcgagaacatcatcaacaaacaattggccgtgcagtcgaagttgcactccaagaaatgcatggaggagtacatcgaggaactgggctatctggactag

SEQ ID NO: 2931 - DNA, 1338 bp, Unknown
  Bacillus sp. multi
cttggggttaccatcaagatcatgaagtaccaaatacttttcccacttaatgtggactggacaatcttcgagaagcacctccggaacctgacctaccaagtcagaaccatctcaaatcgtactatccaacagctatgggagtttgacgcgctcagcttcgactacttcaaggagcggggcacctaccccaccgtccaagacttgtacggatgcacacagaagaagatcgacggttacatctatcacacccttcagagcaagtaccccgacatccacaaggggaatatgtcaactactctccagaagattatcaagacatggaaatctcgtcggaacgagatccgcaagggcgaaatgtccatcccctccttccgcaacaggataccaatagacctacacaacaattccgttgacattactaaggaaaaaaacggggactacatcgctgggatctccctgttctcccgcgacttccataaggaaaacgatgacgtgccaaaagggaagatattcgtgaaactggccacccagaagcagaagtccatgaaggtgatcctggacaggctgattaaccagacgtactctaaaggggcgtgcatgattcacaagtacaagaataagtggtatctcagcatcacgtacaagttcaacgctattaaggagaacaaattcgacaaggagcttatcatgggcattgacctcggtgggataaacaccgtttacttcgctttcaacgagggcttcatccgaagcaacattaagtcagacgagatcatccgccagaggaggatcaacctgctgaaacagagcaagtactgtagtaactctcgtaccgggaagggacgcactaagcgacttcagccgattgacgtgctgagcaacaagatcgccaagttccgcaactcgacaaatcacaagtacgcaaactacatcgtgaagcagtgcttgaaacacaactgcgggcggatacagatggagttgcttaaggggattagcaagaacgacagaatccttaaagactggacgtacttcgacctccaggaaaaaatcaagaaccaggccgagatccacggcattgaggtcatcaaggtggccccggcctatacgtcacagcggtgctcacagtgcggttacatctgcaaggagaaccgatgcacacaggctactttcgagtgtaaacagtgcggatacaagactcacgccgactacaacgcggctaagaacatctcaacgtacgacattgagaacatcatcaacaagcagctcgccgttcagagtaagctacactccaagaagtgtatggaggagtacatcgaggagcttggctacctcgactag

SEQ ID NO: 2932 - DNA, 1338 bp, Unknown
  Bacillus sp. multi
ctgggcgtgaccatcaagattatgaagtaccagatcctgtttcctctaaacgtggactggaccatcttcgagaagcacctccgtaacctcacctatcaagtccgaaccatcagcaacaggactatccaacaactttgggagttcgacgcgctttccttcgactacttcaaggaacgcggcacctacccgaccgtccaagacctctacggctgcacccagaagaaaatcgacgggtacatctaccacactctacagtcgaagtaccctgacatccataagggaaacatgagtaccacgctccagaagattatcaagacgtggaaatcacggaggaacgagatcaggaaaggagagatgtcgatcccgtctttccgtaaccgcattccgattgacctgcacaacaactccgtggacattactaaggagaagaatggcgactacatcgctggaatatctctgtttagccgcgacttccacaaggaaaacgacgacgtgcctaaggggaagatattcgtgaaactcgctacccagaagcagaagtccatgaaggtgattcttgatcggctcattaaccagacttactcaaagggcgcttgcatgatccataagtacaagaacaaatggtatctgtcaatcacatacaagttcaacgccattaaggagaacaaattcgacaaggagctaatcatggggatcgacctgggcggcatcaacacggtttacttcgcattcaacgagggcttcatccgctccaacatcaagtctgacgagatcatccgacaaagacggattaacctccttaagcagtccaaatattgttcaaattcccggacagggaagggcagaactaaacgtttgcagccgattgacgtgctcagcaataagattgccaaattccggaacagcactaaccacaagtacgccaactacatcgtgaagcagtgccttaaacacaactgtgggcgtatccaaatggagctgctcaagggtatttccaagaacgaccgaatcctcaaggactggacgtacttcgacctccaggagaagattaaaaaccaggccgagatccacgggatcgaagttatcaaggtggcacccgcatacaccagccagaggtgctcccagtgcggctacatctgcaaggagaacagatgtacccaggctacgtttgagtgcaaacagtgcgggtacaagacccatgctgactacaacgcggccaagaacatatccacctacgacattgagaacatcatcaacaagcagttggccgtccagagtaagttgcatagcaagaaatgcatggaggagtacatcgaggagttgggctatttggactag

SEQ ID NO: 2933 - DNA, 1338 bp, Unknown
  Bacillus sp. multi
ctcggcgtgaccatcaagattatgaagtaccagatcctgttcccgctgaacgtggactggactatcttcgagaagcacctccggaacttgacctaccaagttcggacgatctccaacaggacgatccagcagctttgggagtttgacgcattgtccttcgactacttcaaagagcgcggcacataccccaccgtacaagacctctatggatgcacccagaagaagatcgacgggtacatctaccataccttacaatcgaaatacccagacatccacaagggcaacatgagcactaccctacaaaaaatcatcaagacatggaagtctcgccgtaacgagatccggaagggcgagatgtcaatcccatcattccggaaccgcataccaattgatctccacaacaactctgttgacattactaaggaaaaaaacggcgactacattgcgggcatctcacttttcagtcgtgactttcacaaggagaacgacgacgtgcccaaaggcaagatattcgttaaactggccactcagaagcagaagtccatgaaggtgatcctggacagactcatcaaccagacctactctaagggtgcctgcatgattcacaagtacaagaataagtggtacttgtctatcacatacaagttcaacgcgatcaaggagaacaaattcgacaaagagctaatcatgggaatcgacctgggtggcatcaacacagtgtacttcgcattcaacgagggcttcattcgctcaaacatcaagagcgacgagataatccgccagaggaggatcaaccttctcaaacagtccaagtactgctcaaattcgcgcaccggaaaaggacgcactaaacgccttcagccaatcgacgtcctgtcaaacaagatagccaagttccgaaatagtaccaatcacaagtatgccaactacatcgtgaagcagtgcttgaagcacaactgcgggaggatacagatggaactgcttaagggcatctccaagaacgaccgtatcctgaaagactggacctacttcgacctacaggagaagatcaaaaaccaggcggagatccacgggatcgaagttattaaggtggctccagcctacactagccagcgatgcagtcaatgcggctatatctgtaaggagaaccggtgcacacaggccacgttcgagtgcaagcagtgcgggtacaaaacgcacgctgattacaacgctgccaagaacatctcaacctacgacatcgagaacattatcaataagcagctcgctgtgcagtcgaagctccacagcaaaaagtgtatggaggagtacatcgaggagctgggctacttggactga

SEQ ID NO: 2934 - DNA, 1338 bp, Unknown
  Bacillus sp. multi
ttgggagtgaccattaagatcatgaagtaccagatcctgttcccactaaacgttgactggaccatattcgagaagcacctccgtaacctaacgtaccaagtcaggacaatctcgaaccgcacgatccagcagttgtgggagttcgacgctctatccttcgactacttcaaggagcgcggtacttaccctaccgtccaagacctctacggctgcacacaaaaaaagatagacggctacatctaccacacactccagtcgaagtacccagacatacacaagggcaacatgagcaccaccctccagaagattatcaagacttggaaaagccgacggaacgagatccgtaagggcgagatgtctatcccatccttcagaaaccggatacccatcgaccttcacaataactcggttgatattacaaaggagaagaacggtgactacatcgcggggatcagtctgttctcgcgcgacttccacaaggagaacgatgatgtgcctaaagggaaaatcttcgttaagctcgcaacacagaagcagaagtccatgaaggtgatattggaccgtctcatcaaccagacttactcaaagggagcgtgcatgatccataagtacaagaacaagtggtacttgtccatcacttacaagttcaacgcgatcaaggagaacaaattcgacaaggagctgataatgggaattgacctgggtgggataaacacagtgtactttgccttcaacgagggattcatccggtcgaacatcaagtccgacgagatcatccgtcagagacgcatcaatctgctaaagcagtccaagtactgtagcaactccaggactggcaaggggcgaacaaagcgtcttcagcctattgacgtcctgtccaacaagatcgccaagttccgtaattctacgaaccacaagtacgccaactacatcgtgaagcagtgccttaagcacaactgcgggcggatacaaatggagctgttgaagggcatatccaagaatgacagaatacttaaggactggacctactttgacctccaggaaaaaatcaagaatcaggccgagatacacggcattgaggtgattaaggtcgcgcccgcctatacaagtcagcgctgctcccagtgcggctatatctgcaaggagaaccgatgtacccaagctacgttcgagtgcaaacagtgcgggtacaagacacacgcagactacaacgccgccaagaatatctccacttacgatattgagaacatcatcaacaaacagctcgccgtgcagagcaagctgcattccaaaaagtgtatggaggagtacatcgaggagctgggctacctggactag

SEQ ID NO: 2935 - DNA, 1338 bp, Unknown
  Bacillus sp. multi
ctcggggtcaccatcaagattatgaagtaccaaatcctatgcccgctgaatgtggactggacgatcttcgagaagcacctgaggaacctcacctaccaagtcagaaccatcagcaaccgcaccatccagcaattgtgggagttcgacgccttgtctttcgactacttcaaggaacgtggaacatatcccaccgtccaagacctctacggctgcacccagaagaaaatcgacggctacatataccatacccttcagtccaagtacccggacatccacaagggcaatatgtccactacactccaaaaaatcatcaagacctggaagtcgcgccgaaacgagattcgtaagggtgagatgagcatcccgagtttccgcaaccgaatccccatcgacctgcacaacaacagcgtggacatcacgaaggagaagaacggtgactacattgcgggtatctcattgttcagcagagatttccacaaggaaaacgacgacgtgcctaagggcaagatattcgtaaagctggcaacgcagaagcagaagtctatgaaggtgatcctcgaccgcctcatcaaccagacatactctaagggagcttgcatgatccacaagtacaagaacaagtggtacttatcaataacgtacaaattcaatgctatcaaggagaacaagttcgacaaggagctaatcatggggatagacctgggtgggatcaacactgtctatttcgcattcaacgaggggttcattcgatccaatatcaagagcgacgagatcatccgccagcggaggataaacctcttaaagcagagcaagtactgtagcaactctcgcaccggcaagggccgcactaagcgcttgcagccaatcgacgtcctcagcaacaagatcgccaagttccgtaactcgaccaaccacaagtacgcaaactacatcgtgaagcagtgcttaaaacacaactgcgggagaatccagatggagttactcaagggcatctccaagaacgaccgaatcctcaaggactggacctacttcgacctccaggagaagatcaaaaaccaggcagagatccacggcattgaagttattaaggtggcaccagcatacaccagtcagaggtgcagtcagtgcggctacatctgcaaggagaaccggtgcacccaggctacgtttgagtgtaagcagtgcggctacaaaacccacgcagattacaacgcggccaagaatatctccacttacgatattgagaacattatcaataagcagttggcggtgcagtccaagctacactccaaaaaatgcatggaggagtacattgaggaactgggctacttagactag

SEQ ID NO: 2936 - DNA, 1338 bp, Unknown
  Bacillus sp. multi
ctgggcgtgaccatcaagattatgaagtaccagatactctgccctctgaacgtggattggacgatcttcgagaagcacttgaggaacctcacgtaccaagtaaggactatctccaaccgcaccatccagcagctctgggagttcgacgccttgtcctttgactacttcaaggagcgtggcacgtaccctaccgtccaagacctctacggctgcacccagaagaaaatcgacggctacatataccacacactccagtcaaagtatcccgacattcacaaggggaatatgagcactaccctccaaaaaatcatcaagacttggaaatcacggcgaaacgagatccgcaagggcgagatgtcgatccccagctttcgcaaccgcatccctatcgacctgcacaacaactctgttgacataactaaggagaagaatggtgactacatcgccggaatctcgctgttcagccgtgacttccacaaggaaaacgacgacgttccgaaggggaagatattcgtaaagttggccactcagaaacagaagtctatgaaggtcattctcgacagacttattaaccagacatacagtaagggtgcctgcatgattcacaagtacaagaacaagtggtacttgtctatcacctacaagttcaacgccattaaggagaacaagttcgacaaggagctgattatggggatcgacctgggcgggattaacaccgtttacttcgcattcaatgagggcttcatccgttccaacatcaagtctgacgagataatcagacagcggaggatcaacctgctcaagcagagtaagtattgcagcaactcgcgtaccggaaaggggcgtaccaagcgcctacagccgatagacgtgcttagcaacaagatagccaagttcagaaacagtacaaaccataagtatgcaaactacatcgtcaagcagtgccttaaacacaactgcggccgaatccagatggagctacttaaggggattagcaagaacgacaggatactcaaagactggacttacttcgacctccaggaaaaaattaagaaccaggcggagatccacggtatcgaggtcatcaaggttgctccagcctacacaagtcaaaggtgcagtcagtgcgggtatatctgcaaggagaacagatgcactcaggcgaccttcgaatgtaaacagtgcggctacaagacacacgcggactacaacgcagccaagaacatcagcacttacgacattgagaacatcatcaataagcaactcgccgttcaaagtaagctccatagcaaaaaatgcatggaggagtatatcgaggagttgggttacctcgactga

SEQ ID NO: 2937 - DNA, 1338 bp, Unknown
  Bacillus sp. multi
cttggcgtgaccattaagattatgaagtaccagatcctctgtccgctcaatgtggattggaccatcttcgagaaacacctgagaaatctgacgtaccaagtgaggaccatctccaacagaacaatccagcaactttgggagttcgatgctctgtcgtttgactactttaaggagcgcggcacctacccgaccgtccaagacctgtacggctgcacgcagaagaagatagacgggtacatctaccacacgctccagtcgaagtaccccgacatccacaaaggaaacatgagcaccacgctacagaagattatcaagacgtggaagtcccgaaggaacgagatcaggaaaggagagatgagcatccccagcttcagaaaccgcatccccattgacttgcacaacaactctgtggacattacgaaggagaagaacggtgactacatcgctggtatctcactgttctcacgagatttccacaaggagaacgacgacgtgcctaaggggaaaatcttcgtgaaactcgccacacagaaacagaagtccatgaaggtgatcctagaccgccttattaaccagacctacagcaagggtgcctgcatgatccacaagtacaagaacaagtggtatctgtcaatcacatacaagttcaacgctatcaaggagaacaagttcgataaggagcttatcatgggaatagacctgggcgggatcaacacagtttacttcgctttcaacgaggggttcattcgctccaacatcaagagcgacgagatcatacgtcagcgccgtatcaaccttctcaagcaatccaagtactgttccaactctaggacaggcaagggacgtacgaagcgtctccagcccatcgacgtcctctccaacaagatcgccaagttccgtaacagcaccaaccacaagtacgccaactacatcgtcaagcaatgcctcaagcacaattgcggtcgcattcaaatggagctgttgaaggggattagcaagaatgacaggatacttaaagactggacgtactttgacctacaggaaaaaatcaagaatcaggccgaaatccacggcatcgaagttattaaggtcgctccagcatatacttctcagcgctgttcacagtgcgggtacatctgtaaggaaaatcgttgtacccaggccacgttcgagtgcaaacagtgcggctacaagactcatgccgattacaatgccgctaagaacataagcacctacgacatcgagaatatcatcaacaagcagcttgcggtccagagcaaactgcacagcaaaaagtgtatggaggagtacatcgaggagctgggctacctcgactag

SEQ ID NO: 2938 - DNA, 1338 bp, Unknown
  Bacillus sp. multi
cttggagttacgattaagatcatgaagtaccagatcctgtgtccgctcaacgtggactggaccatattcgagaaacacctcaggaaccttacctaccaagttcgtactatctccaaccgcaccattcagcagttgtgggagttcgacgcactctcgttcgactacttcaaggagcgcggaacctaccctaccgtacaggacttgtacggttgtacgcagaagaagattgacggctacatctaccacaccctacaatccaagtaccccgatatacacaaggggaacatgagcaccaccctccaaaaaatcatcaagacgtggaaaagtcgaaggaacgagatccggaagggcgagatgtccatcccgtcattccgcaaccggataccgatagacctgcacaacaacagtgttgatattacgaaggaaaaaaatggggactacatcgcgggcatatctctgttctcccgcgacttccacaaggagaatgatgacgtgcctaaaggcaaaatcttcgttaagctggcgacacagaagcagaagtccatgaaggtcatcctggaccggctcatcaaccagacttactctaaaggtgcctgcatgatccacaagtacaagaacaagtggtatcttagtattacttacaaattcaacgctattaaggaaaacaaattcgacaaggagttaatcatggggatcgacttgggcgggatcaataccgtgtactttgccttcaacgaggggttcattcgctccaacattaagtctgacgagataatccgtcagcgaaggatcaaccttctcaagcagagcaaatattgcagcaattctcgcaccggcaaaggtcgcactaagaggcttcagccaattgacgtcctgagtaacaagatagccaaattccgtaactccacgaaccacaagtatgccaattacatcgtcaagcagtgcctcaaacacaactgcggtcgtatccagatggaacttctcaagggcatctccaagaacgaccgtatcctcaaagactggacatacttcgatctccaggagaagatcaaaaaccaggccgagatccacggcatcgaggtcattaaggttgccccagcatacaccagccagaggtgcagccaatgcgggtacatctgcaaggagaaccggtgcacccaagccacgttcgagtgcaagcagtgcggatacaagacccacgccgactacaacgccgccaagaacatctccacttacgacatcgagaacattatcaacaagcaactcgcagtccagtccaaattacacagcaagaaatgcatggaggagtacatcgaggaactgggttaccttgactag

SEQ ID NO: 2939 - DNA, 1338 bp, Unknown
  Bacillus sp. multi
ctcggggtgaccatcaagatcatgaagtaccaaatcctctgcccgctgaacgtggattggacgatcttcgagaagcacctccgcaacctcacttaccaagtaaggaccatctcgaatcgcaccatccagcagctctgggagttcgacgccctcagcttcgactacttcaaggagcgcggcacttatccaacggtgcaagacctatatggctgcacgcagaagaagatcgacggctatatctatcatacactccagtccaagtatccagacatccacaagggcaatatgagtaccaccttgcagaaaatcattaagacatggaaatctcgccgcaacgagatccgcaagggcgagatgtcaatccccagctttcgtaatcgaatacccatcgacttacataacaacagcgttgacattacgaaggagaagaacggggactacatcgctggcatctccctcttcagtcgtgacttccacaaggagaacgatgacgttccaaagggcaaaatcttcgtgaaactggccactcagaagcagaaaagtatgaaggtgattctcgaccggctcatcaaccagacatacagcaagggtgcctgcatgatacacaagtacaagaataagtggtacttgtccattacttacaagttcaacgcgatcaaggagaacaaattcgacaaagagcttatcatgggaatcgacctcggcggcatcaacacagtctatttcgccttcaacgagggcttcattcgttccaatatcaagagcgacgagatcatccgacagagacgcattaacttacttaagcagagcaagtactgctcaaactcgcgcaccgggaagggccgcactaaaaggctccaacccattgatgtgctttcgaacaagatcgccaagttccgtaactccaccaaccacaagtatgcaaactacatcgtgaagcagtgcctaaagcacaactgcgggcgcatccagatggagctacttaagggaatctccaagaacgaccgaatactcaaagactggacctacttcgatctccaggaaaaaatcaagaatcaggccgagatacacggtattgaagttattaaggtggcaccggcttacacttcgcaacggtgctcccagtgcgggtacatctgtaaggagaaccggtgcacccaggcgactttcgagtgcaagcagtgcgggtacaagacccacgcggactacaacgcggccaagaacatatccacctacgatattgagaacatcattaacaaacagcttgcagtgcagtcgaagctccactccaaaaaatgcatggaggagtatatcgaggaactgggctacctggactga

SEQ ID NO: 2940 - DNA, 1356 bp, Unknown
  Bacillus sp. multi
ttgggagtcaccatcaagattatgaagtaccagatcctttgcccgatgaacgtggactggaccatcttcgaaaagcacctccggaacttaacgtatcaagtccggaccatctccaacaggaccatccaacagctctgggagttcgacgccctgtcgttcgactacttcaaggaacgcggcacctaccccaccgtacaagacctttatggctgcacccagaagaaaatcgacgggtacatctaccacaccttgcagagcaagtaccccgacatacacaaaggaaacatgagcaccacactccaaaaaatcatcaagacctggaaatctaggcgcaacgagatacgaaaaggcgagatgtctatcccgtcgttccgcaaccgcatacccatcgacctccacaacaactcggttgacattacaaaggagaagaacggggactacatcgctggaatctccttattccttcgggacttccacaaggagaacggcgatgttccgaagggcaaaatcttcgttaaactgtccacacagaagcagaagtctatgaaggttatcctcgaccgcctcatgaaccagacgtacagcaaaggagcgtgcatgatccataagtacaaaaacaagtggtatctctccatcacctacaagttcaacgctatcaaggagaacaagttcgacaaggaactaatcatggggattgatatgggcggcatcaacacggtttactttgccttcaacgaggggttcattagatccaatatcaagtctgacgagatcaagatgttcaacgagcgcatccggcagaggcgcatcaacctgttaaagcaaagcaagtattgctccaactcacgaatcgggaaaggaaggacaaaacggcttcaacccattgatgtgctgagtaacaagatagccaagttccgtaacagcaccaaccacaagtacgcaaactacatcgtgaagcagtgcttgaaacacaactgcgggaggatacaaatggaactgttaaagggtattagcaagaatgacaaaatcttgaaagactggacctacttcgacctacaggaaaaaatcaagaaccaggctggcatccacggaattgaggtcattaagatagcgcctgcctacacctcccagcggtgcagccagtgcgggtacatctgcaaggagaatcggtgcacccaggcagtattcgagtgcaagcagtgcggctacaagacccacgctgactacaacgcagctaagaacatcagcatctacgacattgagaacatcattaacaagcaattggccgtccagagtaagctccacagcaaaaaatgcatggaggagtacatcgaggaactgggctatctggactga

SEQ ID NO: 2941 - DNA, 1356 bp, Unknown
  Bacillus sp. multi
ctcggggtgactatcaagattatgaagtaccaaatcctctgccccatgaacgtggactggaccatcttcgagaagcacctccggaaccttacttaccaagtgcgaaccatctcgaatcgaaccatccagcagttgtgggagtttgacgcgctgtcgttcgactacttcaaggaacgcggaacctatccgacggtccaagacttgtacggttgcacccagaagaagatagacgggtacatctaccacaccttgcagtcgaagtaccctgacattcacaagggcaacatgagcactaccctccagaagatcatcaagacctggaaatctcgtaggaacgagatcaggaagggcgagatgagcattccctccttccgtaacagaatccctattgacctccacaacaacagcgtggacatcactaaggagaagaacggagattacatcgcgggtatctccctattcttgagagacttccacaaggagaatggggacgtgccaaagggcaagatattcgttaaactatcaactcagaagcagaagtcgatgaaggtgatcttagacagacttatgaaccagacatactctaagggagcctgcatgattcacaagtacaagaacaagtggtacttgagcataacgtacaagttcaacgctatcaaggagaacaagttcgataaggaactcatcatgggaatcgacatgggcgggataaacactgtgtacttcgccttcaatgagggcttcatacggagtaacattaagtccgacgagatcaagatgttcaacgagcgtatccgtcagcgccggatcaacctcctaaaacagagcaagtactgttccaactccagaatcggcaaaggccgcactaagcgtttgcaacctatcgacgttctgagcaacaagattgccaaattccgcaactccacgaaccacaagtacgccaactacatcgtcaagcagtgcctcaagcacaactgcggccggatacagatggagctgctcaaagggatctctaagaatgacaagatcctcaaagactggacctacttcgacctccaggaaaaaatcaagaatcaggccggtatccacggtatcgaagtcatcaagatagcgcctgcatacacctcccagcggtgctcacagtgcgggtacatctgtaaggagaatcggtgcacccaggccgtatttgagtgtaaacagtgcgggtacaaaactcacgcggactacaacgccgctaagaatatctctatctacgacatcgagaacatcatcaacaagcaactggccgtgcagagcaagctccatagcaaaaagtgtatggaggagtacatcgaggaacttggctacctggactga

SEQ ID NO: 2942 - DNA, 1356 bp, Unknown
  Bacillus sp. multi
cttggagttaccatcaagattatgaagtaccaaatactctgcccgatgaacgttgactggaccatcttcgagaagcaccttcgtaacctcacttaccaagtgagaaccatctccaaccggacaatccagcagctctgggagttcgacgcgctcagcttcgattacttcaaggagcgaggcacttatcctaccgtccaggacttgtacggctgcacccaaaaaaagatcgacgggtacatataccacaccttgcagtccaagtatcccgacatccacaagggcaatatgagtaccactctccaaaaaatcatcaagacatggaaatccaggcggaatgagatccgtaagggtgagatgtccatcccctccttccgaaatcggataccaatcgacctccacaacaacagtgtggacatcacaaaggagaagaacggcgactacatcgctggcatctcgctgttcctgcgcgacttccacaaggagaacggggacgtgcccaaaggcaagatattcgtaaaactgtcaacacagaagcagaagtctatgaaggtcatcctggaccgcctgatgaaccagacttactcgaaaggagcgtgcatgatccacaagtacaagaacaaatggtatctctcaatcacatacaagttcaacgctatcaaggaaaacaaattcgacaaggagttgataatgggcattgacatgggcggcatcaacaccgtgtacttcgccttcaacgaggggttcattcgctcaaacatcaagagcgacgagattaagatgttcaacgagcgcattcgccaacgaaggatcaacctacttaaacagagcaagtactgttcaaattcacggatcgggaagggccgtaccaagaggctccagccgattgacgtcctctccaacaagatagccaaattccgcaattccactaaccacaagtacgccaactacatcgtcaagcagtgcctcaagcacaactgcgggcgtatccaaatggagttattgaaagggattagcaagaacgacaaaatcttgaaggactggacgtacttcgacctccaggagaagattaaaaaccaggctgggattcacggtattgaggtgattaagatcgccccggcctacactagccagaggtgctcccagtgcggctacatctgcaaggagaaccgatgcactcaggctgtcttcgagtgcaagcagtgcgggtacaagactcacgcggactacaatgcagccaagaacatcagtatctacgacattgagaacattatcaacaagcaacttgccgtgcagagtaagctccacagcaagaagtgtatggaggagtacatcgaggaacttggatacctcgactga

SEQ ID NO: 2943 - DNA, 1356 bp, Unknown
  Bacillus sp. multi
ctcggagttaccatcaagatcatgaagtaccagatcctttgccccatgaacgtggactggaccatcttcgagaagcacctgagaaacctcacgtaccaagttcgaacaatcagcaaccggaccatccagcagttgtgggagttcgacgcgctctcgttcgactacttcaaggagcgtggtacttatccaacggtccaagacctttatggctgcacccagaagaaaatcgacgggtacatctaccataccctacaatccaagtacccggacatacacaagggcaacatgagcacgaccctccaaaaaatcatcaagacgtggaaatcgagacgcaacgagatccggaagggcgagatgtccatcccttccttccgtaatcgcatcccaattgacctccacaacaactccgttgacatcactaaggagaagaacggcgactatatcgctggaatatctctgttcttgcgcgacttccataaggagaacggcgacgtgccaaagggcaaaatcttcgtaaagttatccacccagaagcagaaatccatgaaggtgatcctggacagactgatgaaccagacatacagtaaaggtgcctgcatgatccacaagtacaagaacaagtggtatctctctatcacatacaagttcaacgctattaaggaaaacaaattcgacaaggaattgataatgggaattgacatgggtgggatcaacactgtctatttcgccttcaacgaggggttcatccgctccaacatcaagagtgacgagatcaagatgttcaatgagcgcatccggcaacgacgtatcaacttgctaaagcaaagtaagtattgttccaactcgcggatcgggaaggggaggaccaaacgcctccagcccatcgacgtgctctccaacaagatcgccaaattccgcaactccacaaaccacaagtacgccaactacattgtgaagcaatgcctaaagcacaactgcggacgcatccagatggaattgctcaaggggatctccaagaacgacaaaatcctgaaagactggacgtactttgacctacaggaaaaaatcaagaatcaggctggaatccacgggatcgaggttattaagatagcgccagcatacacaagtcagaggtgcagccagtgtggctacatctgcaaggagaaccggtgcacccaagctgtcttcgagtgcaagcagtgcggctacaagacacacgccgactacaacgccgccaagaatatctccatctacgatattgaaaacatcattaacaagcagttagccgtgcagtctaagctgcacagcaaaaaatgcatggaggagtacattgaggagttggggtatttggactag

SEQ ID NO: 2944 - DNA, 1356 bp, Unknown
  Bacillus sp. multi
ctcggggtgaccatcaagatcatgaagtaccagattctctgcccgatgaacgtggactggactatcttcgaaaagcacctccgaaatctgacctaccaagtccggacgatctcaaaccggaccattcagcagctttgggagttcgacgcgctctccttcgactacttcaaggagcgcgggacttaccccaccgtccaagacctctacggctgcacccagaagaagatcgacggttacatataccacactctccaatctaagtaccccgacatccacaagggcaacatgagcaccaccctccaaaaaatcatcaagacttggaaatctaggcgaaacgagatacgaaaaggagaaatgagcatccccagcttccgaaaccgtatcccaatcgacttgcacaacaactcggtggacatcactaaggagaagaacggggactacatcgccggtatctccctattcttgagggacttccataaggagaacggtgacgtcccgaaagggaagatattcgtgaagctgtccactcagaagcagaagtccatgaaggtgatcctggacaggctcatgaaccagacctattctaagggagcctgcatgatccacaagtacaagaacaaatggtacttgtcaatcacctacaagttcaacgccattaaggagaacaagttcgacaaggaactcattatgggcattgacatgggagggatcaacactgtctatttcgcattcaacgaggggttcatacgttccaacattaagtctgacgagatcaagatgttcaacgagcgaatcaggcagcggcgcatcaacctattgaagcagtccaagtactgctcaaacagcagaatcggaaaggggaggaccaagaggctccagccaatcgacgtgctgtccaacaagatcgccaagttccgaaacagcactaatcataagtacgctaactatatcgtcaagcagtgcttgaagcacaactgcggccggatacagatggagttgctcaagggcataagcaagaatgacaagatcctcaaggactggacctacttcgacctacaggagaagatcaaaaaccaggcggggattcacggaatcgaggtcatcaagattgcaccagcctacacttcacagaggtgcagccagtgcgggtatatctgcaaggaaaaccggtgtacgcaagcggtctttgagtgcaagcagtgcgggtacaaaacccatgcggactacaacgcggccaagaatatctctatctacgacattgagaacatcatcaacaaacagctcgccgtgcagtctaagttgcattccaagaaatgcatggaggagtatatcgaggagttgggctatctcgactga

SEQ ID NO: 2945 - DNA, 1317 bp, Unknown
  Bacillus sp. multi
atgaagtatcagatcctttgcccactgaacgtggactggacaatcttcgagaagcacctcaggaacttgacgtaccaagtgcgtactatctcaaacagaacaattcagcagctttgggagttcgacgccctctcctttgactacttcaaggagcgtggcacctaccccacggtgcaagacctctacggatgcacccagaagaagatcgacggctacatctaccacaccctacaatctaagtaccccgacatacacaagggcaacatgagcacgaccttacaaaaaatcatcaaaacttggaaatcacgccgcaatgagatccggaagggcgagatgtccatcccctcattccgtaacagaatacctattgacctccacaacaatagcgtggacataacgaaggaaaaaaacggggactacatcgctggaatatccctgtttagccgcgacttccacaaggagaacgacgacgtgccaaagggcaaaatcttcgtgaagctggccacccagaagcagaagtctatgaaggtgatcctagaccgccttatcaaccagacttactctaaaggtgcttgcatgatccacaagtacaagaacaagtggtacttgagcatcacctacaagttcaacgccattaaggagaacaaattcgacaaggagttaatcatgggaattgacttgggtgggataaacaccgtgtactccgccttcaacgaggggttcatacgttcgaacatcaagtccgacgagatcatacgccagcggcgcatcaatctcctgaaacagtccaagtactgctccaactcaaggaccggcaagggaaggactaaacgattgcagcctatcgacgtcttgagcaacaagatagcgaaattccgtaatagtacaaaccacaagtatgccaactacatcgttaagcagtgcctaaagcacaattgcgggcggatacagatggagctgttgaaggggatctccaagaacgaccgcatcctcaaggactggacgtacttcgacctccaggagaagatcaaaaaccaggctgaaatccacggtatcgaagttattaaggtggctccagcttacacatcccagcggtgtagccagtgcggctacatctgtaaggagaaccggtgtacccaggcgactttcgagtgcaagcagtgcgggtacaagacacacgctgactacaacgccgccaagaacatcagcacatacgacattgagaacatcatcaacaagcagctcgcggtgcagagcaagctgcattccaagaagtgtatggaggagtacatcgaggagctgggttacttagactag

SEQ ID NO: 2946 - DNA, 1317 bp, Unknown
  Bacillus sp. multi
atgaagtaccagatcctgtgcccgctgaacgttgactggacaatcttcgagaaacaccttcgaaacctgacataccaagtgcgtacgatcagcaaccgcaccatccagcagctctgggagttcgacgcgctgtccttcgactacttcaaggagcgagggacatacccgaccgtgcaagacctctacggatgtactcagaagaagatagacgggtacatctaccatacactacagagtaagtaccctgacattcacaaggggaatatgagtacaacgctacaaaaaatcattaagacttggaagtcccgccgcaacgagattcgcaaaggagaaatgtcgatccccagtttccgcaatcgtatccctatagacctgcacaacaactccgtggacatcacgaaggagaagaacggggactatatcgcggggatctcactgttcagtcgtgactttcacaaggagaatgatgatgtacctaagggcaaaatcttcgttaaactcgctacacagaagcagaagtctatgaaggtgatcctcgaccggcttatcaatcagacctattccaaaggtgcttgcatgattcacaagtacaagaacaagtggtatttgagtattacctacaagttcaacgccattaaggagaacaagttcgacaaggagctaatcatggggatcgacctcggcgggattaacactgtgtacagcgcattcaacgagggcttcatccgtagcaacattaagagcgacgagatcatccggcaacggaggatcaacctcctaaaacagtccaagtattgttcaaactcacgcaccggcaagggccggaccaagaggttgcagcctatagacgtactaagcaacaagatcgccaagttccgcaacagcaccaaccacaagtacgccaactatatcgttaagcagtgcttgaagcacaactgcgggaggatacagatggaactccttaaggggatcagcaagaatgaccgcatacttaaagactggacgtacttcgacctacaggagaagatcaaaaatcaggcagagatacacggcatcgaggtcatcaaggtggctccagcatacacgagtcaacgttgctcacagtgcggctacatctgtaaggagaatcgctgcacccaggcgaccttcgagtgcaagcagtgcgggtacaagacccatgcagactacaacgcagctaagaacatctctacctacgacatcgagaacatcatcaacaagcagttggctgttcagtcgaagctccacagcaaaaagtgtatggaggagtatatcgaggaactcggctatcttgactag

SEQ ID NO: 2947 - DNA, 1317 bp, Unknown
  Bacillus sp. multi
atgaagtaccagatcctatgccctcttaacgtggactggaccatcttcgagaagcacctccgaaacctgacctaccaagtaaggaccataagcaaccgcacaatccagcaactctgggagttcgacgccctctccttcgactatttcaaggaaaggggaacgtatcctacagttcaagacctatacggatgcactcagaagaagattgacgggtacatctaccacacattgcagtccaagtaccctgacatacacaagggcaatatgagcactacattgcagaagattatcaagacctggaaatcacgccggaacgagatccggaagggcgagatgagcatcccgagcttccggaaccgcatacccattgacctccataacaacagcgtggacatcacaaaggagaagaacggggactacatcgccgggatctcgctgttctcccgagacttccataaggaaaacgatgatgttccgaagggcaagatattcgttaaactcgcaactcagaaacagaagtcgatgaaggtcattctggaccggctcatcaaccagacctactccaaaggggcttgcatgatccacaagtacaagaacaagtggtacttatcaattacctacaagttcaatgccattaaggagaacaagttcgacaaggagttaatcatggggattgacctcggtgggataaacaccgtgtactcggccttcaacgaggggttcatccgctcgaacatcaagtccgacgagattatcaggcagagacggatcaacctgttgaagcagtcgaagtattgttccaactcccgaactggcaagggccgcacgaaacgacttcaacccattgacgtcctgagcaacaagatcgccaagttccgcaactccaccaaccacaagtacgcaaactacattgtcaagcagtgcctcaaacacaattgcgggagaatccagatggagctactaaagggaatcagcaagaacgaccgcatcttgaaagactggacgtactttgacctacaggagaagatcaaaaaccaggccgagatccacgggatcgaagtcatcaaggtcgccccagcttacacctcccagagatgctctcagtgcgggtacatctgtaaggagaaccgatgcacgcaagcgacattcgagtgcaaacagtgcgggtacaaaacccacgccgactacaacgccgccaagaacatcagcacctacgatattgagaacatcattaacaagcagttggcggtgcagtcaaagctccattccaagaagtgtatggaggagtacatcgaggagcttggctacttggactag

SEQ ID NO: 2948 - DNA, 1317 bp, Unknown
  Bacillus sp. multi
atgaagtaccagatcctctgcccactcaacgtggactggacaatcttcgagaagcacctccggaacctcacctaccaagtaagaacgattagcaaccgtactatccagcagctctgggagttcgatgctctgtccttcgattacttcaaagagcgcggcacttacccaaccgtccaggacttgtacggctgcacacaaaaaaagattgacgggtacatctatcataccctccagagcaagtatcccgacattcacaaggggaatatgagtaccacgctccagaaaatcatcaagacatggaaatcgcgccgaaacgagattcggaaaggcgagatgtccattccctcctttcgtaacagaatccccatcgacctacacaacaatagcgtggacattactaaggagaagaacggagactacatcgccggtatctcacttttcagccgagacttccacaaggagaacgacgatgtgccgaagggcaagatattcgtgaaactcgctacccagaagcagaagtctatgaaggtcattctggaccgcttgataaaccagacctactcaaaaggagcgtgcatgatccacaagtacaagaataagtggtacttgtccatcacctacaagttcaacgcgatcaaggagaacaagttcgacaaggaattgataatgggcattgatctcggcgggattaacacagtgtactcagccttcaacgaggggttcattcggtcaaacattaagtccgacgagattatcagacagcggcgcatcaacctcctcaagcagtcgaaatactgctcaaacagccgcacggggaaagggaggaccaagcggctacaaccgattgatgtgctgagcaacaagattgcgaaattccgcaattccaccaaccacaagtacgctaactacattgttaaacagtgccttaagcacaactgcgggcgcattcaaatggagctgttaaagggtatatccaagaacgacagaatcttgaaagattggacctacttcgacctccaggagaagatcaaaaaccaggccgagatccacgggatcgaagtgattaaggtggctcctgcatacacctcccagcggtgctcccagtgcgggtacatctgtaaggagaaccgatgcactcaagctaccttcgagtgcaaacagtgcgggtacaagacgcacgcagactacaacgccgccaagaatatctccacgtacgacattgagaatatcatcaacaaacaacttgctgtgcagtcaaagttgcactccaaaaagtgtatggaggagtacattgaggagttgggctatcttgactag

SEQ ID NO: 2949 - DNA, 1317 bp, Unknown
  Bacillus sp. multi
atgaagtaccagatcctctgccctttgaacgtggactggacgatcttcgagaagcacctccgaaacctgacctaccaagtccgcaccatcagcaaccggacgatccagcagctctgggagttcgacgcgctcagcttcgactacttcaaggaaaggggaacctatccgaccgtccaagacctgtacggctgtacccagaagaaaatcgacgggtatatctatcacaccttgcaatctaagtaccccgacatacacaagggcaacatgagcacaaccttgcagaagatcattaagacatggaagtcgaggcgtaacgagatccggaagggagaaatgtccatcccttccttccgcaaccgcatccctatagaccttcacaataactccgtggacattacgaaggaaaaaaatggcgactacattgccggaatcagcttgttcagtcgagactttcacaaggagaatgacgatgttcctaagggcaagatattcgttaagttggctacccagaagcagaagtcgatgaaggtcattctggaccggctgattaaccagacgtattcaaaaggtgcctgcatgattcacaagtacaagaacaagtggtacttgtctatcacatacaagttcaatgcgattaaggagaacaaattcgacaaggagctgattatggggatcgacctcggtgggatcaacactgtttactcggctttcaacgaggggttcattcgctccaacatcaagtctgacgagatcatccgacagcggcgcatcaacctcctcaagcagtccaaatattgctccaattcgaggaccggcaaggggaggactaagaggctacaacctatagacgtactcagcaacaagatagccaagttcagaaactcgaccaaccacaagtatgcgaactacatcgtgaaacagtgcttgaaacacaactgcggtcggatacagatggagctactcaaggggatcagcaagaacgaccgtatccttaaagactggacctacttcgacctccaggagaagatcaaaaaccaggccgaaatccacgggattgaggtcatcaaggtggctccagcatacacctctcagaggtgctctcagtgcgggtatatctgtaaggaaaacagatgtactcaagctacgttcgagtgcaagcaatgcggctacaagacccacgccgactacaacgcagccaagaatatctccacctacgacattgagaacatcatcaacaagcaattggcggtgcagtcgaagttgcactccaagaagtgtatggaggagtatatcgaggaactcggctaccttgactga

SEQ ID NO: 2950 - DNA, 1335 bp, Unknown
  Bacillus sp. multi
atgaagtaccagatcctgtgcccgatgaacgtggactggaccatcttcgagaagcacctgaggaacctcacctaccaagtgcgaaccatcagcaaccgcacaatccagcagttgtgggagttcgacgccctgtcattcgactatttcaaggagcggggcacctacccgaccgtgcaagacctctacggctgcacccagaagaaaatcgacggctacatctaccacacgcttcaatccaagtacccagacatccacaagggaaacatgagcactaccctccagaagatcatcaagacttggaaatcccgtcgcaacgagatccgcaagggcgagatgtcgatcccgtctttccggaaccgcattcctatcgacctccacaacaactctgttgacatcatcaaggagaagaacggggactacatcgccggtatcagcctattctctagggactttcacaaggaaaacggcgacgtgcctaagggcaagatattcgtaaagctctccaaccagaagcagaagtctatgaaggtcatcttggacagactcatgaaccagacatactctaaaggggcttgcatgatacacaagtacaagaacaagtggtacttgtcaatcacttacaagttcaacgccattaaggaaaacaaattcgacaaggaactgattatgggaatcgacatgggcgggattaacaccgtgtactttgccttcaatgagggattcatccgttcgaacattaagagcgacgagatcaagatgttcaacgagcgcataaggcagcgacggatcaacctcctcaaacagagcaagtattgttcaaatagtaggacggggaaaggccgtacaaaacggttgcagcctattgacgtgctgtcaaacaagatcgccaaattcagaaatagcaccaaccacaagtacgcgaattacatcgttaaacagtgccttaagcacaactgtgggagaatccaaatggagcttctaaagggcatagctaagaacgacaagatactcaaagactggacgtacttcgacctacaggaaaaaatcaagaatcaggcggagatccacgggatcgaagttatcaagatcgcaccagcatatacaagtcagcggtgctcccagtgcgggtatatctgcaaggagaaccgctgcacccaagcggtgttcgagtgcaaacagtgcggctacaagacccacgccgactacaatgcagctaagaacattagcatctacgacatcgagaacatcatcaacaagcaattggcggtccagtcgaagctacacagcaagaagtgtatggaggagtatatcgaggagctgggctacctggactga

SEQ ID NO: 2951 - DNA, 1335 bp, Unknown
  Bacillus sp. multi
atgaagtaccagatcctctgccccatgaacgtggactggaccatcttcgagaagcacctaaggaacctgacttaccaagtcaggactatatccaacaggacgattcaacagctctgggagttcgacgctctctccttcgactatttcaaggagcgcgggacatacccgaccgtccaggatctgtacgggtgcacacagaagaagatcgacggctacatataccatacgctccagtcaaagtacccagacatccacaagggcaatatgagcaccacccttcagaagatcatcaagacttggaaatctcgccggaacgagattcgcaagggtgagatgtccatcccctccttccgaaacagaatccccatcgacctgcacaacaacagtgttgacatcattaaggaaaaaaatggcgattacatcgctggcatcagtctgttctcgcgggacttccacaaggagaacggcgacgttccgaaggggaagatattcgtgaaactctcgaaccagaagcagaagtccatgaaggtgatcctcgacaggctgatgaaccagacctatagcaagggcgcttgcatgatccacaagtacaagaacaagtggtatctcagcataacgtacaagttcaacgccattaaggagaacaaattcgacaaggagttgataatgggcattgacatgggcgggataaacacagtgtacttcgccttcaatgagggattcatccgctccaacattaagagcgatgagattaagatgttcaacgaacgaatcaggcagcgacgtattaacttgttaaagcagagcaaatattgttctaatagtagaacggggaagggacgtaccaagcgtctccagccaatcgacgtgctctcaaacaagattgcgaagttccgaaattccaccaaccacaagtacgcgaactacatcgtgaaacagtgcttaaagcacaattgcgggcgtatccagatggagttgcttaagggcatcgccaagaacgacaagatcctaaaggactggacctacttcgacctacaggagaagatcaaaaaccaggcagagatccacgggatcgaggtcatcaagatagccccggcctatacgagccagcggtgcagtcagtgcggctacatctgcaaggaaaaccgttgcacccaagctgtgttcgagtgcaagcagtgcgggtacaaaacccacgctgactacaacgcggccaagaacatctctatctacgacattgaaaacattatcaacaagcaacttgcggtgcaatcgaagctccatagcaagaagtgtatggaggagtacattgaggagttgggctacctggactaa

SEQ ID NO: 2952 - DNA, 1335 bp, Unknown
  Bacillus sp. multi
atgaagtaccaaatcctatgccccatgaacgtggactggaccatattcgagaagcacctgaggaacctgacttaccaagtcaggactatatccaaccgtaccattcagcagctttgggagttcgacgccctctccttcgactatttcaaggagcgtggcacttaccccactgtccaagacctttatgggtgcacgcagaagaaaatcgacgggtatatctaccacaccctccagagcaagtaccccgacatccacaagggcaatatgtccacaacgttacaaaaaatcatcaagacttggaaatctaggcgcaatgagatacgcaagggcgagatgtctataccctcgtttcgtaacagaatacccattgacctgcacaacaactccgttgacatcattaaggaaaaaaacggcgactatatcgcgggtattagcctgttcagtagagacttccacaaggaaaacggcgacgtccctaagggcaaaatcttcgtcaaactcagcaaccagaagcaaaagtccatgaaggtcatcctggaccgtctcatgaaccagacttacagcaagggagcgtgcatgatccacaagtacaagaataagtggtatctctccattacctacaagttcaacgctatcaaggagaacaaattcgacaaggagctgataatgggcattgacatgggcggtattaacacggtgtactttgctttcaacgagggcttcatccgatccaacatcaagtccgatgagattaagatgttcaacgagcgcattcgccagaggaggatcaatctcctaaagcagtccaagtattgctcgaacagccgaaccgggaaaggacgcacgaagcggctacaacccatcgacgtgcttagcaacaagattgccaagttccgcaactccaccaaccacaagtacgccaactacatcgtgaaacagtgccttaagcacaactgcggccgtatccagatggaacttctcaaggggatcgccaagaacgacaagatccttaaagactggacctacttcgatctacaggagaagatcaaaaaccaggccgagattcacggtattgaagtcatcaagatcgcgcccgcctacaccagtcagcggtgctctcagtgcggctacatctgcaaggagaaccgatgcactcaagccgtcttcgagtgcaagcaatgtggctacaagacccacgctgactacaacgccgctaagaacatcagtatctatgacattgagaacattatcaacaaacaacttgccgtgcagtctaagttgcacagcaagaaatgcatggaggagtacatcgaggagttgggatacctcgactag

SEQ ID NO: 2953 - DNA, 1335 bp, Unknown
  Bacillus sp. multi
atgaagtaccagatcctctgccccatgaacgtggactggaccatattcgagaagcacctccggaatttgacttaccaagtccgtaccatctccaacaggaccatacagcagctctgggagttcgacgccctctcgttcgactatttcaaggaaaggggtacatatccgaccgtccaagacctttacgggtgcacgcagaagaagatcgacgggtacatctatcacaccttgcagtccaagtaccccgacatacacaaggggaatatgtccaccactcttcagaagatcattaagacgtggaaatcacgcagaaatgagattcgcaaaggcgagatgagcatcccgagtttccggaaccgtatccccatcgacttgcacaacaacagcgtggacatcattaaggagaagaatggcgactacatcgcgggtatctctctattctcgcgcgacttccacaaggagaatggtgacgtaccgaagggcaagatattcgtgaagctctccaaccagaagcagaagtccatgaaggtcatcctggaccgcctgatgaaccagacctattcgaaaggagcttgcatgatccacaagtacaaaaacaagtggtatctgtcaattacatacaaattcaacgcgatcaaggagaacaagttcgacaaagagcttatcatgggcattgacatgggtgggatcaacaccgtgtacttcgcattcaacgaggggttcattcgcagcaacattaagtccgacgagattaagatgttcaacgagcgcattcgccagaggcgcatcaacctcctcaagcagagcaagtattgctctaattcacgcaccggcaagggccgcactaaacgcctccaacctatagacgtgctctccaacaagatagccaaattccgcaactctacgaaccacaagtatgctaactatatcgtgaagcagtgtctaaagcacaactgcgggagaatccagatggagctgctcaagggcatagctaagaatgataagatcctcaaagattggacttacttcgacctacaggagaagatcaaaaaccaggcagagatccacggcattgaggtcattaagatcgccccagcctacacctctcagaggtgttcacagtgcgggtacatctgcaaggagaaccggtgcactcaggccgtcttcgagtgcaagcagtgcggctacaagacgcacgcggactacaatgcagctaagaatatctctatctacgacatcgagaacatcatcaacaagcagctcgctgtgcaaagcaagctgcacagcaaaaaatgcatggaggagtacattgaggagctaggctacctcgactga

SEQ ID NO: 2954 - DNA, 1335 bp, Unknown
  Bacillus sp. multi
atgaagtaccagatcctgtgccccatgaacgtggattggacaatcttcgagaagcacctaaggaacctcacctatcaagttcgaacgatctccaaccgcacaatccagcagctttgggagttcgacgccttgtcctttgactacttcaaggagcggggcacataccccaccgtccaagacctctacggctgtacccagaagaagattgacggctacatctaccacactttacagtcgaaataccctgacatccacaagggcaatatgagtacaaccctccagaagattatcaagacgtggaaatctaggcgcaacgagatccgcaaaggcgagatgagcatcccgtcattccgtaaccggattcctattgatctccacaacaactcggttgacatcatcaaggagaagaacggggactatatcgcgggaatatcactcttcagtagagacttccacaaggaaaacggtgacgtgcctaagggcaagatattcgtgaaactgtccaaccagaagcagaaatctatgaaggtcatcctcgaccggctcatgaaccagacctatagcaagggagcgtgcatgattcacaagtacaaaaacaagtggtacttgtccatcacctacaagttcaacgcgatcaaggagaacaagttcgacaaggagcttatcatggggatagacatgggagggatcaacacagtttacttcgccttcaacgagggctttatccgttcgaacattaagtcggacgagatcaagatgttcaacgagcgcatacgtcagaggcgcatcaacctcttgaagcagagcaagtactgctccaattctcgcaccggcaaggggcgcacgaagcgcctccagccaattgacgtgctctccaacaagatagcgaaattccggaacagtacaaaccacaagtacgccaactacatcgtcaagcagtgcctaaaacacaactgcggtcgcatacagatggagctgttgaaagggattgccaagaacgacaagatcctcaaagactggacctacttcgacctccaggagaagatcaaaaaccaggccgagatccacggcatcgaggttattaagatcgcacccgcatacacctcgcagcgttgctcacagtgcgggtatatctgtaaggagaaccgctgcactcaggccgtgttcgagtgcaagcaatgcggttacaaaacccacgctgactacaatgccgccaagaatatcagtatctacgacatcgagaacatcatcaataagcaactcgccgtgcagagtaagctgcacagcaagaagtgtatggaggagtacatcgaggagttgggatacctcgactga

SEQ ID NO: 2955 - DNA, 1338 bp, Unknown
  Bacillus sp. multi
ctcggggtcaccatcaagatcatgaagtaccagatcctgtgcccactcaacgtggactggaccatcttcgagaagcacttgagaaacctcacctaccaagtccgaactatctccaatcggactattcagcagctctgggagttcgacgcactctccttcgactacttcaaggagcgcggcacgtacccgactgtccaagacctatatggctgcacgcagaagaaaatcgacgggtacatctaccacacgctccagtcgaagtaccccgacatccacaagggcaatatgagtacaacactccagaagatcatcaagacttggaaatctcgccggaacgaaattcgtaagggtgagatgtctatcccctctttccggaaccggattcctattgaccttcataacaactcggtggacattactaaggagaagaacggtgactatatcgccgggatctcattgttcagccgagacttccataaggagaacgatgacgtgccaaagggcaagatattcgtcaagttggcaactcagaagcagaagtccatgaaggtgatactggaccgtctcatcaaccagacatactcaaagggtgcgtgcatgatccacaagtacaagaacaagtggtatctctctatcacctacaaattcaacgccattaaggagaacaaattcgacaaggaattgataatgggcatcgacttgggcggtatcaataccgtgtactttgctttcaacgagggcttcatccggagcaacatcaagtccgacgagatcatccgtcagaggcggataaacctgcttaaacagagcaaatattgttcaaactcccgcacaggcaagggtaggaccaagcggctccagcccatcgacgtgctctccaacaagatcgccaagttcagaaattccactaaccacaagtatgccaactacatcgtaaagcagtgcctaaaacacaactgcggtcgaatccaaatggaacttctcaagggcatcagtaagaatgacaggatcttgaaagactggacttacttcgacttacaggagaagatcaaaaaccaggctgagattcatggaatcgaggtcatcaaggtggctccagcctacaccagccagaggtgcagccagtgcgggtacatctgtaaggagaatcggtgcacccaggccacctttgagtgtaagcaatgcgggtacaagacccacgccgactacaacgctgccaagaacattagcacctacgacattgagaacatcatcaacaaacagctcgcagtacaaagtaagctgcactccaaaaagtgtatggaggagtacatcgagaaactcggctacctcgactag

SEQ ID NO: 2956 - DNA, 1338 bp, Unknown
  Bacillus sp. multi
ctgggcgtgaccatcaagatcatgaagtatcagatactctgtccactcaacgtggactggacgatattcgagaaacacttgaggaacctcacctaccaagtgaggaccataagtaacaggacgatccagcagttgtgggagttcgatgcgttgtcattcgattacttcaaggagcgtggaacatatcccaccgtccaagacctatacggctgtacgcagaagaagattgacggctacatctatcataccctccagtctaagtatcccgacatccacaagggcaatatgtcaaccacactccaaaaaatcattaagacatggaagtctcggcgtaacgagatccggaagggagagatgtccattccatccttccgtaaccggattccgatagacctccacaacaactctgtggacatcacgaaggagaagaatggcgactacatcgccggtatttccttattctcaagggatttccacaaggagaatgacgacgttccgaagggcaagatattcgttaagttggccacccagaagcaaaagtctatgaaggtgattctcgaccgcctgattaaccagacctacagcaaaggagcctgcatgatccacaagtacaagaacaagtggtacttgagtatcacgtacaaattcaacgccatcaaggagaacaagttcgacaaggagctgattatgggaattgatcttggtgggatcaatacggtgtacttcgcgttcaacgaggggttcatccgctcgaacatcaagtccgacgagatcatccgccagcgccggatcaacctcctaaaacagagcaagtattgctcaaactcccgtaccggcaagggtaggaccaagcgtcttcagcccatcgacgtgctgagcaacaagattgccaagttccgaaactccactaaccacaagtacgcgaactatatcgttaagcaatgcctaaagcacaactgcgggaggatacaaatggaactattgaagggaatctccaagaacgacaggatcttgaaagattggacctacttcgacctacaggaaaaaatcaagaaccaggccgagattcacggcatcgaagttatcaaggtcgcgcctgcatacactagccagcgttgcagccagtgcggctatatctgtaaggagaaccggtgcacccaagcgacgttcgaatgtaagcagtgcgggtacaagacccatgccgactacaacgccgccaagaatatctctacttacgacatcgagaacatcattaacaagcaattggccgtacagtcgaagctgcacagcaagaaatgcatggaggagtatatcgaaaagctcggctaccttgactga

SEQ ID NO: 2957 - DNA, 1338 bp, Unknown
  Bacillus sp. multi
ttgggtgtcaccatcaagattatgaagtaccaaattctctgcccactcaacgtggactggaccatcttcgagaagcacctccgcaacctgacgtaccaagtacggaccatcagcaacaggaccatccagcagctctgggagttcgacgccctgtcctttgactactttaaggagcggggcacctatccgacggttcaagacctttatggttgcacccagaagaaaatcgacggctacatctatcacaccctccagtcaaagtatcccgatattcacaagggcaatatgagtaccactctccagaaaatcatcaagacatggaaaagtcgtcggaacgaaatccgcaagggcgagatgagcataccgtccttccggaaccgaatacccatcgacctccacaacaactccgtggacattacaaaggagaagaacggggactacattgcgggcatctccctgttctcacgcgatttccacaaggagaacgacgacgtaccgaagggcaagatattcgtaaagctggcgacacagaagcagaagtctatgaaggtgatcttggacagactcatcaatcagacttacagtaaaggtgcttgcatgatccacaagtacaagaacaagtggtatttgagtatcacctacaagttcaacgccattaaggagaacaagttcgacaaggagttaatcatgggaattgacctgggcgggataaacacagtgtacttcgccttcaacgaggggttcatacgcagtaacattaagagcgacgagatcatacggcagcgtcgtatcaacctcctcaagcagtccaaatattgctcaaattcacgtacggggaaggggaggaccaaaaggctccagccaatcgacgtactgagtaacaagatcgccaaattccgtaactctacaaatcacaagtacgcaaactacatcgtcaagcagtgtctcaagcacaactgcggacgcatacagatggagctgttaaaggggatcagtaagaacgaccgcatcttgaaagactggacctacttcgacctccaggaaaaaatcaagaatcaggcagagattcacggcatcgaagtcattaaggtggctccagcctacaccagccagaggtgcagccagtgcgggtacatctgcaaggagaaccgctgcacccaggcaacgttcgagtgcaagcagtgcgggtacaaaacacacgcagactacaatgcggccaagaacataagcacttacgacattgaaaacatcatcaacaagcagttggcagttcagtccaagctgcactccaagaagtgtatggaggagtacatcgagaagctaggctacctggactag

SEQ ID NO: 2958 - DNA, 1338 bp, Unknown
  Bacillus sp. multi
ttgggagtgacgattaagatcatgaagtaccagattctctgtccgttgaacgtggattggacgatattcgagaagcacttgcggaacctcacataccaagtccgaacgatcagcaaccggaccatccagcagttatgggagttcgacgctctgagcttcgactacttcaaggaaagaggcacataccccacggtgcaagacctttacggctgcacacagaagaagatagacgggtacatctaccacactctccagtcgaagtacccggacatccacaagggcaatatgagcaccaccctccaaaaaatcattaagacgtggaaaagccggagaaacgagatccggaagggcgagatgtcgatcccttccttccgtaaccgtatcccaatcgacctgcacaacaactccgtggacataactaaggaaaaaaacggcgactacattgccggtatcagccttttcagccgggacttccacaaggaaaatgacgacgttcctaagggcaagatattcgtcaaattggccacacagaagcagaaatccatgaaggtgatcttagaccgcctcatcaaccagacctacagcaagggagcctgcatgatccacaagtacaagaacaagtggtacttgagcataacatacaagttcaacgccatcaaggagaacaagttcgacaaggagctaatcatgggaatcgacttgggtgggattaacaccgtttacttcgcgttcaacgagggcttcatccgctcaaacattaagtccgacgagatcatcaggcagcggcggatcaacctcttaaagcagagcaagtactgctctaattctcgcaccgggaagggccggacaaaacgtttgcagcccatcgacgtactttccaataagattgccaagttccgtaactcaacaaatcataagtatgcaaactacatcgtgaagcagtgcttgaagcacaactgcggccggatacaaatggagctgttgaaggggataagtaagaacgaccggatattgaaagactggacgtactttgacctccaggagaagatcaaaaaccaggcagaaattcacggaatcgaggtcattaaggttgccccggcatacaccagccagaggtgcagccagtgcggctacatctgtaaggaaaaccgctgcactcaggccaccttcgagtgcaagcagtgcgggtacaagacacacgcggactacaacgccgccaagaacataagcacatacgacatcgagaacattatcaataagcagttggctgttcagtcgaaattgcactccaagaagtgtatggaggagtacatcgagaagctaggctacctcgactaa

SEQ ID NO: 2959 - DNA, 1338 bp, Unknown
  Bacillus sp. multi
cttggagtaaccattaagatcatgaagtaccagattctctgtccgctcaatgtggactggaccatattcgagaaacacctcaggaacctaacgtaccaagtcaggacaatctcgaacaggacaattcagcagctatgggagttcgacgcactcagcttcgactacttcaaggagcgcggaacttatccgaccgtccaggacttgtacggctgcacccagaagaagatcgacggctacatctaccacacccttcagtcgaagtacccagacatccacaaggggaacatgagcacaactctccaaaaaatcattaagacctggaagtctaggaggaacgagatcaggaaaggggaaatgagcattccctccttccgcaaccgtattcccatcgacctccacaacaactccgtggacattacgaaggagaagaatggagactacatcgctgggatcagcctgttctcacgggactttcacaaggagaacgacgacgttcctaaaggcaagatattcgtgaagctcgccacccagaagcagaaatccatgaaggtgatcttagaccgacttatcaatcagacctactcaaaaggtgcttgcatgatccacaagtacaagaataagtggtatctctctattacctacaaattcaacgctattaaggaaaacaaattcgacaaggagctgataatgggcatcgacctgggagggatcaacaccgtttacttcgcattcaacgagggcttcatcaggagcaacatcaagagcgacgagatcatccgccagcgccgcatcaacttactcaagcagagcaaatattgctccaattcaaggaccggcaaggggcgcaccaaacgactacagcctatcgacgttctatccaacaagattgccaaattccgtaactcgacgaaccacaagtacgccaactacattgtcaagcagtgcttgaaacacaactgcgggcgtattcagatggaattactaaaggggattagcaagaacgacaggatactcaaggactggacctacttcgacttacaggaaaaaatcaagaaccaggccgagatacacggtatcgaggtcatcaaggtcgcacccgcctacacctcccaacgctgctcacagtgcggctatatctgcaaggaaaatcgttgcactcaggccacgttcgagtgcaagcagtgcgggtacaagacacacgcagactacaacgcggccaagaacatctctacctacgacattgagaacatcatcaacaagcagctcgcggtgcaatccaaattacactccaagaagtgtatggaggagtacattgagaaattgggctacctcgactag

SEQ ID NO: 2960 - DNA, 1338 bp, Paenibacillus sp. novel
cttggagtgaccatcaagatcatgaagtatcagatcctctgcccactcaacgtggactggaccatcttcgagaaacacctccgcaacctcacgtaccaagtgcgaaccatctccaacaggactatccagcaactgtgggagtttgacgccctgtccttcgactacttcaaggaacgcggaacgtacccgaccgtccaggacttgtacggatgcacgcagaagaagatcgacggctatatctaccacactctacagtccaagtacccggacatccacaagggcaatatgtcaactacccttcagaagatcattaagacctggaaaagccgccgcaacgagatacgcaagggagagatgtcaatcccgtcattccgcaacagaatccccatcgaccttcacaacaacagtgtggacatcacgaaggagaagaatggggactatatcgccggtatatcactattctcaagggacttccataaggagaacgacgacgttccaaaaggcaagatattcgtgaagctcgctacccagaagcagaagtcgatgaaggtgatcttggatcgactcatcaatcagacctactcaaaaggagcgtgcatgattcacaagtacaagaacaagtggtatctgtctattacttacaagttcaacgcgattaaggaaaacaagttcgacaaggagctgataatggggatcgacctcggagggatcaatactgtgtactctgcgttcaacgaggggttcatacggagtaacattaagagcgacgagatcatccgccagcgaaggatcaacttgctcaagcagagcaagtattgctctaattccaggacgggaaaaggtcggactaagaggttgcagcccattgacgtcctttccaacaagatcgctaagttccgcaactctaccaaccacaagtatgccaactatatcgttaagcagtgcctcaagcacaactgcgggcgtattcaaatggagctgctcaagggaatctctaagaacgaccgcatcttgaaagactggacctacttcgatctccaggagaagatcaaaaaccaggctgagattcacgggattgaggtgattaaggtcgcgcccgcatatacctctcaaaggtgctcccagtgtggctacatctgcaaggagaaccgttgcacccaggccactttcgagtgcaagcagtgcggatacaagactcacgctgactacaatgccgccaagaacatctcgacttacgacattgagaacatcatcaataagcagcttgccgttcaaagcaaactacactccaaaaagtgtatggaggagtacattgaggagttgggctacctcgactga

SEQ ID NO: 2961 - DNA, 1338 bp, Paenibacillus sp. novel
ttgggcgtaaccatcaagatcatgaagtaccagattctctgtcctttgaacgtcgattggacaatcttcgagaagcacctccgcaacctcacgtaccaagtcaggacgatctcgaatcggaccatccaacaactctgggagttcgacgcccttagtttcgactacttcaaggagcgcggcacctatccaacggtccaggacttgtacggctgcacccagaagaaaatcgacgggtacatctaccacacgctgcaaagcaagtaccccgacatccacaagggcaatatgagcaccaccttgcagaaaatcatcaagacctggaagtcccgccggaacgagattcgcaaaggggagatgtcaatccccagcttccgcaatcgcattccaattgatcttcacaacaactccgtggacataacgaaggaaaaaaatggagactacatcgctgggatctccctcttcagcagagacttccacaaggagaacgacgacgtgcccaaaggcaagatattcgttaagctcgctacccagaagcagaagtctatgaaggttattctcgatagacttatcaatcagacctactcgaagggagcttgcatgatccacaagtacaagaacaaatggtatctgagtatcacttacaagttcaacgctatcaaggagaacaaattcgacaaggagcttatcatgggaattgacctgggcgggattaacactgtgtactcagccttcaacgaaggcttcatcagaagtaacatcaagagcgacgagattatccggcagcgccgtatcaacttgctcaagcagtcgaaatattgctcaaactcccggacaggaaaggggcgtaccaaacgacttcagccaatcgacgtgctgtccaacaagatcgccaaattccgcaacagcacgaaccacaagtatgctaactacatcgtgaaacagtgcctcaagcacaactgcggccggattcagatggagctactcaagggcatctctaagaacgaccgtattcttaaagactggacttactttgacctacaggagaagatcaaaaaccaggccgagatacacgggatcgaagttattaaggtggccccggcatatacttctcagaggtgttcccaatgcggctacatctgcaaggagaaccggtgtacccaggctactttcgagtgcaagcagtgcgggtacaagacacacgcggactacaacgctgccaagaacattagcacctacgacattgagaacatcatcaacaaacagctcgcagtccagagcaaactgcactccaagaagtgtatggaggagtacatcgaggagttgggttatctcgactaa

SEQ ID NO: 2962 - DNA, 1338 bp, Paenibacillus sp. novel
ctgggtgtaaccatcaagatcatgaagtaccagatcctgtgtcctctcaatgtggactggaccatcttcgagaagcacctacgaaacctgacctaccaagtcagaaccatctcgaaccgtaccatccagcaactctgggagttcgacgcgctctccttcgactacttcaaggagcgcggcacatatcccacagtgcaagacttgtacggctgcacccagaagaaaattgacggctacatataccacacactacagtctaagtaccccgacattcacaagggcaatatgagcactacgttgcaaaaaatcatcaagacgtggaaatcacggaggaacgagatcaggaaaggcgagatgtccattccctctttccgaaatcgcatacccatcgacctccacaacaactccgttgacattactaaggagaagaatggggactacatcgccgggatcagcctcttcagtcgtgacttccacaaggaaaatgacgacgtgccgaaggggaaaatcttcgtcaagttggccactcagaagcagaagtcgatgaaggttatcctagaccgccttatcaaccagacctatagtaagggagcttgcatgatccacaagtacaagaacaaatggtacttgtccatcacgtacaagttcaacgctatcaaggagaacaaattcgacaaggagctgataatggggatagacctcggcggcatcaacacggtctattctgctttcaatgagggcttcatccgctccaacattaagagtgacgagataatccgccagcgccgtatcaacctgttgaagcagtccaagtattgctcaaactctcgtacagggaaggggcgcaccaaacgtctccagccaattgacgtgctcagtaacaagatcgccaaattccgaaatagcaccaaccacaagtatgccaactacattgtcaagcagtgcttgaagcacaactgcgggcgtattcagatggaattgttaaagggaatctccaagaacgaccgtatcctgaaagactggacctacttcgacttacaggagaagatcaaaaaccaggctgagattcacggaatcgaggtcatcaaggtcgctcctgcctacacctcacagagatgctctcaatgcggctacatctgcaaggaaaatcgctgcacccaagccaccttcgagtgcaagcaatgcggttacaagacacacgccgactacaacgccgctaagaacatctcgacctacgacatcgagaacattatcaacaagcaactcgccgtgcagagcaagctgcactccaaaaagtgtatggaggagtatatcgaggagttgggttacctagactga

SEQ ID NO: 2963 - DNA, 1338 bp, Paenibacillus sp. novel
ctgggtgtgaccatcaagattatgaagtaccagatcctgtgtccgttgaacgtggactggaccatcttcgagaagcacttgcgaaatctcacttaccaagtaagaaccatctcaaaccggaccattcagcaactctgggagtttgacgccctctcgtttgactacttcaaggaacgcggaacctatccgaccgtccaagacctctatggctgcactcagaagaaaattgacggctacatctaccacacccttcagagtaagtatccagacatacacaagggaaacatgagcacgaccctccagaagattatcaagacctggaaatccaggcggaacgagattcggaagggcgaaatgtcgattccgagtttcagaaaccgcatacctatcgacctgcataacaacagcgttgacattactaaggagaagaatggggactacatcgcgggtatctcgctgttctctcgtgacttccacaaggagaacgacgacgtgccaaagggcaaaatcttcgtgaaactggccacgcagaagcagaagtccatgaaggtgatcttggaccgtctcatcaaccagacatactctaaaggtgcgtgcatgatccacaagtacaagaacaagtggtatctctcaattacttacaagttcaacgccatcaaggagaacaagttcgacaaggagttaatcatggggatagacttaggtggtatcaacaccgtgtactcggctttcaacgagggcttcattcggtccaacatcaagagcgacgagatcattcgccagaggaggatcaacctcttaaaacagtccaagtactgctccaactcacgaaccggaaaggggaggaccaagcggctgcaacccattgacgtgctgtcaaacaagattgctaagttccgtaatagcactaaccacaagtacgcgaactacatcgtcaagcagtgcctcaagcacaactgcgggcgtatccagatggaattgctcaaagggatcagcaagaatgaccgcattcttaaggactggacctacttcgacttacaggagaagatcaaaaaccaggccgagattcacggaatcgaggtgattaaggttgcgcccgcctacacgagccagcgatgctcgcagtgcgggtacatctgcaaggagaaccgatgcactcaggctactttcgagtgcaagcagtgcggctacaagactcacgcagactacaacgcagccaagaacatcagtacctacgatattgagaacatcatcaacaagcagctcgcggtacagtctaagctccactccaaaaaatgcatggaggagtacattgaggagctgggctatttggactag

SEQ ID NO: 2964 - DNA, 1338 bp, Paenibacillus sp. novel
ctaggcgtgaccattaagatcatgaagtaccagatcctctgcccgctgaacgtggattggacaatcttcgagaagcacctccgcaacctgacataccaagttcgcacaatctccaacaggacgatacagcagctctgggagttcgatgcgctcagtttcgactacttcaaggaacgcgggacttacccgacggtccaagacctctatgggtgcacgcagaagaaaatcgacggctacatctaccatacccttcaatctaagtacccggacatccacaagggcaacatgagtacaacgcttcagaaaatcatcaagacttggaaatcgcggcgcaacgagatccggaaaggagagatgtcaataccttccttccgtaaccggattccgatagacttgcataacaactccgttgacataacgaaggagaagaacggtgactacatcgcggggatctcgctgttcagtcgagacttccacaaggagaacgacgacgtgccgaagggcaagatattcgttaagctcgctacgcagaagcagaagtctatgaaggtcatattagaccgcctcatcaaccagacttacagcaaaggagcctgcatgattcacaagtacaagaataagtggtatctctcgattacctacaagttcaacgccattaaggaaaacaagttcgacaaggaactcattatgggaattgacttgggtgggataaacaccgtgtactccgccttcaacgagggcttcattagatccaacatcaagagtgacgagattatcaggcaaagacgcatcaacttgctcaagcaatccaaatattgttccaacagtcgtactggaaaggggcgcactaagcgtcttcagcctatcgacgtgctctccaacaagatcgccaagttccgcaactctacaaaccacaagtatgcaaattacatcgtaaagcaatgcttgaaacacaactgcgggaggatacaaatggagctattgaaggggatctctaagaacgaccgcatactcaaagactggacatacttcgacctccaggagaagattaaaaaccaggctgagatccacggaattgaggttatcaaggtcgctccggcatacacctctcagaggtgctcgcagtgcggttacatctgcaaggaaaatcgctgcacccaggcgacgttcgaatgcaagcagtgcggctacaagactcacgccgactacaacgctgctaagaacattagcacgtacgacatcgagaacatcattaacaaacagctcgccgtgcagtccaagttgcactccaaaaagtgtatggaggagtacatcgaggagttgggttacctcgattaa

SEQ ID NO: 2965 - DNA, 1335 bp, Bacillus thuringiensis
atgaagtaccagatcctctgccccatgaacgtggactggacgatcttcgagaaacacttgagaaatctcacctaccaagtccgcacaatctccaacaggaccatccagcagctctgggagtttgacgctctgagcttcgactacttcaaggagcggggcacatacccaaccgtccaagacctctatggctgcacacagaagaagatagacggctacatctaccacacgctccagagcaagtacccggacatccacaaggggaatatgagtacaacacttcaaaaaatcatcaagacttggaagtccaggcgtaacgagattcggaagggtgagatgtctatcccatccttccgcaaccgcatacccatcgacctccacaacaactcggtggacatcaaaaaagagaagaatggggactacatcgcggggatctcactcttcagcagagatttccacaaggagaactcggacgtccctaaggggaaaatcttcgttaagctggctaccaagaaacagaaatctatgaagatcatactcgaccggcttatgaaccagacgtactccaaaggcgcgtgcatgattcacaagtacaagaacaaatggtatttgagtatcacctacaagttcaacgctattaaggagaacaaattcgacaaagaccttatcatggggatagacatgggtgggatcaataccgtgtacttcgcgttcaatgagggcttcatccggtcgaacatcaagtcagacgagattaaggcgttcaacgagaagattcgtcaaagacggatcaacctacttaaacagagcaactactgctcgaactcacgcaccggcaaggggcgcgctaagaggctccagccaattgatgtactaagcaacaagattgccaagttccgtaattctactaaccacaagtatgccaactatatcatcaagcagtgcttgaagcacaactgcggccgtatccagattgaactccttaaggggatcagcaagaacgacaaggtgcttaaagactggacatacttcgacttacaggaaaaaatcaagaatcaggccgaggtgcacggtatcgaagtcatcaaggtggcgtctgcttacaccagtcagcgttgctcacagtgcgggtacatctgcaaggagaatcgttgcacccaggcggtctttgaatgtaaacagtgcggatacaagacccacgccgactacaatgctgccaagaacattgcgacctacgacattgagaacatcatcaataagcagctcgcagtgcagagcaagctccacagcaagaaatgcatggaggagtacatcgaggagttgggctacctagactag

SEQ ID NO: 2966 - DNA, 1335 bp, Bacillus thuringiensis
atgaagtaccagatcctgtgcccgatgaacgtggattggacgatcttcgagaagcacctacggaacctcacctaccaagtcagaaccatcagtaaccgtactatccagcaactgtgggagttcgacgccttgagctttgactacttcaaggaacgcggcacttacccgaccgtccaagacctatacggctgcacacagaagaaaatcgacgggtatatctaccacacgctgcaatccaagtacccggacatccacaagggcaatatgagcactaccctacagaagatcattaagacctggaaatcccggcgcaacgagatcaggaagggcgagatgtctatccccagctttcgcaaccgcatccccatcgaccttcacaacaactctgtggacattaagaaggaaaaaaatggggactacatcgcgggtatctcactgttctccagggacttccacaaggaaaacagtgacgtgccgaaggggaaaatcttcgtgaaattggcgaccaagaaacagaagtccatgaagatcatcctggacaggcttatgaaccagacctactcgaagggtgcttgcatgattcacaagtacaagaacaagtggtacttgtcgataacctacaagttcaacgccattaaggagaacaaattcgacaaggatctcataatggggatcgacatgggtgggatcaacactgtgtactttgcattcaacgaggggttcatccggagcaacatcaagagcgatgagatcaaggcgttcaacgagaaaatccgtcaacgccggatcaacttgctcaagcagagtaactactgctcaaactccagaaccggaaagggaagggcaaaacgtttgcagcccatcgacgtactgtccaacaagatagccaagttccgtaacagcaccaatcacaaatacgctaactacatcatcaagcagtgccttaaacacaattgcgggcgcatccaaattgagctgcttaagggcatctccaagaacgacaaagtgctgaaagactggacctacttcgatctacaggaaaaaatcaagaatcaggccgaggttcacggcatcgaggtcatcaaggtggcgtcggcttacacatcccaaaggtgctcacaatgcgggtatatctgtaaggagaaccgctgcacccaggcggtctttgagtgcaagcaatgcgggtacaagacccatgccgactacaatgctgctaagaatatcgcaacctacgacatcgagaacattatcaacaagcaattggcagtgcagtcgaagctgcactccaaaaagtgtatggaggagtacatcgaggaattgggttacttggattga

SEQ ID NO: 2967 - DNA, 1335 bp, Bacillus thuringiensis
atgaagtaccagatcctgtgccccatgaacgtggactggaccatcttcgagaagcacctacgaaacctgacctaccaagtacgcacgatctccaaccgaaccatccagcagctctgggagttcgacgccctctcgttcgactacttcaaggagcggggaacctatccaaccgtccaagacttgtacggatgcacgcagaagaagattgacggctacatctaccatactctccagtcaaagtaccccgacatccacaaggggaatatgagtacaaccttgcaaaaaatcatcaagacctggaaatcgaggagaaacgagatccgaaagggcgagatgagcattccatcctttcgtaaccgtatccccattgacctccacaacaacagcgtggacatcaagaaggagaagaatggggactacatcgccgggatttcactgttctccagggatttccacaaggagaactccgacgtcccgaagggcaaaatcttcgtgaagctggccaccaagaagcagaagtctatgaagatcatcttggaccggttgatgaaccagacctactctaaaggagcttgcatgatacacaagtacaagaacaagtggtacttgagcatcacctacaagttcaacgctatcaaggaaaacaaattcgacaaagacctcattatgggaatcgacatgggcggcattaacaccgtgtactttgcattcaacgaggggttcatacgatccaacatcaagtcagacgagattaaggcgttcaatgagaaaatccgacaaagacgtatcaacctgttaaagcagtccaactactgtagcaactcaagaactggaaaggggagggccaagaggctccagcccattgacgtcctttccaataagattgcgaagttccgtaacagcacaaaccacaagtacgcaaactacattatcaagcagtgcctcaagcacaactgcgggcgcatacaaatagagcttctcaagggcatcagcaagaacgacaaagtgcttaaagactggacctacttcgacctacaggagaagatcaaaaaccaggcagaagtgcacggcatcgaagttattaaggtggcgtcagcatacacaagccagcgatgctctcagtgcggttacatctgcaaggagaaccgttgcacgcaagcagtcttcgagtgtaagcagtgcggctacaaaacgcacgccgactacaacgccgccaagaacatcgccacatacgacatcgagaacatcattaacaagcagctcgccgtgcagtcgaagctgcactccaaaaaatgcatggaggagtacattgaggagctgggataccttgactga

SEQ ID NO: 2968 - DNA, 1335 bp, Bacillus thuringiensis
atgaagtaccagattctgtgcccgatgaacgtggactggacgatcttcgagaaacacctccgaaacctgacgtaccaagttcgtaccatcagcaacaggacgatccagcaactctgggagtttgacgccctctcattcgactacttcaaggagcgcgggacatatcccacggtccaagacctctacggatgcacccagaagaagattgacgggtacatctaccacaccctgcaatctaagtacccggacattcacaagggaaacatgagcaccacgctccagaaaatcatcaagacctggaaatcacgccgcaatgagatccgaaagggtgagatgtccatcccctccttccgtaatcgcatcccgattgaccttcacaacaactcagtggacatcaaaaaggaaaagaatggggactacatcgccggaatcagcctgttcagcagagacttccacaaggaaaacagtgacgtgcctaaggggaaaatcttcgtgaagctggctaccaaaaaacagaagtctatgaagatcattctggaccgactgatgaaccagacctactcgaaaggggcttgcatgatccacaagtacaaaaacaagtggtatttgagcataacctacaagttcaacgctatcaaggaaaacaaattcgacaaggacttaatcatggggatcgacatgggcggcatcaacacagtgtactttgctttcaacgagggcttcatccgctccaacatcaagagcgacgagatcaaggcgttcaacgaaaaaatccgccaacgtcggatcaacctcctgaaacagtcaaattactgtagtaactctcgcaccggcaaggggcgcgctaaacgattgcagcccatcgacgtactttccaacaagattgcgaagttccgtaacagcacgaaccacaagtacgccaactacatcattaagcagtgccttaagcacaactgcggccgtattcagatagagttgctaaagggcatcagcaagaacgacaaagttcttaaggactggacctacttcgatctccaggagaagatcaaaaaccaggccgaagttcatggcatcgaggtgattaaggtcgcatctgcctacacttcccagcggtgctcccagtgcgggtatatctgcaaggagaaccgatgcacacaagccgtgttcgagtgcaagcagtgcggctacaagacgcacgccgactacaacgctgccaagaatatcgccacatacgacattgagaacatcattaacaagcaactcgctgttcagagcaaactgcactccaagaagtgtatggaggagtacatcgaggaacttggatacctggactag

SEQ ID NO: 2969 - DNA, 1335 bp, Bacillus thuringiensis
atgaagtaccagattctgtgccccatgaacgttgactggaccatcttcgagaagcacctccgcaacctgacttatcaagtacgcaccatcagcaatcgaaccattcagcagctctgggagtttgacgccctgtcgttcgactacttcaaggagcgaggcacgtaccctaccgtgcaagacctatacggctgcacccagaagaaaatagacggctatatctatcacacccttcagtccaagtatccggacatccacaaggggaatatgagcaccaccctccaaaaaatcatcaagacctggaaatccagacgcaatgagatcaggaagggtgagatgtcgatccccagtttccgtaaccgcattccaatcgacctccacaataacagtgtggacatcaaaaaggagaagaatggtgactatatcgcggggatctctctgttcagcagagacttccacaaggaaaacagcgacgtgcctaagggcaaaatcttcgtgaagctcgccaccaagaagcaaaagtcgatgaagattatccttgaccgcctcatgaaccagacatacagcaagggcgcgtgcatgatacacaagtacaagaacaagtggtacttatctatcacttacaaattcaacgccatcaaggagaacaaattcgacaaggacttaatcatggggattgacatgggtggtattaacacggtgtacttcgcattcaacgaagggttcatccgtagcaacatcaagagtgacgagattaaggcgttcaacgagaagatccgtcagcggcggataaacctcctcaagcagagcaactattgttcaaactcgcgtaccggcaaggggcgcgcgaagcgcctccagccaatcgacgtacttagcaacaagattgccaagttccgtaactctaccaaccacaagtacgccaactacatcatcaagcaatgcctcaaacacaactgcggtcgtattcagatcgagctgctaaaagggatctccaagaatgacaaggtgttgaaagattggacgtacttcgacctacaggagaagattaaaaaccaggctgaggtgcacggcatcgaggttatcaaggtggcatccgcatacacatcgcaacggtgctcccagtgcggctacatctgcaaggagaatcggtgcacacaagccgtcttcgagtgcaagcagtgcgggtacaaaacccacgcagactacaacgccgctaagaatatcgccacatacgacattgagaacatcatcaacaagcagttggccgtgcaatccaaactccactccaagaagtgtatggaggagtatatcgaggaattgggctaccttgactga

SEQ ID NO: 2970 - DNA, 1356 bp, Unknown
  Bacillus sp. multi
ttgggagttaccatcaagatcatgaagtaccagattctttgccccatgaacgtggactggaccatcttcgagaagcacctaaggaacttgacctaccaagtaagaacaatctctaatcgtaccatacagcaactctgggagttcgacgcgctctcgttcgactacttcaaggccatcggaacatatccgaccgtccaggacctttacggatgcacgcagaagaaaattgacggctacatataccatactctccagtcgaagtacccagacatccacaagggcaatatgagtaccaccctccagaaaatcattaagacctggaaatcgaggcgcaacgagatccgcaagggcgagatgagtatcccctcattccggaacagaattcctattgatctccacaacaactccgtggatatcaagaaggagaagaacggcgactacatcgctgggatttcactcttcagtcgtgacttccacaaggaaaacagtgacgtgccgaagggaaagatattcgttaagctcgccaccaagaagcagaaatctatgaagataattctggaccgacttatgaaccagacctacagcaagggagcctgcatgatacacaagtacaagaataaatggtacttgagcattacctacaaattcaacgccatcaaggagaacaacttcgacaaggaacttatcatggggattgacatgggcgggataaacaccgtgtactttgcattcaatgagggcttcataagaagtaatattaaatcagacgagatcaaggcattcaacgagaagattcggcagcgccgcatcaacctgctcaagcagtccaactactgttccaactcccggactggcaagggtagagctaagcggctccagcccatcgacgtcctaagcaacaagatcgcaaagttccgcaatagtacgaaccacaagtacgccaactacattatcaagcagtgcctcaaacacaactgcgggcggattcagatcgaactccttaaaggtattagtaagaacgacaaagtgctcaaggactggacctacttcgacttacaggagaagattaaaaaccaggcggaggtccacgggatcgaggttattaaggttgcttcagcatacactagccagcgatgctctcagtgcggctacatctgcaaggaaaaccgctgcacccaggcggtgttcgagtgcaagcagtgcggctacaagacccacgctgactacaatgccgcaaagaacattgcaacttacgatatcgagaacatcattaacaagcagttggccgtgcagtcgaaactacacagcaagaagtgcatggaggagtacatcgaggagttagggtacctggactga

SEQ ID NO: 2971 - DNA, 1356 bp, Unknown
  Bacillus sp. multi
ctcggggttaccatcaagattatgaagtaccagatattgtgccccatgaacgtggactggaccatcttcgagaagcacctccgtaacctcacgtaccaagttagaacgatctcgaaccgtaccatccagcagctctgggagttcgacgcgctctccttcgactacttcaaggctatcggaacctacccgacagttcaagacttgtacggctgcacccagaagaagattgacggctacatataccacacattacaatccaagtacccagacatccacaagggcaacatgagtaccacgctccagaagattatcaagacatggaagtcaaggcgtaatgagatacgcaagggtgagatgagcatcccctccttccggaatcgcattcccattgacctgcacaacaacagcgtggacatcaaaaaagagaaaaatggcgactacattgcgggtatatcactgtttagtagggatttccacaaggagaatagcgatgtgccgaagggcaagatattcgttaagttggctaccaaaaaacagaaatccatgaagatcattcttgaccgcctcatgaaccagacctactctaagggcgcgtgcatgatccacaagtacaagaacaagtggtacttgtcaatcacctacaagttcaacgctatcaaggaaaacaacttcgacaaggagcttatcatgggcattgacatgggtggcatcaacactgtgtacttcgccttcaacgaggggttcatccggagcaacattaagtccgacgagatcaaggcgttcaacgagaagattcgtcagcggaggatcaacctgctcaagcagtccaactactgtagtaattcaaggactgggaagggtcgagccaagcggcttcagccgattgacgtcctgtccaacaagattgccaaattccgaaatagcacgaaccacaagtacgcaaactacatcatcaagcagtgtcttaagcacaactgcggtcgtatccaaattgagttactaaaaggaatcagcaagaatgacaaagtgttgaaggactggacctatttcgatctccaggagaagatcaaaaaccaggccgaggttcacgggatcgaggtcatcaaggtggccagtgcctacaccagccagaggtgctctcagtgcggctatatctgcaaggagaatcgttgcacccaggcggtgttcgagtgcaagcagtgtggatacaagacccacgccgactacaacgccgctaagaatatcgccacctacgacattgagaacattatcaacaagcagctcgcggtgcaaagcaagctccactccaagaaatgcatggaggagtacatcgaggagcttggctacttggactag

SEQ ID NO: 2972 - DNA, 1356 bp, Unknown
  Bacillus sp. multi
ttgggtgtcaccatcaagatcatgaagtaccagatcctgtgtcccatgaacgtggactggaccatattcgagaaacacctccgaaatctcacataccaagtgcgtaccatatccaaccgcaccatccagcagttgtgggagttcgacgccctgagcttcgactacttcaaggcaatcggaacttaccccacggtacaggacttgtacggctgtacgcagaagaagatcgacgggtacatctatcacacccttcagtccaagtaccccgacatacacaaggggaacatgagcaccacacttcagaaaatcatcaagacctggaaaagccgtcgaaacgagatccgtaagggcgagatgtccataccctccttccgaaaccggattccaatagacctccacaacaactcggtggacattaagaaagagaagaatggcgactatatcgccggaatatcactgttctcgcgcgacttccacaaggaaaactcagacgtgcctaagggaaagatattcgtgaagctcgccaccaagaagcagaagtccatgaagatcatcctcgataggctcatgaaccagacgtacagcaaaggggcgtgcatgattcacaagtacaagaacaagtggtatttgagtattacttacaaattcaacgctattaaggaaaacaacttcgacaaggagttaatcatgggcatcgacatgggcgggattaacaccgtgtacttcgccttcaacgagggcttcattagatccaacatcaagagtgacgagatcaaggcgttcaacgaaaaaatccgccagcgtcgcatcaacctgttaaagcagtcaaattactgctccaatagtcggactggaaaagggcgggccaagcgtctccagcctatagacgtgctcagcaacaagattgccaagttccgtaatagcaccaaccacaagtacgcgaactacatcatcaagcagtgcctcaagcacaactgcggtcgcatccagatagagttgctaaaggggataagcaagaacgacaaggtgcttaaggactggacgtacttcgacttacaggagaagatcaaaaaccaggctgaggtgcacggcattgaggtgattaaggtggcatcggcctacacctcccagaggtgcagccagtgcggctacatctgcaaggagaataggtgcacccaagccgtgttcgaatgcaagcagtgcggctacaagacccacgctgactacaacgcggccaagaacatcgcaacttatgacattgagaacatcatcaacaagcaactcgcagtgcagtcaaagctccacagcaagaaatgcatggaggagtacatcgaggaactaggctacctcgactga

SEQ ID NO: 2973 - DNA, 1356 bp, Unknown
  Bacillus sp. multi
ctgggagtgaccattaagatcatgaagtaccaaatcctatgcccgatgaacgtggattggaccatcttcgagaagcacctccgaaaccttacctaccaagtgaggacgataagcaaccggacgatccagcaattgtgggagttcgacgccctgtcgttcgactacttcaaggcaatcggcacctacccaacggtccaagacctttacggctgcacccagaagaagatcgacgggtacatctatcataccctccagagcaagtacccggacatccacaaaggcaatatgagcacaaccctccagaagatcattaagacctggaaaagcagacgcaacgagattcgaaagggtgagatgtccatcccctcgttccgtaacagaatacccattgacctgcacaacaactcagtggacatcaagaaagagaagaacggcgactacattgcggggatcagcctctttagtagagactttcacaaggagaactcagacgtacctaagggcaagatattcgtcaagctggcgaccaagaaacagaagtctatgaagataattcttgatcgcttgatgaaccagacttactctaaaggcgcttgcatgatacacaagtacaagaacaagtggtatctctccattacctacaagttcaacgctatcaaggagaacaatttcgacaaggaactgattatgggcattgacatgggagggataaacaccgtgtacttcgccttcaatgagggattcatacggagcaacatcaagtccgacgagatcaaggcgttcaacgaaaaaatccggcaacgccgcatcaacctcctcaagcaatctaattactgctcaaattccaggaccgggaaggggagggctaagcgattgcagccgattgacgtgctgagtaacaagatcgccaagttccgcaactccaccaaccacaagtacgcgaactacatcatcaagcagtgcctgaaacacaactgcgggcgtatccagatcgaacttctcaaagggatttccaagaacgacaaggtgttgaaggactggacttacttcgacctccaggagaagatcaaaaaccaggccgaggtgcacggcatcgaggtcattaaggtcgcatcggcatatacgagtcagcgctgctcccagtgcgggtacatctgcaaggagaaccggtgcacccaggctgtcttcgagtgcaagcagtgtggatacaagacgcacgccgactacaacgccgccaagaacattgcgacgtatgacattgagaacatcattaacaagcagttggctgttcagtctaagctgcactccaaaaagtgtatggaggagtacatcgaggaattgggctacttggactag

SEQ ID NO: 2974 - DNA, 1356 bp, Unknown
  Bacillus sp. multi
ctcggggtgaccatcaagatcatgaagtaccagatcctgtgccccatgaacgtggactggaccatcttcgaaaagcacctcaggaaccttacttaccaagtcaggaccatctccaatcgcaccatccaacagttgtgggagttcgacgcgctgtcgttcgattacttcaaagccatcggaacttaccccacagtccaagacttgtacggttgcacacagaagaagatagacggctacatctaccacacacttcagtcgaagtacccggacattcataaggggaatatgtcaaccaccttgcagaaaatcatcaagacctggaaatccagacggaacgaaatccgcaagggcgagatgagcattccctccttccgcaacaggatacccattgacctccacaacaacagcgtggacatcaaaaaagagaaaaacggggactacatcgctggaatttcgttgttcagtcgggacttccacaaggagaactcggatgtcccaaagggcaagatattcgtcaaactcgccaccaagaaacagaagtccatgaagatcattctcgaccgcctgatgaaccagacctactcaaaaggtgcctgcatgattcacaagtacaagaataagtggtacttgagtatcacgtacaagttcaacgctattaaggagaacaatttcgacaaggagttgataatgggaattgacatgggtgggattaacacggtgtacttcgcgttcaacgagggcttcattcgcagcaatatcaagagcgacgagattaaggcgttcaacgagaagatacggcagcgacgcatcaacctcctcaagcagtcgaactactgttccaacagtcgtactggcaagggccgggccaaacggctccagcccatcgacgtcctctccaacaagatagcaaagttccgaaatagcacgaatcacaagtacgcgaactacatcatcaagcagtgtctcaaacacaactgcgggagaatccagattgagttgctcaaggggataagtaagaacgacaaggtgctcaaggactggacttactttgacttacaggaaaaaatcaagaatcaggctgaggtgcacggcattgaggtcatcaaggtggcgtcagcctacaccagccagaggtgctctcagtgcggctatatctgcaaggagaaccgctgcacccaggccgtattcgagtgtaagcagtgtggatacaagacgcacgctgactacaacgcagccaagaacatcgcaacctacgacatcgagaatatcatcaacaagcagctcgccgtgcagtcgaagctccactccaaaaagtgtatggaggagtacatcgaggaactgggctacttggactga

SEQ ID NO: 2975 - DNA, 1335 bp, Unknown
  Bacillus sp. multi
atgaagtaccaaatcctatgccccatgaacgttgactggacgatcttcgagaagcacttgcgaaacctgacctaccaagtccgcactatctccaatcgaaccatccagcagctctgggagttcgacgccttgtcattcgactacttcaaggccatcggaacgtacccgacagtacaagacctatatggctgtacccaaaaaaagatcgacggctacatctatcacactcttcagtccaaatacccggacattcacaagggaaacatgagcaccacgttgcagaagattatcaagacttggaaatcgaggcgcaacgagattcggaagggtgagatgtcgatcccatcctttcgcaaccgcatcccaatcgacctccacaacaactccgtggacatcaagaaagagaagaatggggactacatcgcgggaatcagtctattctccagggacttccacaaggaaaactccgacgtaccgaagggcaagatattcgttaagctggcgaccaaaaagcagaagtctatgaagatcatcctggaccggttgatgaaccagacctactcgaaaggtgcgtgcatgatccacaagtacaagaacaagtggtatctatcaatcacttacaagttcaacgctattaaggagaacaacttcgataaggaactaatcatgggcattgacatgggcgggatcaataccgtttacttcgcattcaacgagggattcatccgaagcaatatcaagtcggacgagatcaaggcgttcaacgagaagatccggcagagacggattaacctcctcaaacagtccaactattgctcaaactcacgtaccgggaaaggccgagcgaagcgcttgcagcccattgacgttctctcgaacaagatcgccaaattccgcaattcgaccaaccacaagtacgccaactacattatcaagcagtgcctcaagcacaattgcggccgtattcagatagagctacttaagggaatcagtaagaatgacaaggtgctcaaagactggacctactttgacctccaggaaaaaatcaagaatcaggccgaggttcacggcatcgaggttattaaggttgcctccgcttacacctcacagcggtgctcacagtgcggctacatctgtaaggagaataggtgcacccaggccgtgttcgagtgcaagcagtgcggctacaagactcacgctgactacaacgcggccaagaacatcgctacctacgacatcgagaacatcatcaacaagcagcttgcggtacagagcaagctccactccaaaaagtgtatggaggagtacatcgaggaactaggctacctggactga

SEQ ID NO: 2976 - DNA, 1335 bp, Unknown
  Bacillus sp. multi
atgaagtaccaaatcctttgccccatgaacgttgactggaccatcttcgagaagcacttaaggaacctgacctatcaagttcgtacgatcagcaaccggaccatccagcagctctgggagttcgacgccctctccttcgactatttcaaggccatcggcacctacccgaccgtccaagacctttacgggtgcactcagaagaaaattgacgggtacatctatcacaccttgcaaagcaaatacccagacatccacaaggggaatatgagtaccacgcttcagaagatcattaagacatggaaatcacggaggaacgagatcaggaagggcgagatgtccatccccagcttccgcaaccgcatccccatcgaccttcacaacaactccgtggacatcaaaaaagagaagaacggggactacatcgccggaatttcgttgttcagccgtgacttccacaaggagaactccgacgtcccaaaggggaaaatcttcgtgaagctggctaccaaaaaacagaagtcgatgaagatcatacttgacaggctcatgaaccagacctacagtaaaggagcctgcatgatacacaagtacaagaataagtggtatctatctattacctacaagttcaacgctatcaaggagaacaacttcgacaaggagctgataatggggatcgacatgggcggcatcaacacggtgtacttcgcgttcaacgagggcttcatccgaagcaacattaagagcgacgagattaaggctttcaacgagaagatacggcagaggaggataaacttactcaagcaaagcaactattgttccaactccagaactggcaaggggagggctaaacgcctccagcctatcgacgtgctttccaacaagattgccaaattccgaaatagtaccaaccacaagtacgctaactacatcattaagcagtgcctcaagcacaactgtgggcgtatccaaatcgagttgctcaagggtatttccaagaatgacaaggtgcttaaggactggacatacttcgacctccaggagaagatcaaaaaccaggccgaggttcacggtatcgaagtcatcaaggtcgcctcagcctacaccagccagaggtgctcacagtgtggctatatctgcaaggaaaatcgttgtacccaggcagtgttcgaatgcaagcagtgcgggtacaagacgcacgccgactacaacgccgccaagaacattgcaacatacgacatcgagaacatcatcaacaagcagttggcggtgcaaagcaagctccactccaaaaaatgcatggaggagtacatcgaggagctgggctatctggattag

SEQ ID NO: 2977 - DNA, 1335 bp, Unknown
  Bacillus sp. multi
atgaagtaccagatactgtgcccgatgaacgtggactggaccatcttcgagaagcacctccgcaacctcacataccaagtccgaaccatctctaatcgcaccatccagcagctttgggagttcgatgccctgtccttcgactacttcaaagccatcggcacctaccccacggtccaagacctgtacggatgcacccagaagaagattgacgggtacatctaccacaccctccagtcaaagtaccccgacattcacaagggcaatatgagcaccactctccaaaaaatcattaagacgtggaagtcaaggcggaacgaaatccgtaagggcgagatgtcaattccgtcattccgaaaccgtatccccattgacctgcacaacaactccgtggacatcaagaaggaaaaaaatggggactacatcgctggaatttccttgttctctagggatttccacaaggagaatagtgacgtcccgaagggcaagatattcgtgaagctcgctaccaagaagcagaaaagtatgaagatcatcctcgaccgcctgatgaaccagacgtacagtaagggtgcttgcatgatccacaagtacaagaataagtggtatttgagtattacatacaagttcaacgcgattaaggagaacaactttgacaaggaactgattatgggcattgacatgggcgggattaacaccgtgtactttgccttcaacgagggattcatccggagcaacatcaagagcgacgagattaaggcgttcaacgagaaaatccgtcagaggcggatcaacctgctcaaacagtccaactactgctcaaactcaagaaccggaaaggggcgcgcgaagcgcttacagcctattgacgtgctctcgaacaagatcgccaaattccgcaactccacaaaccacaagtacgccaactacatcatcaagcagtgccttaaacataactgtgggagaatccagatcgaactattgaaagggatttccaagaacgacaaggtgctcaaggactggacctacttcgacctacaggagaagatcaaaaaccaggcagaggttcacggtattgaggtcatcaaggttgcttcggcatacacctcccagaggtgcagtcagtgcggctacatctgcaaggaaaaccgatgcacgcaagccgtgttcgagtgcaagcagtgcggctacaaaacccacgctgactacaacgctgccaagaatatcgcaacctatgatattgagaacattatcaacaagcagctcgccgtgcagtctaagctccacagcaaaaagtgtatggaggagtacatcgaggaattgggctacctcgactag

SEQ ID NO: 2978 - DNA, 1335 bp, Unknown
  Bacillus sp. multi
atgaagtaccagattctatgcccgatgaacgtggactggactatcttcgagaaacaccttcggaatctcacgtaccaagttcgtaccatctccaacaggaccatccagcagctttgggagttcgacgccctctccttcgactacttcaaggccatcgggacgtaccccacagtccaggacttgtacggttgcactcaaaaaaagattgacggttacatctaccacaccctccaaagcaagtaccccgacattcacaagggcaatatgagcacgaccctacagaagatcatcaagacttggaaaagtcgtcggaacgagattcggaaaggcgaaatgagcatcccgtctttccgcaaccgcatccccatcgacttgcacaacaactcagtggacatcaaaaaggagaagaatggcgactacatcgcggggatcagcttgttcagccgcgacttccacaaggagaactccgacgttccaaagggcaaaatcttcgttaaactggccaccaaaaagcagaagtccatgaagatcatcttggataggctgatgaaccagacgtactctaagggagcctgcatgatccacaagtacaagaacaaatggtatctgagcatcacctacaagttcaacgccatcaaggagaacaacttcgacaaggagctaatcatggggatcgacatgggtggtatcaacactgtgtactttgcattcaacgagggcttcattcggtcgaacatcaagtcggacgagatcaaggcgttcaacgagaaaatccggcagaggcggatcaacctactaaagcagagcaactactgctccaacagtcgcaccgggaaagggcgcgctaagcgcttgcagcctattgacgtgctttccaacaagatagccaaattccggaactcaacaaaccacaagtacgccaactacatcatcaagcagtgcctcaaacacaactgcgggcggatacagatcgaactgctcaaaggaatctctaagaacgacaaggtgcttaaggactggacgtatttcgatctccaggagaagatcaaaaaccaggccgaggtccacgggatcgaagtcattaaggtggctagtgcatacacctcgcagaggtgcagccagtgcgggtatatctgtaaggagaatcgttgcacccaggcagtcttcgagtgcaagcagtgcggatacaagacccacgcggattacaacgcggccaagaacatcgctacctacgacattgagaacatcattaacaagcagctcgccgtgcagtctaagctacacagcaaaaagtgtatggaggagtacatcgaggagctgggttacttggactga

SEQ ID NO: 2979 - DNA, 1335 bp, Unknown
  Bacillus sp. multi
atgaagtaccagatactgtgccccatgaacgtggactggacaatcttcgagaagcacctacggaacctgacctaccaagtgagaacgatttcgaaccggacaatccagcagctatgggagttcgacgccctttccttcgattactttaaggcaatcgggacgtaccctacagtccaggatctctacggctgcacgcagaagaagatagacgggtacatctaccacacgctccagagcaagtaccccgacattcacaaggggaacatgagcaccacacttcagaagatcatcaagacctggaaatcgagacgcaacgagatccgcaagggagagatgtccatcccgtccttccgaaacagaatacctattgatctgcacaacaattccgtggacattaagaaagagaagaatggggactacattgccgggatctcactgttcagccgcgacttccacaaggaaaactctgacgtccctaagggcaagatattcgtaaagctcgccaccaagaagcagaagtctatgaagatcatactggaccgtctcatgaaccagacgtacagcaaaggagcgtgcatgatccacaagtacaagaacaagtggtacttgtccatcacgtacaaattcaacgccattaaggaaaacaacttcgacaaggagctaatcatgggcattgacatgggcgggatcaacacagtttacttcgccttcaacgaaggcttcatccggagcaacattaagagcgacgagatcaaggctttcaacgaaaaaatccggcagaggcggatcaacctgctaaaacagagtaactactgttcaaactctaggaccgggaaaggcagagctaaacgactacagccaatcgacgttctcagcaacaagatagcaaagttccgcaactcgactaaccacaagtacgcaaactacatcatcaagcagtgcctcaagcacaactgcgggcgcatccagattgagttacttaagggcatcagcaagaacgacaaggtgttgaaggactggacctacttcgacttacaggaaaaaatcaagaaccaggcggaggtgcacggaatcgaggttattaaggtggctagtgcatacacaagccagagatgctctcaatgcggttacatctgcaaggagaaccgctgcacccaggccgtctttgagtgcaagcagtgcggatacaagactcatgcggactacaacgccgccaagaacattgccacgtacgacatcgagaacattatcaacaagcagcttgccgtgcaatctaagctgcactccaaaaaatgcatggaggagtacatcgaggagctggggtacttggactga

SEQ ID NO: 2980 - DNA, 1335 bp, Unknown
  Bacillus sp. multi
atgaagtaccagatcctctgccccatgaacgtggattggaccatattcgaaaagcacctaaggaacctgacctaccaagttcgtaccatcagtaaccggactattcagcagctctgggagttcgacgccctgtccttcgactacttcaaggccatcgggacgtatccgaccgtccaagacctgtacggctgcacccagaagaagattgacgggtacatctatcacaccttgcagtcaaagtacccggacattcacaaggggaacatgagcactaccctccagaaaatcatcaagacctggaagtcccggaggaacgaaattcggaagggagagatgagcattccctcgtttcggaaccgcatccctatcgacctacacaacaactcggtggacatcaaaaaagagaagaacggagactacatcgcggggatctcactgttcctcagggactttcacaaggagaactccgatgtcccaaaaggcaaaatcttcgtaaaactggctaccaaaaagcagaagtctatgaagataatccttgaccgccttatgaaccagacctactctaaaggtgcctgcatgattcacaagtacaagaacaaatggtacttatccatcacatacaagttcaatgcgattaaggagaacaatttcgataaggagttgataatgggaatcgacatgggcgggataaacaccgtgtacttcgctttcaacgagggcttcatccgctcgaacattaagagtgacgagatcaaggcgttcaacgagaagattcgtcagaggcggatcaaccttctaaaacagagtaactactgctccaactcgcggactgggaaggggagggccaagcgccttcagcccattgacgtgctttccaacaagatcgccaagttccgcaactctaccaaccataagtacgctaactacatcatcaagcagtgccttaagcacaactgtggaaggatacaaatagagctgctcaaagggatctctaagaatgacaaggtgctaaaggactggacctatttcgacctacaggagaagatcaaaaaccaggccgaggtgcacgggatcgaggttatcaaggtcgcatcggcctacacttcccagaggtgctcccagtgcgggtacatctgcaaggagaaccgatgcacccaggccgtgttcgagtgcaagcagtgcggttacaagacccacgctgactacaacgcggctaagaatatcgccacctacgacattgaaaacatcattaacaagcaactcgctgtacagtcaaagttgcactccaaaaagtgtatggaggagtacatcgaggagctgggctacttggactga

SEQ ID NO: 2981 - DNA, 1335 bp, Unknown
  Bacillus sp. multi
atgaagtaccaaatcctgtgcccgatgaacgtggactggaccatcttcgagaaacacctccggaacttgacctaccaagtccggaccatctcgaaccgcacaatccagcaactctgggagttcgacgccctatccttcgactacttcaaggccattggcacctacccaactgttcaagacctctacggatgcacccagaagaaaattgacgggtacatctaccacacattacagtccaaataccccgacatacacaagggcaatatgtcaacgacactccaaaaaatcatcaagacatggaaatctaggcgtaacgagatccgaaagggcgagatgtcaataccgtccttccgcaacagaatacccatcgacctgcacaacaactctgtggacattaagaaggaaaaaaatggcgactacatcgctgggatcagcctcttcctccgggacttccacaaggagaacagcgacgtgccaaaggggaaaatcttcgtgaagctggccaccaagaagcagaagtctatgaagattatcctggatcggttgatgaaccagacctacagcaagggagcttgcatgatccacaagtacaagaataagtggtacttgtcgattacctacaaattcaacgctatcaaggagaacaacttcgacaaggagttaatcatggggatagacatgggtggtattaacacagtttacttcgccttcaacgagggattcattcggtccaacattaagtctgacgagattaaggcgttcaacgagaagatacgccagaggaggatcaacctccttaagcagtccaattactgctccaactcccgaactggcaagggtcgggctaagaggcttcagcccatcgacgtgctgtcgaacaagatcgccaaattccggaacagcacaaaccacaagtatgcaaactacatcattaagcagtgcctcaagcacaactgcggcagaatccagatcgaattactaaagggcatctccaagaacgacaaagtattgaaagactggacgtacttcgacctccaggagaagatcaaaaaccaggctgaggtgcacggtatcgaggtcattaaggtggcctcggcctatacttctcagcggtgcagccagtgcggctacatctgcaaggaaaaccgctgcacccaggctgtcttcgagtgcaagcagtgcggctacaagacccacgctgactacaacgctgccaagaatatcgctacttacgacatcgagaacatcatcaacaagcagctcgcagtgcagtcaaaacttcactccaagaagtgtatggaggagtacatcgaggaactgggctacctcgactaa

SEQ ID NO: 2982 - DNA, 1335 bp, Unknown
  Bacillus sp. multi
atgaagtaccaaatcctatgtcccatgaacgttgactggacgatattcgagaaacaccttcgcaacctgacatatcaagtccgcaccatatccaacagaacaatccagcaactctgggagttcgacgccttgtcctttgactacttcaaggccattggaacgtaccccacggttcaagacctttatggatgcactcaaaaaaaaatcgacggctacatctaccataccctgcaaagcaaataccccgacattcacaagggcaatatgagcactacccttcagaaaatcatcaagacctggaagtcacgccgtaacgagatcaggaagggtgagatgtccataccctccttccgaaaccgcattccaatagacctgcacaacaacagcgtggatattaagaaagagaagaacggcgactacattgccgggatctccctgttcctgcgcgacttccacaaggagaactccgacgttccgaaggggaagatattcgtgaagttggccaccaagaagcagaagtctatgaagatcatcctggacagactgatgaaccagacttacagcaagggagcgtgcatgatccacaagtacaagaataagtggtatcttagcattacctacaagttcaatgctattaaggagaacaacttcgacaaagagctgataatgggcattgacatgggtgggattaacaccgtgtacttcgcattcaacgagggcttcataaggtcaaacatcaagagcgacgagattaaggcgtttaacgagaagatccggcagaggaggatcaacctcctcaagcagtccaactactgctccaactcacgtaccgggaaggggagggctaagcgcctacagcctatcgacgtcctctcgaacaagatcgccaaattccgtaatagtacgaaccacaagtacgctaactacatcatcaagcagtgcctcaagcacaactgcgggagaatccaaattgaactcctaaaaggaatctccaagaatgataaggtgctcaaggactggacctacttcgatctacaggagaagatcaaaaaccaggccgaggtgcacgggatcgaggttattaaggtcgcctccgcctacacctctcagcgctgctcgcagtgcggctacatctgcaaggagaaccggtgcacccaggccgtcttcgagtgcaagcagtgcggctacaaaacccacgctgactacaacgcggccaagaatatcgccacctacgacattgagaacatcatcaacaaacagttggctgttcaaagcaagctgcatagcaagaaatgcatggaggagtacatcgaggagttggggtatttggactga

SEQ ID NO: 2983 - DNA, 1335 bp, Unknown
  Bacillus sp. multi
atgaagtaccagatcctatgccctatgaacgtcgattggacgatcttcgagaaacacctaaggaacctcacctaccaagtgcgaaccatctccaaccgcaccatccagcaactgtgggagttcgacgcactctccttcgactacttcaaggccattggcacctacccgacggtccaggatctctatggctgtacccagaagaaaatcgacggctacatctaccacactcttcagtccaagtaccccgacatccacaagggcaatatgagcacgacccttcagaaaatcattaagacctggaagtcccgccggaacgagatccgcaagggtgaaatgagtatcccctccttcagaaaccggattcctattgacttgcacaacaacagcgtggacatcaaaaaagagaagaacggggactacatcgctggtatctcgctcttcctccgtgacttccacaaggagaacagcgacgtccctaagggcaaaatcttcgtcaagctggcgaccaaaaagcagaagtcgatgaagatcatcctcgaccgactcatgaaccagacgtacagcaagggtgcctgcatgatccacaagtacaagaataagtggtatctctccatcacatacaagttcaatgcgatcaaggagaacaatttcgacaaggagctaatcatgggaattgacatgggcgggataaacacagtttacttcgccttcaatgaggggttcattagatccaacattaagtccgacgagattaaggcgttcaacgagaagattcggcaacgccgcattaacctccttaagcagagcaactactgctcaaattcacgaaccgggaaaggccgtgcaaagcgtctccagccaattgacgttctcagcaacaagatcgccaagttccgcaacagcaccaaccacaagtacgcaaactacatcattaagcagtgccttaaacacaactgcggacggattcagattgagctactaaaggggatctccaagaacgacaaggtgctcaaagactggacatacttcgacctccaggagaagatcaaaaaccaggcagaggtgcacggaatcgaggttattaaggttgcctccgcttacaccagccagcgctgctcacagtgcgggtacatctgtaaggagaaccgttgcactcaggcggtgttcgagtgcaagcagtgcggctacaagacccacgccgactacaacgcggccaagaatatcgccacttacgatattgagaatatcatcaacaagcagttggcggtccagagcaagctgcacagcaagaagtgtatggaggagtacattgaggagctgggatacctagactga

SEQ ID NO: 2984 - DNA, 1335 bp, Unknown
  Bacillus sp. multi
atgaagtaccaaatactctgtcccatgaacgtggactggacgatattcgagaaacacctcaggaacctgacttaccaagtgcgtaccatctccaaccgaaccatccagcagctttgggagtttgacgccctcagcttcgactatttcaaggccatcggcacgtaccccaccgtccaagacctttacggctgcacccagaagaaaatcgacgggtatatctatcacaccctccagtctaagtacccggacatccacaaagggaatatgagcaccacattgcaaaaaatcattaagacttggaaaagccgccgcaacgagatccgaaagggcgagatgagcatcccctccttccgaaatcgcatccctattgatctacacaacaactcagtggatatcaagaaagagaaaaacggggactacatcgcgggtatcagcttgttcctccgagacttccacaaggagaactccgatgtccctaagggcaagatattcgtgaagttagctaccaagaaacagaagtccatgaagatcatcctggacaggcttatgaaccagacctactcgaaaggggcctgcatgatccacaagtacaagaataagtggtatttgagtattacttacaaattcaacgctatcaaggagaacaatttcgacaaggaactgattatgggaatagacatgggcggcatcaacactgtttacttcgctttcaacgagggcttcatccgatccaacatcaagagcgacgagattaaggcgttcaacgagaagattcgtcagcggaggatcaatctcctcaagcagagcaattactgctccaattcacgcaccgggaaggggcgcgcaaagaggcttcagcccatcgacgtcctgagcaacaagatcgcaaagttccgcaactcaacgaaccacaagtacgccaactacatcattaagcagtgccttaaacacaactgcggacggattcaaatcgagttgctcaaaggaatctccaagaacgacaaagttctcaaagactggacatacttcgacctccaggaaaaaatcaagaatcaggcggaggtccacgggatcgaggtcattaaggttgcatctgcatacacaagccagcggtgcagccaatgcgggtacatctgcaaggagaaccgctgcacccaagcggtcttcgagtgcaagcagtgcggctacaagactcacgcggactacaacgccgccaagaacatcgctacttacgacattgagaacatcatcaataagcagctcgcagttcagtccaagctgcactccaagaagtgtatggaggagtacatcgaggaattgggttacctcgactga

SEQ ID NO: 2985 - DNA, 1335 bp, Unknown
  Bacillus sp. multi
atgaagtaccagatcctctgccctatgaacgtggactggaccatcttcgagaagcacctccgcaacttgacataccaagttcggactatctcaaaccgaaccatccagcagctctgggagtttgacgccttatccttcgactacttcaaggctatcggcacttaccccaccgtgcaagacctctacggctgcactcagaagaaaatcgacggctacatctaccacatactccagtctaagtatcccgacatccacaagggaaacatgagcactactctccagaaaatcatcaagacttggaaatctcgacgcaacgaaatccgtaagggcgaaatgagtatcccatcgtttcgtaaccgaataccgattgatctacacaacaactccgtggacattaagaaggaaaaaaacggggactacatcgcgggcatatcacttttcagccgggatttccacaaggagaacagcgacgtgcctaagggcaaaatcttcgtgaagttggccaccaagaagcagaagtctatgaagatcattctggatcggcttatgaaccagacttactcaaaaggcgcgtgcatgattcacaagtacaagaataagtggtacttatcaatcacttacaagttcaacgctattaaggaaaacaactttgacaaggagttgataatggggatcgacatgggcgggataaacaccgtgtacttcgcattcaacgagggcttcatccgttcaaacatcaagtccgacgagattaaggcgtttaacgagaagattcggcagaggcggatcaacctcctcaagcagtccaactactgctcaaactcccgaaccgggaaggggcgggccaagcagctccagcccattgacgtcctcagtaacaagatcgccaagttcagaaacagcacgaaccacaagtacgccaactacatcattaagcaatgcttgaagcacaactgtgggaggatacagattgagttactcaagggcatctccaagaatgataaggtgctcaaggactggacctacttcgacctccaggagaagatcaaaaaccaggcggaggtccacggcattgaagttatcaaggtcgccagtgcctacacatcccagaggtgcagccagtgcgggtacatctgtaaggagaaccggtgcacccaggcagtgttcgagtgcaagcagtgtggttacaagactcacgcggactacaacgccgccaagaacattgcgacgtacgacattgagaacattatcaacaaacagctcgcagtgcagtctaagttgcacagcaaaaagtgtatggaggagtacatcgaggagctgggctacctcgactaa

SEQ ID NO: 2986 - DNA, 1335 bp, Unknown
  Bacillus sp. multi
atgaagtaccagatcctctgcccgatgaacgtggactggaccatattcgagaagcacctccgcaacctcacttaccaagtccgtactatctccaaccgtacgatccagcagctatgggagttcgacgccctcagctttgactactttaaggctatcggaacctaccccaccgttcaagacctttatggctgcacacagaagaagatcgacgggtatatctatcatatcctacagtccaagtacccagatattcacaaggggaacatgagtaccaccctccagaagatcatcaagacttggaaatccaggcgtaacgagatccgcaagggcgaaatgtcgatcccatccttccggaaccgcataccaatcgacctccacaacaactccgtggacattaaaaaggagaagaatggcgactacatcgctggcatctccttattcagtagagacttccacaaggaaaactccgacgtgcctaaggggaagatattcgtcaagctggctaccaaaaaacagaagtccatgaagatcatattggatcgactgatgaaccagacgtactcaaaaggagcttgcatgatacacaagtacaagaataagtggtatctctcgatcacatacaagttcaacgcgatcaaggagaacaacttcgacaaggagctgataatgggcatcgacatgggtgggataaacaccgtttacttcgccttcaacgaggggttcattcggtccaatatcaagtccgacgagatcaaggctttcaacgaaaaaatccggcagagacgtatcaacctgctcaagcagtccaactactgttccaattcaagaaccgggaagggccgggcaaagcagctacaacccatcgacgtcctgtccaacaagattgccaagttccgaaacagcacaaaccacaagtacgccaactacatcatcaagcagtgccttaaacacaactgcggtcgcattcagatcgagctgttaaaggggatctccaagaacgacaaggtgctaaaggactggacttacttcgatctacaggaaaaaatcaagaaccaggccgaggtccacgggattgaagtgattaaggtggcctcagcctacaccagccagcgatgcagccagtgcggctacatctgcaaggagaaccgatgcactcaggcagtgttcgagtgcaagcagtgcgggtacaagactcacgccgactacaacgctgccaagaacattgccacctatgacattgagaacattatcaacaagcagttggcggttcagtctaaactgcacagcaagaagtgtatggaggagtacattgaggaattgggatacctcgactag

SEQ ID NO: 2987 - DNA, 1335 bp, Unknown
  Bacillus sp. multi
atgaagtaccagattctatgccccatgaacgtggattggacgatcttcgagaagcaccttcgcaacttgacgtaccaagttcgcacaatatcgaaccgcaccatccagcagctctgggagttcgacgccctgtctttcgactacttcaaggccatcggcacctaccccaccgtccaagacctttatggttgcactcagaagaagatagacggctacatctaccacatcctccagtccaagtacccggacatccacaaggggaatatgtcaaccaccttgcaaaaaatcatcaagacttggaaatctaggcggaacgagatcaggaaaggagaaatgtccatcccatcgtttcggaaccgtatccctatcgaccttcacaacaacagtgtggacattaagaaggaaaaaaatggggactacattgccggaatatcgctcttcagtcgtgacttccacaaggagaactcagacgtgcctaaaggcaaaatcttcgtgaaactggccaccaaaaaacagaagtcgatgaagatcatcctggaccgcttgatgaaccagacttactcaaagggtgcctgcatgatccacaagtacaagaacaagtggtacttatcaatcacctacaagttcaacgctatcaaggagaacaacttcgacaaggagttgataatggggattgacatgggtgggatcaacaccgtgtacttcgccttcaacgagggattcatacgaagtaacattaagtcagacgagattaaggcgttcaacgagaagatacggcagcgtcggatcaacctattgaagcagtccaactactgctccaactccaggactggcaagggacgggcaaagcagttgcagcccatcgacgtcctgtcaaacaagattgcgaagttcagaaactccacgaaccacaagtacgcaaactacatcattaagcagtgccttaaacacaactgcggcagaatccaaatcgagctattgaagggtatctctaagaacgacaaggtgttgaaagactggacctacttcgacctccaggagaagatcaaaaaccaggcggaggtgcacggtatcgaggtcatcaaggttgcgtcagcctataccagtcagcgatgctcgcagtgcgggtacatctgcaaggagaatcgctgcacccaggctgtcttcgaatgcaagcagtgcgggtacaagacccacgccgactacaatgccgccaagaacattgctacttacgacatcgagaacatcatcaataagcagctcgctgtgcagtctaagctccactccaagaagtgtatggaggagtatatcgaggaattgggctacctagactag

SEQ ID NO: 2988 - DNA, 1335 bp, Unknown
  Bacillus sp. multi
atgaagtaccagatcctctgtccgatgaacgtggactggaccatcttcgagaaacacctccgtaacctgacctaccaagtccgtacgatctcgaaccgcacgatccagcagttgtgggagttcgacgcgctcagtttcgactacttcaaggccatcggcacctaccccaccgtacaggatctctacggctgcacgcagaagaaaattgacgggtacatctaccacatccttcaaagcaagtatcccgacattcacaagggaaacatgagcacgacactccaaaaaatcattaagacctggaaatccaggagaaatgagatccggaagggcgagatgagcatcccctcgttccgaaaccgcatcccaatcgacctccataacaactcggtggacattaagaaagagaagaatggcgactacatcgcgggcatatcactcttcagccgcgacttccacaaggaaaactctgacgtgccaaaggggaaaatcttcgttaagctggccaccaagaaacagaagtccatgaagatcatcctcgataggctgatgaaccagacctacagcaagggagcctgcatgattcacaagtacaaaaacaaatggtacttatccattacctacaagttcaacgccattaaggagaacaacttcgacaaggagttgataatggggattgacatgggtggcatcaacacagtgtacttcgccttcaacgagggcttcatacggtcgaacattaagtccgacgagattaaggcgttcaacgagaaaatccgacaaaggcgcatcaacctcctcaaacaaagcaactattgctcaaattcaaggactggaaagggccgcgctaagcagcttcagcctattgacgtcttgtccaacaagatcgccaagttccgaaattccacaaaccacaagtacgccaactacatcatcaagcaatgtctcaagcacaattgcggccgtatccagatcgagttactcaaggggatctccaagaacgacaaggtgctcaaggactggacctactttgacctccaggaaaaaatcaagaatcaggcggaggtgcatggtattgaggtgattaaggtggcctcagcctacacctcccagaggtgctcacagtgcggctacatctgtaaggagaatcggtgcacccaggccgttttcgagtgcaagcagtgcgggtacaagacacacgccgactacaacgccgccaagaacatcgcaacatacgacattgagaacattatcaataagcagttggcggtgcagtccaagctgcattccaaaaagtgtatggaggagtacatcgaggagcttggctacttggactag

SEQ ID NO: 2989 - DNA, 1335 bp, Unknown
  Bacillus sp. multi
atgaagtaccagatcctatgccccatgaacgtcgattggaccatcttcgagaagcacctccggaatctcacctaccaagtacgcacaatctccaaccgcacaatccagcagttgtgggagttcgacgctttatcgtttgactacttcaaggccatcggcacctacccaaccgtccaggacttgtacggttgcacccagaagaagattgacgggtacatctaccacatactccagtccaagtatcccgacatccacaagggcaacatgagcactaccctacagaagattatcaagacgtggaaatcccgccgcaacgagatccggaagggcgagatgtccataccttcgtttcgcaatcgcatcccaatcgacctccacaacaactccgtggacatcaagaaagaaaaaaatggcgactacatcgccgggatcagcctgttctctagggacttccataaggaaaacagtgacgtaccgaagggcaaaatcttcgtgaagctggccaccaagaaacagaagtctatgaagatcattcttgaccggctcatgaaccagacctatagtaagggcgcttgcatgatccacaagtacaagaacaagtggtatcttagtatcacctacaaattcaacgcgattaaggagaacaacttcgataaggagcttatcatgggaattgacatgggcggcattaacaccgtttacttcgctttcaacgaggggtttatccgctccaacattaagtccgacgagatcaaggcgttcaacgagaagatccgccagagacgcatcaatctgttgaagcagagtaactactgctcaaattccaggactgggaagggcagagctaagcagcttcagcctattgacgttctctcaaacaagatcgccaagttccgtaactccacgaaccacaagtacgcgaactacatcatcaagcagtgcctcaaacacaactgcggccggatacaaatcgagctattgaagggcatcagcaagaatgacaaggtgctcaaagattggacttactttgacctccaggagaagatcaaaaaccaggccgaggtgcacgggatcgaggttattaaggtcgcctccgcatacacgagccagagatgcagtcagtgcgggtacatctgcaaggagaaccggtgcactcaggccgttttcgagtgcaagcagtgcggttacaagacgcacgcggattacaacgccgccaagaacattgctacttacgatattgagaacatcatcaacaagcaattggctgtgcaaagcaagttgcactccaagaaatgcatggaggagtacattgaggagttgggttacctggactga

SEQ ID NO: 2990 - DNA, 1314 bp, Unknown
  Bacillus sp. multi
ctcggcgttaccatcaagatcatgaagtaccagatcctgtgcccgctgaatgtggactggacgatcttcgagaaacacctgagaaacctgacctaccaagtccgcaccatatcgaacaggaccatccagcagctctgggagttcgacgccctgtccttcgattacttcaaggaacgtggaacgtatccaaccgttcaagacctctatggctgcactcagaagaagatcgacggctacatctaccataccttacaatcgaagtatcccgacatccacaagggcaatatgtcaactaccctccagaagattatcaagacatggaagtcgaggcggaacgaaattcgcaagggtgagatgtcgatcccatccttccggaaccgcatccctattgaccttcacaacaacagcgttgacattactaaggaaaaaaacggagactacattgcggggatctccttattcagtagggatttccacaaggaaaacgacgacgtgcctaagggcaaaatcttcgtaaaactggcaacgcagaagcagaagtctatgaaggtgatcctggaccgacttattaaccagacctacagcaagggagcctgcatgattcacaagtacaagaacaagtggtatctatccatcacctacaagttcaatgcgatcaaggagaacaaattcgacaaggagctgattatgggcattgacctcggcgggatcaacacagtgtactctgcattcaacgagggcttcatccgttccaacatcaagagcgacgagatcatacggcagaggaggatcaatctcctcaagcaatccaagtattgctccaactcacgaaccggaaaggggcggactaagcgccttcaaccgattgacgttctctccaacaagatcgccaagttccgaaactctacaaaccacaagtacgccaactacatcgtcaagcagtgcctcaaacacaactgcggccgtatccagatggagttgctcaaggggatctctaagaatgaccgcatattgaaggactggacatacttcgatctccaggagaagatcaaaaaccaggcggagatacacgggatcgaggttatcaaggtggctccagcctacacgagccagcggtgctcacagtgcggctatatctgtaaggagaaccggtgcacccaggccacctttgagtgcaagcagtgcgggtacaagacccacgccgactacaatgccgccaagaacattagcacatacgacatcgagaacatcatcaacaaacagctcgccgtccagtcaaagctccactccaagaacgtatggaagtctatctga

SEQ ID NO: 2991 - DNA, 1314 bp, Unknown
  Bacillus sp. multi
ctcggcgtaacgatcaagatcatgaagtaccagatactctgcccactcaacgtggactggaccatcttcgagaaacaccttcgcaacctcacctatcaagtgaggaccatctccaatcggacgatccagcagctatgggagttcgatgccctatcgttcgattacttcaaggagcgtggcacgtaccccaccgttcaagacctctacggatgcactcagaagaaaatcgacggttacatctaccacaccttgcaatctaagtaccctgacatccacaagggcaacatgagcaccacccttcagaaaatcattaagacctggaagtcccggcgcaacgagattcggaagggtgagatgtctatcccctccttccgcaaccgcatcccaatcgacctccacaacaactccgttgacatcactaaggagaagaacggtgattacatcgctggaatctccttattcagccgtgacttccacaaggagaacgacgacgttcctaaaggcaagatattcgtgaagctggcaacgcagaagcagaagtccatgaaggtcatcttggatcgccttatcaaccagacctactccaaaggtgcgtgcatgatacacaagtacaagaataagtggtatctatcaattacctacaaattcaacgccatcaaggagaacaaattcgacaaggagctgattatgggcatcgacctcggcgggatcaacacagtgtactctgccttcaacgaagggttcatccgttccaacatcaagtcagacgagatcatccgccagcgccgcatcaatttgctaaagcagtccaagtattgttccaactcaaggacaggaaaggggcggaccaagcgtcttcagccaattgacgttctatccaacaagatcgctaagttccgaaactcgactaaccacaagtacgcaaactacatcgttaagcaatgtctaaaacacaactgtgggcgcatccagatggaattactaaaagggataagcaagaacgaccgcatcctcaaggactggacctacttcgatctacaggagaagatcaaaaaccaggccgagatccacgggattgaggtgattaaggtcgctcctgcatacacaagtcaacggtgttcccagtgcgggtacatctgcaaggagaaccggtgcacccaggcgacgttcgagtgcaagcagtgcggttacaagacgcacgctgactacaatgccgctaagaacatcagcacctacgacattgagaacatcatcaacaagcaattggctgtccaatctaagctgcattccaagaacgtctggaagtctatctag

SEQ ID NO: 2992 - DNA, 1314 bp, Unknown
  Bacillus sp. multi
cttggagttactattaagatcatgaagtaccagattctctgcccgctcaacgtggactggactatcttcgagaaacacctccggaacctgacctaccaagtgcgaacgatcagtaaccggaccatccagcagctctgggagttcgatgcactctcattcgactacttcaaggagcgcggaacctacccgaccgtccaagacctatatggatgcacacagaagaaaattgacggttacatctaccacacactccaaagcaagtacccggacattcacaaggggaacatgagcacaaccctccagaagatcatcaaaacttggaagtcaaggcgaaacgagatccgaaaaggtgagatgtcaattcccagcttccgaaaccgcattcccattgatctccacaacaacagcgtggacataactaaggagaagaacggtgactatatcgccggaatctcgttgttcagccgagactttcataaggagaacgacgatgttccgaagggtaagatctttgtgaagctggcgacgcagaagcagaaatccatgaaggttatcctcgaccggctgatcaaccagacttacagcaagggagcgtgcatgatccacaagtacaagaataagtggtacctatctattacttacaaattcaacgctatcaaggagaacaagttcgacaaggagctaataatggggattgatctgggtggtattaacacggtctactcagcattcaatgaggggtttatcaggagtaacattaagtcagacgagataatccgccagcggcgtatcaacctgctaaagcagtccaagtactgctccaactctcgcactggcaagggtcgcacaaagaggctccagcctattgatgtgctatccaacaagatcgcaaaatttcgaaatagcaccaaccacaagtacgccaactacattgtgaagcagtgccttaaacacaactgcggacgcatccaaatggagctattgaaggggatcagcaagaatgacaggattctcaaagactggacgtacttcgatctccaggagaaaataaagaaccaggcagagatccacgggatagaggttattaaagttgctcctgcctacacctcacagaggtgctcccagtgcggctatatctgtaaggagaaccggtgcacacaagccacattcgagtgcaagcagtgcggttacaagactcacgccgactacaacgcggctaagaacatctcaacctacgacatcgagaacatcatcaacaaacaactcgcggtgcagtccaagttgcactccaagaacgtctggaaatccatctga

SEQ ID NO: 2993 - DNA, 1314 bp, Unknown
  Bacillus sp. multi
ctaggcgtgaccatcaagatcatgaagtaccagatcctctgccctcttaatgtggactggacgatcttcgagaagcaccttcgcaacctgacctaccaagtccgcaccatctccaaccgcaccatccagcaactatgggagttcgacgccttgtcgttcgactatttcaaggagcgcggcacctatcccacagtccaagacctctacggatgcacccagaagaagattgacgggtacatctaccacacattacagtccaagtacccagacatccacaagggcaacatgagtaccaccctccagaaaatcatcaagacctggaaaagtcggaggaacgagatccggaaaggcgaaatgtccattcccagctttcgaaatcgcattccaatcgacctacacaacaactccgttgacattactaaggagaagaacggcgactacattgctggcatctcgctgttcagtagggacttccataaggagaatgacgacgttcctaaggggaaaatcttcgtaaagctggccacccagaagcagaagtcgatgaaggtgatccttgaccgcctcattaaccagacatactcaaagggagcttgcatgatccacaagtacaagaataagtggtacttatctatcacgtacaaattcaacgctattaaggaaaacaaattcgacaaggagctgataatgggaatcgacttgggtgggatcaacacggtgtacagcgcattcaacgagggcttcatacgatccaatatcaagtctgacgagatcatacgccagaggcgcattaacctacttaaacaatcgaaatactgttcaaactctcgtaccggaaagggtcggactaagcggctgcaacccatcgacgtattgtccaacaagatagccaagttccgcaatagcacgaaccacaagtacgccaactacatcgttaaacagtgccttaaacacaactgcgggcgcatccaaatggagttgcttaaggggatctctaagaacgaccggatcttaaaggactggacttacttcgacctacaggaaaaaatcaagaatcaggcagagattcacggcatcgaagtgattaaggtcgccccggcttacactagccagcgctgctcccagtgcgggtacatctgcaaggagaacagatgcacacaggccactttcgagtgcaagcagtgcggctacaaaacccacgctgactacaacgcggccaagaacatatcaacctacgacattgagaatatcatcaacaaacagcttgccgtgcagtccaaactgcacagcaagaacgtctggaagtccatctga

SEQ ID NO: 2994 - DNA, 1314 bp, Unknown
  Bacillus sp. multi
ttgggcgtgaccatcaagatcatgaagtaccagatactgtgtccactgaacgtggactggacaatcttcgagaagcacctccgaaatctcacctaccaagtgcggacgatctccaaccgcacaattcagcaactctgggagttcgacgccctgagctttgactacttcaaggagcgcggtacttacccaaccgtccaagacctctatggctgcactcagaagaagatagacggctacatctatcacacccttcagtccaagtacccggatattcacaaggggaacatgagcacaactctacagaagatcatcaagacttggaaaagtaggcgcaacgagatcagaaaaggcgagatgtccatcccatccttccgaaaccgcattcccattgacctgcataacaacagcgtggacatcactaaggagaagaacggcgattacatcgccgggatcagtctgttcagtagggacttccacaaggagaacgacgacgttccgaagggcaaaatcttcgtaaaactggctacacagaagcagaagtccatgaaggtcattcttgaccggctcatcaaccagacatactcgaagggcgcttgcatgatccacaagtacaagaacaaatggtatctctctattacttacaagttcaacgctattaaggagaacaaattcgacaaggaacttatcatgggaattgatctgggtggtatcaacaccgtttactccgccttcaacgaggggttcatacgcagcaacatcaagtccgacgagatcattagacagaggcgcatcaatctgctcaagcagtccaaatattgttccaactcaaggaccgggaagggccgcacgaagcgtctccaaccgattgacgtactgtccaacaagatcgccaagttcagaaactccacaaaccacaagtacgccaactacatcgtaaagcagtgtctcaagcacaactgtgggagaatccagatggaactgctcaaggggatcagcaagaacgaccgcattctaaaggactggacctacttcgatctacaggaaaaaatcaagaatcaggccgagatccacgggatcgaggtcattaaggtcgcaccagcatatacctctcagcgctgctcccagtgcggttacatctgcaaggagaaccggtgcactcaggctacattcgagtgcaagcagtgcggttacaagacacacgcggactacaacgcagccaagaacatctctacttacgacatcgagaacattatcaataagcagttggcggttcaatccaagctgcacagcaagaacgtctggaagtcaatatga

SEQ ID NO: 2995 - DNA, 1347 bp, Unknown
  Bacillus sp. multi
atgaagtaccagatcctctgccccatgaacgtggactggacgatattcgagaagcacctccggaacctcacgtaccaagtccgcactatcagcaaccgtacaattcagcagctctgggagttcgacgctctttccttcgactacttcaaagccatcgggacgtaccccaccgtccaggacttgtacggctgcacccaaaaaaagatcgacggttacatctaccacaccctacagtccaagtaccccgacattcacaaggggaatatgtcaaccacgcttcaaaaaatcatcaagacctggaaatcccgccgtaacgagatccgcaaaggcgagatgtccatcccttcattccggaacagaatacctatcgacttgcacaacaacagcgtggacatcaagaaggagaagaatggggactacattgcgggcatctcactgtttagtcgggacttccacaaggaaaactccgacgttcctaaggggaaaatcttcgtgaaactggccaccaaaaaacagaaatctatgaagatcattctggaccggctcatgaaccagacctattcgaaaggagcctgcatgatccacaagtacaagaataagtggtatttgagcatcacgtacaagttcaacgctatcaaggagaacaacttcgataaggaactaatcatggggatagacatgggcggcattaacaccgtgtacttcgcattcaatgagggattcatccgatccaacattaagtccgacgagatcaaggcgttcaacgagaagattcgtcagagacgcatcaacctcctaaagcagagtaactactgtagtaactccagaaccggcaagggcagagccaagcgtctccagccaattgacgtgctgtccaacaagatcgccaagttccgcaattctactaaccataagtacgccaactacatcattaagcagtgcctcaaacacaactgcggccgtatccagatcgagttgcttaagggcatcagcaagaacgacaaagtgcttaaagactggacctatttcgatctacaggaaaaaatcaagaaccaggctgaggttcacgggatcgaggtcatcaaggtggcatcagcctacaccagccagcgatgcagccagtgcggctatatctgcaaggagaaccggtgtactcaagccgtattcgagtgcaagcagtgtggctacaagacgcacgctgactacaatgcggctaagaacattgcaacctacgacatcgagaacattatcaacaaacagctcgccgtccagagcaagttgcatagcaagaagtgtatggaggagtacattgaggagtacatcgaggagttgggctacctcgactag

SEQ ID NO: 2996 - DNA, 1347 bp, Unknown
  Bacillus sp. multi
atgaagtatcagatcctatgcccgatgaacgtggattggaccatcttcgagaagcacctccggaacctcacctaccaagttcggaccatctccaaccgaaccatccagcagttatgggagttcgacgccctgtcgttcgactacttcaaggctatcggaacctatcctacggtccaagacctctatggctgcacgcagaagaagatagacggctatatctaccacaccctgcaatccaagtatcctgacatccataaggggaacatgagcaccaccctccagaagattattaagacctggaaatcgcggcgcaacgaaatcaggaagggtgagatgtctattccgtccttccgcaaccgcattcccattgacctgcataacaactctgtggacatcaagaaggaaaaaaacggggattacatcgcgggcatcagcttgttcagcagagacttccacaaggagaactcagacgtgccaaagggcaaaatcttcgtaaaactggctaccaaaaaacagaagtccatgaagatcatcctggaccggctcatgaaccagacgtactcgaaaggagcctgcatgattcacaagtacaagaacaagtggtatctgtcaatcacttacaagttcaacgctattaaggagaacaacttcgataaggaattgataatgggcattgatatgggcggtatcaatactgtgtacttcgcattcaacgaggggttcatcagatcgaacatcaagtccgacgagatcaaggcgttcaacgaaaaaatccggcagcggcggatcaacctcctcaaacagtcgaactattgctcgaactcccgcaccgggaagggaagggctaagcggctccagcctatcgacgtcctatccaacaagattgcgaaattccgtaacagcaccaaccacaagtacgctaactacatcatcaagcagtgcttgaagcacaattgcgggcgcatccagattgagctgttgaaggggatcagcaagaacgataaggtgctcaaagattggacttacttcgacctccaggaaaaaatcaagaatcaggcagaggtccacggaattgaggtcattaaggtggcctctgcatataccagccagcggtgctcgcagtgcggttacatctgcaaggaaaaccgctgcacacaagccgtcttcgagtgcaagcagtgcggctacaagacccacgccgactacaacgccgccaagaacattgctacttacgacatcgagaacatcatcaacaaacagttagctgttcaaagcaagctacactccaagaagtgtatggaggagtacatcgaggagtacatcgaggagctgggataccttgactaa

SEQ ID NO: 2997 - DNA, 1347 bp, Unknown
  Bacillus sp. multi
atgaagtaccagatcctgtgccccatgaacgtggactggaccatattcgagaagcaccttcgtaaccttacctaccaagtcaggaccatcagtaaccgcaccattcagcagctttgggagttcgacgccctctccttcgactacttcaaggccattggaacctaccccaccgtccaagacctctatggctgcacgcaaaaaaaaatcgacgggtacatctaccacaccctccagtcgaagtacccggacatacacaagggcaatatgtcaaccactctccagaaaatcatcaagacctggaaatcacgtcggaacgagattcgaaaaggagaaatgtccatcccctctttccgtaatcggatacctatcgacctgcacaacaacagcgtggacatcaaaaaggagaagaacggcgattacatcgctggcatctccctgttctcaagggatttccacaaggagaactctgacgtgccgaaggggaaaatcttcgttaagctggcgaccaagaagcagaagtccatgaagatcattctcgaccgtcttatgaaccagacttacagcaagggtgcctgcatgatacacaagtacaaaaacaagtggtatctctcaatcacgtacaagttcaacgctatcaaggagaacaactttgacaaggaactgattatgggcattgacatgggtggcattaacacagtctatttcgcgtttaacgagggcttcatccgtagcaacatcaagtccgacgagatcaaggcgttcaacgagaagattcggcagcggaggatcaacctgctgaaacagtccaactactgctctaatagccgtaccggaaagggccgtgctaagcggcttcagcccattgatgttctcagcaacaagattgccaaattccggaactccactaaccacaagtacgccaactacatcattaagcagtgcctcaagcacaactgcggacggatacagattgaactactcaaggggatcagcaagaacgacaaggtgttgaaggactggacctacttcgacttacaggagaagatcaaaaaccaggccgaggtccacgggatcgaagttattaaggtcgcctctgcatatacctcccagagatgctcccagtgcggctacatctgtaaggagaaccgttgcacccaggccgtcttcgagtgcaagcagtgcgggtacaagacgcacgcggactacaatgccgccaagaacatcgccacctacgacatcgagaacatcatcaataagcagctcgcagtgcagtcgaagctgcacagcaaaaaatgcatggaggagtacatcgaggagtatatcgaggagttgggataccttgactag

SEQ ID NO: 2998 - DNA, 1347 bp, Unknown
  Bacillus sp. multi
atgaagtatcagatcctgtgcccgatgaacgtggattggaccatcttcgagaaacacctccggaatctcacctaccaagttcgtaccatctcaaacagaacaatccagcaactgtgggagttcgacgccctcagcttcgactacttcaaggcaattgggacgtaccccaccgtccaagacctctacgggtgtactcagaagaaaatcgacggctacatctaccacaccttgcagagcaagtaccccgacatccacaagggaaacatgagtaccacccttcaaaaaatcattaagacgtggaaatctcggaggaacgagatccgcaagggcgagatgtccatcccatccttccggaaccgaatcccaatcgacctgcacaacaactccgtggacattaagaaagagaagaacggagactacattgccggtatcagcttgttctcgcgcgactttcacaaggaaaactctgacgtaccaaagggcaagatattcgtcaagttagctaccaagaagcagaagtccatgaagatcatcctcgaccgcttgatgaaccagacatactcgaagggagcttgcatgatccacaagtacaagaataagtggtatctatcaataacctacaaattcaacgccatcaaggaaaacaatttcgacaaggaactgataatgggaattgacatgggtgggatcaacacagtgtactttgctttcaacgaaggcttcatccgctccaacatcaagtccgacgagatcaaggctttcaacgagaagattcggcagcggcgcatcaacctcctaaagcagagcaactactgctccaacagccgcaccggcaagggccgagccaagaggctccagccaatcgacgtgctgagcaacaagatcgccaagttccgaaactcgaccaaccacaagtacgctaactacatcatcaagcagtgcctgaaacacaactgcgggcgcatacagattgagcttctaaaagggatttccaagaacgacaaggttctcaaagactggacgtacttcgacctccaggagaagatcaaaaatcaggcagaagttcatgggatagaggtcatcaaggtggcgagcgcctacacctctcagcgctgctcgcagtgcgggtatatctgcaaggagaaccgttgcacccaggccgtgttcgagtgcaagcaatgcggttacaagactcacgcagactacaacgcggctaagaacattgccacctatgacattgagaacatcatcaacaagcagctcgccgtgcagagcaaattacacagcaagaaatgcatggaggagtacattgaggagtacatcgaggagttgggctacctcgattag

SEQ ID NO: 2999 - DNA, 1347 bp, Unknown
  Bacillus sp. multi
atgaagtaccagatcctttgcccgatgaacgtggactggacgatcttcgaaaagcacttacgcaatctcacctaccaagtccgtacgatctccaaccgcacgatccaacagctctgggagttcgacgcattgtcattcgactacttcaaggccatcggcacctaccccaccgtccaggacttgtacgggtgcacgcagaagaagattgacgggtacatctatcacacgcttcagagcaagtaccctgacatccacaagggcaacatgagcacgaccctccaaaaaatcattaagacttggaaatcacgtcgcaacgagatccgcaagggcgagatgtcaataccttcattccggaaccgtattcccatcgaccttcacaacaacagcgtggacattaagaaggaaaagaacggcgactatatcgcggggatttccctgttcagtagagacttccacaaggaaaacagtgacgtgccgaaggggaaaatcttcgtcaagctcgccaccaaaaagcagaagtccatgaagatcatactggaccgattgatgaaccagacctattctaagggtgcgtgcatgatccacaagtacaagaacaagtggtatctgtccatcacctacaagttcaatgctatcaaggagaacaacttcgacaaggagctaatcatggggatcgacatgggtgggatcaacacagtttacttcgccttcaacgaggggttcataaggtccaacatcaagagcgacgagatcaaggcgtttaacgaaaaaatccgtcagaggaggatcaacctactcaagcagtcgaactactgctcgaacagccgaaccggcaaggggcgtgcgaagcgtcttcagcctattgacgtgctctcgaacaagatagctaagttccgtaacagcacgaaccacaagtacgccaattacatcatcaagcagtgccttaagcacaactgcggtcgaatccaaatcgagctgttgaagggcatcagcaagaacgacaaggtgttgaaggactggacctacttcgacttacaggaaaaaatcaagaaccaggcggaagttcacggcatcgaggtcattaaggttgcctcagcctacacgagccagaggtgctcacaatgcggctatatctgtaaggagaatcgttgcacacaggccgtgttcgagtgtaagcagtgtggctacaagacccatgctgactacaacgcggccaagaacatcgctacctacgacatcgaaaacattatcaacaagcagttggccgtgcagtcaaagctccatagcaaaaagtgtatggaggagtacatcgaggagtatatcgaggaattgggctatctggattag

SEQ ID NO: 3000 - DNA, 1191 bp, Unknown
  Bacillus sp. multi
atgctttacccactcactacgctcaagaaggaaggccacaccttgctctcgaagatttgcatgggcgtccaccggcgaaagttgatggctatctatcacactttgcagagcaaatacccagacatccacaaggggaatatgtccaccacgcttcaaaaaatcatcaagacttggaaatctaggcgcaacgagatccggaaaggcgagatgtcgatcccgagtttccgtaatcgcatccccattgacctccacaacaactccgttgacattacgaaggagaagaacggcgactacatcgcggggatctcactctttctcagggacttccacaaggagaacgacgacgtgcctaagggcaagatattcgttaaactggcaacccaaaagcagaagtccatgaaggtgatcctggaccgactcattaaccagacgtacagcaagggagcgtgcatgattcacaagtacaagaacaagtggtatctgtcaatcacgtacaagttcaacgccatcaaggaaaacaaattcgacaaggagttaatcatgggaatcgacctcggtggtatcaacaccgtgtactttgctttcaacgagggcttcatccgcagcaacattaagtccgacgagatcatcaggcagcgtcggatcaatctcctaaagcagagcaaatattgttcaaattcaagaaccgggaaggggaggacgaagcgccttcagcccattgacgtccttagcaataagatcgctaagttcagaaactcaactaaccacaagtacgccaattacatcgtgaagcagtgcctaaaacacaactgcggacgcatccagatggaactcctcaagggcatcagtaagaatgaccgcatattgaaagattggacctacttcgatctccaggagaagatcaaaaaccaggcggagatccacggcatcgaggtcattaaggttgcaccggcttacacatcccaaaggtgcagccaatgcgggtacatctgcaaggagaacagatgcacacaggcaaccttcgagtgtaagcagtgcggctacaagacacacgctgactacaacgctgctaagaacattagcacttatgacatcgagaacatcatcaacaagcagttggcggtccagagcaagctccactccaaaaaatgcatggaggagtacatcgagaagttgggttacttggactga

SEQ ID NO: 3001 - DNA, 1191 bp, Unknown
  Bacillus sp. multi
atgctctaccctttgacaacgctcaagaaagagggtcacaccctgctgtccaagatttgcatgggtgttcaccggaggaagctaatggcgatataccacacgctccagagtaagtaccccgacatacacaagggcaacatgagcacgacgctccagaagattatcaagacatggaaatccaggcgcaacgagattcgcaaaggagaaatgtcgatcccatcattccgaaaccgcatcccgattgacctacacaacaacagcgttgacataacaaaggagaagaacggcgactacattgcggggatctcactattcttgcgggacttccacaaggagaacgacgatgtgccaaagggcaagatattcgtcaagttggcaacccagaagcagaagtctatgaaggtgatcttggacaggctgattaaccagacctacagcaagggcgcttgcatgatacacaagtacaaaaacaagtggtatctgtcaatcacctacaagttcaacgcgattaaggagaacaaattcgacaaggagttgataatggggatcgacctgggcggcattaacaccgtttacttcgctttcaacgaggggttcatccgttccaacatcaagagcgacgagatcatccgccagcggcgcatcaaccttctcaagcaaagcaaatattgctcaaactcacgaacgggcaaggggaggaccaaaaggctccaacctatcgacgtcctctcgaacaagatcgccaaattcagaaacagcactaaccacaagtacgcaaactacatcgtcaagcagtgcctcaagcacaactgtggacggattcagatggaactgctcaagggtatctccaagaacgacaggatactcaaagactggacgtacttcgacctacaggagaagatcaaaaaccaggctgagattcacggtattgaagtcattaaggtcgcgcccgcctatacttcgcagcgatgttcccagtgcggctacatctgcaaggagaaccggtgcacacaggctacattcgagtgcaagcagtgcgggtacaagactcacgccgactacaacgccgccaagaatatctccacctacgacattgagaacattatcaataagcaacttgcagtgcagtccaagctgcactccaaaaagtgtatggaggagtacatcgagaaactgggctacctggactag

SEQ ID NO: 3002 - DNA, 1191 bp, Unknown
  Bacillus sp. multi
atgctctatcccctcaccaccctcaaaaaagagggccacaccttactctccaagatttgcatgggcgtccataggcgtaagctcatggcaatctaccacacactccagtcaaagtacccggacatccacaagggcaatatgagcactaccctacagaaaatcatcaagacttggaaatctaggcgtaacgagatccggaaaggcgagatgtcgattcccagcttccgaaatcgcattcctattgacttgcacaacaactctgttgacattacgaaggagaagaacggggactacatcgcggggatctccctgttcctcagagacttccacaaggaaaacgatgacgtccccaaaggcaagatattcgttaagctggctacccagaagcagaagtctatgaaggtgattcttgacaggcttatcaatcagacttactcaaagggagcctgcatgatccacaagtacaagaacaagtggtatctgtcaatcacctacaagttcaacgccatcaaggagaacaaattcgacaaggagctaatcatggggatcgacctcggtgggattaacacagtttacttcgcattcaacgaggggttcattcgcagcaatatcaagagcgacgagatcatccgtcaacggcggattaacctcctcaagcagtccaagtattgttcaaactcccggacggggaaggggcgcaccaagcgcctccagcccatcgacgtgctgagtaacaagatcgccaaattccgcaattcaactaaccacaaatacgcgaactacatcgtgaagcagtgccttaaacacaactgtggacggatacagatggagctgttgaaggggatcagcaagaacgacaggatacttaaggactggacctacttcgacctccaggagaagatcaaaaaccaggccgagatccacgggatcgaagttatcaaggtggccccggcttacacgagtcagaggtgctctcagtgcgggtacatctgcaaggagaaccggtgcactcaagcaacgttcgagtgcaagcaatgcggttacaagacccacgcggactacaacgctgctaagaacatcagcacgtacgatattgagaacatcatcaacaagcaattggcagtgcagtcgaagctacattccaaaaaatgcatggaggagtacattgaaaagctaggctaccttgactag

SEQ ID NO: 3003 - DNA, 1191 bp, Unknown
  Bacillus sp. multi
atgctgtaccctttgacgacgctcaaaaaggagggtcacaccctgctcagcaagatttgcatgggagtgcacaggcgcaagctgatggcaatctaccataccctccagtcaaagtacccagacatccacaagggcaatatgagcactactctacagaagatcattaagacttggaagtcgcggcgaaacgagatccgaaagggcgaaatgtcaattccatcattccgtaaccgcattccaattgatcttcacaacaactccgtggacattacgaaggagaagaatggagactacatcgctggaatatccttgttcctgcgcgactttcacaaggagaacgatgatgtgcctaaagggaaaatcttcgtgaaactcgccacccagaagcagaagtccatgaaggtcatccttgacagacttatcaaccagacctactctaaaggagcgtgcatgatccacaagtacaagaataagtggtatctgtctattacatacaagttcaacgctatcaaggagaacaagttcgacaaggagctgataatggggattgacttgggcgggatcaacacggtttacttcgccttcaatgagggcttcataaggtcgaacatcaagtctgacgagattatcaggcagcgccgtatcaacctgcttaaacagagcaagtattgcagcaattcaaggaccgggaagggccgtaccaagcgtctccagccaattgatgtgctgtccaacaagattgccaaattccgtaactcgacaaaccacaagtacgccaactacatcgtcaagcagtgccttaaacacaactgcgggcgtatccagatggagttgctcaagggtatatccaagaacgaccgtatccttaaagactggacctacttcgacctccaggaaaaaatcaagaatcaggccgagatacacggcatcgaagtgattaaggtggcacccgcctacacctcccagagatgcagtcaatgcgggtacatctgcaaggagaatcgctgcacacaggctaccttcgagtgcaagcagtgcggctacaagacccacgccgactacaacgctgccaagaacataagtacctacgacatcgaaaacatcatcaacaagcagttggcggttcagtccaagctccactccaaaaaatgcatggaggagtacatcgagaagttgggctacttggactag

SEQ ID NO: 3004 - DNA, 1191 bp, Unknown
  Bacillus sp. multi
atgctctatccactcaccaccctcaagaaggaagggcacacgctcctttcgaagatttgcatgggcgtgcaccgccggaagctgatggcgatctaccacacccttcagagcaagtacccagacatacacaaaggcaacatgagcacgactctccagaagatcatcaagacttggaaaagtcgtaggaacgagattcgcaaaggagagatgagcattccatcattccgtaaccggatacctatagacctgcacaacaacagcgtggacatcacgaaggagaagaatggagactacattgcgggaatctcccttttcctacgcgacttccacaaggagaatgatgatgtgcccaaaggcaagatattcgtgaagctcgcaacccagaagcagaagtctatgaaggttattctcgaccgactcattaaccagacatactctaaaggggcctgcatgatccacaagtacaaaaacaagtggtatttgagtatcacgtacaaattcaacgctattaaggaaaacaagttcgacaaggagcttatcatggggattgacttgggtgggatcaacaccgtttacttcgccttcaacgaggggttcattcggtcgaacatcaagtccgacgagatcatccgccaaaggcgtatcaacctactcaaacagagcaaatattgttccaattccaggaccgggaagggaaggactaagcgactccagcccattgacgtcctctccaacaagatcgctaagttcagaaactccacaaatcacaagtacgccaactacatcgttaagcagtgtctcaagcacaactgcgggcgtatccagatggaactcctcaagggcatcagcaagaacgacaggatcttgaaagactggacctacttcgacctccaggaaaaaatcaagaatcaggctgagatccacgggatcgaggtcatcaaggttgctcctgcatacacatcacagcgctgctcacagtgcgggtacatctgcaaggaaaaccgttgcactcaagcaacattcgagtgcaagcagtgcggctacaagacccacgccgactacaacgccgccaagaatatctcgacctacgacattgagaacatcatcaacaagcagcttgccgtgcaatctaagctgcacagcaagaaatgcatggaggagtacatcgagaaactggggtacttagactga

SEQ ID NO: 3005 - DNA, 1353 bp, Unknown
  Bacillus sp. multi
ctttcaacggtggtcaaggtcatgaagtatcagatcgtctgcccggtgaacattgagtggaaggtgttcgagacctacctgaggacattaacctaccaagttagaaccatcgggaaccgcacgatccagaagctatgggagttcgacaaccagtccctcaaccacttcaaggaaaacggcgtgtacccctctacccagcagctctacggttgtactcagaaaaccatctccggctacatctacgaccaactcaaattcgaatatctcgacattaacaaggccaatatgtccacgaccctccagaaaactattaagacgtggaactcacgcaagaaggagatatggagcggggagatgtctatcccgtccttccggaacaacttaccaatcgacatccacggcaacagtatccagctaacgaaggagaagtctggcgattacatcgccaacctctcccttttcagcagcagcttcatccgtgaaaatgagctgtcctcaggcaaaatcctggtcaagctgagcacccgtaagcagaacagcatgaaggtgatcttggatcgactcatcgacggaacgtacgccaaaggagcaagtatgctccataagtacaagaataagtggtacttaagcgtgacctacaaagctaacgcaattgaggagtcgaagttcgacgaagacttcatcatggggatcgacatggggaaggtcaacgtcctgtacttcgctttcaataagggattcatacgtgggtcgatcagtggggaggaaattgaggctttccgcaagaagatagagcacaggcgtatatctctgctccgtcagggaaagtattgttccgagaaccggatagggaaggggcgcaagaaacggattaagccggtggatgtgctaaacgacaaagtggccagattccgtaacagcaccaaccacaagtacgccaactacattgtgcaacagtgcctaaagtacaaatgcgggtgcatccagcttgaaaatcttcaaggaatttcgaaggagcagaccttcctcaagaattggacatacttcgacctccaggagaagattgagaaccaggctaaccagtacgggatcaaggtcgtcaagattgcgccaagttacacaagccagcggtgcagcgagtgcgggtacatccacaagaacaatagacaggaccagtccactttcgagtgccagcagtgcaacctcaaagtccacgccgactacaatgcagccaagaacatatccatctacaacatcgagaagttgatccagaagcagttgaagctacaggaaaagctgaactccaaaaaatatactgagcagtacaaggaacagatcgagaatatcacgtga

SEQ ID NO: 3006 - DNA, 1353 bp, Unknown
  Bacillus sp. multi
ctttcaacggtcgtcaaagtcatgaagtaccagatcgtatgccccgtgaacatcgagtggaaagtgttcgagacttaccttcgtacgctgacctaccaagttcgtaccattgggaacaggacgatccagaagctctgggagttcgacaaccagtcgttgaaccacttcaaggagaacggcgtgtacccctctacccagcagctctacggttgcacacagaaaactatctccggctacatctacgaccagctcaagttcgagtacctcgacattaacaaggccaatatgtccaccaccctccagaaaactattaagacgtggaacagccgcaagaaggagatttggagcggggagatgagcatccccagcttccgaaacaacctccctatcgacatccacggaaactcaatccagttgacgaaggagaagtctggcgactatatcgccaacctctcactgtttagctccagctttatccgtgaaaatgagctgtctagcggaaagattctggtgaagctgagcacacgcaagcagaactctatgaaggtgatccttgatcggttgatcgacggtacttatgcgaaaggagctagtatgctgcacaagtacaagaacaaatggtacttgtccgtaacctacaaagcgaacgccatcgaggagagcaaattcgacgaagacttcataatggggattgacatggggaaagtgaatgttctctatttcgcattcaacaaggggttcattcgtggcagcatcagtggggaggagatcgaagccttccgcaaaaagatagagcaccgacggatctcactacttcggcaaggcaagtattgcagcgagaaccgaattgggaaggggcgcaagaagcggatcaagcccgtagatgtgctcaacgacaaagttgcacgcttccgtaactccacgaaccataagtacgccaactatatcgtccagcagtgccttaagtacaaatgcggctgcatacagttggaaaatctacagggaatttcgaaggagcagacctttctcaagaactggacctacttcgacttacaggagaagattgaaaaccaggctaaccagtacggcattaaggtggtcaaaatcgcgccgtcctacacaagccagaggtgctccgagtgcggctacatacacaagaacaaccgccaggaccagtccactttcgagtgccagcagtgtaacttaaaagtccatgcggactacaacgcagccaagaacatcagcatctacaacattgagaagctcatccagaagcaactgaaattacaggagaagctcaactccaagaaatatactgagcagtacaaggagcaaattgagaacatcacttga

SEQ ID NO: 3007 - DNA, 1353 bp, Unknown
  Bacillus sp. multi
ctctcaacagtggtgaaggtgatgaagtaccagatcgtatgcccggtgaacatcgagtggaaggtcttcgagacctacctcagaactctcacgtatcaagtccgcaccatcggcaaccgcaccattcagaagctctgggagttcgacaaccagagtcttaaccacttcaaggagaacggggtgtacccttctacccagcagctctacggttgcacccaaaaaaccatctctggctatatctacgatcagctaaagttcgagtatctggacattaacaaagccaacatgagcacgacgctccagaagaccatcaagacctggaactcccgcaagaaggaaatctggagtggggagatgtctatccccagcttccgcaacaatctacctattgacattcacgggaactcaatccagcttactaaggagaagtcgggagactacatcgccaacctgtctctgttcagctcttcattcattcgggagaatgagctgtcctccgggaagattcttgttaagttgtcaacaaggaagcagaatagcatgaaggtgatcctcgaccgcctaatcgacggcacatacgcgaagggagcatccatgctccacaagtacaagaataagtggtacttgtcagtcacgtacaaggctaacgccattgaggagtcgaagttcgacgaggacttcatcatgggaatcgacatgggcaaggtgaatgtgctgtacttcgccttcaacaaggggttcattcgtggtagtatatccggggaggagattgaggcttttcgcaagaagattgagcacaggcgcatatcgttgcttagacaggggaaatattgttctgagaaccgcatcggcaaagggcgcaaaaaacgtatcaagcccgtggacgtgcttaacgacaaggtggcccgcttccgtaacagtaccaatcacaagtatgccaactacatcgttcagcagtgcttgaagtacaaatgcgggtgcatccagttggaaaatctgcaaggaatcagcaaggagcagactttccttaagaattggacctactttgacttacaggagaagattgaaaatcaggcaaaccagtacggtattaaggtggtcaagatcgcaccatcttacaccagccagagatgctccgaatgcggctatatccacaagaacaaccgtcaggatcagtcaacgttcgagtgccaacagtgcaacctcaaggtccatgcggactacaacgcggctaagaacatatctatctacaatatcgagaagctgatccagaagcagctaaagctccaggagaaactcaacagcaagaagtatactgagcagtacaaggagcaaatcgagaacataacctga

SEQ ID NO: 3008 - DNA, 1353 bp, Unknown
  Bacillus sp. multi
ctctccaccgtcgtgaaggtgatgaagtaccagatcgtgtgccccgtcaatatcgagtggaaggtgttcgagacttacttaagaactttgacttaccaagtgcggaccatcggcaatcgcaccatccagaagctgtgggagttcgacaatcagagcctcaatcactttaaggagaacggcgtttacccttccacacagcagctttatggctgcacccagaagacaatctccgggtatatctatgaccagctcaagttcgagtacctggacattaacaaggccaatatgagcacaaccctccaaaaaaccatcaagacctggaactcccgcaagaaagagatatggagcggagagatgtccatcccctccttccgtaacaaccttcccatcgacatacacggaaacagcattcagctcacaaaggagaagtctggagactacatcgccaacctgtctctgtttagctcttccttcataagggagaacgaattgtccagcggcaagattctcgtgaagctgtccacaaggaagcagaactctatgaaggtcatacttgacaggctcatcgacggcacctacgcgaagggcgcttccatgctgcataagtacaagaacaagtggtatctgtctgtgacgtacaaggctaacgcaatcgaggagtctaagttcgacgaggacttcattatgggaatcgacatggggaaggtgaacgtcctctatttcgccttcaacaagggattcataagaggttcgatcagtggggaggagatcgaggcgttccgcaaaaaaatcgagcatcgccgtatatccctgttgagacagggcaaatattgcagcgaaaaccgtattggaaaggggcgcaagaagcggattaagcccgttgacgtgctgaacgacaaggtggcacgcttccgtaatagcactaaccacaagtacgcaaactacatcgtccagcaatgcttgaagtacaagtgcgggtgcattcaattggaaaacctccaggggattagcaaggagcagacattcctcaagaactggacgtacttcgacctccaggagaagattgagaaccaggcgaaccagtacgggattaaggtggtgaagatcgcccctagctacacatcacagaggtgctccgagtgcggctatatccataagaacaaccgacaggaccagtcaacgttcgagtgccagcagtgcaacctgaaagtccacgccgactacaacgccgctaagaacatatccatatacaacatcgagaagttgatccagaaacagcttaaactccaggagaaattgaatagcaagaagtacacagagcagtacaaggagcagatcgagaacatcacttga

SEQ ID NO: 3009 - DNA, 1353 bp, Unknown
  Bacillus sp. multi
ctctcgaccgtggtcaaagtgatgaagtaccagatcgtgtgcccagtcaacatcgaatggaaggtgttcgagacctacctgagaacactgacctaccaagtgagaactatcgggaaccgcacaatccagaagctctgggagttcgataaccagagcctcaaccacttcaaggaaaacggtgtgtacccatccacgcagcagctctacggttgcacgcagaaaacgatctccggctacatctacgaccaattgaaattcgagtacctcgacattaacaaagccaatatgtccacaaccctccagaaaactatcaagacttggaactcacgcaaaaaagagatttggagcggcgagatgtcgatcccctcgttccgtaacaatttgcccatcgacatacacggcaacagcatccagctcacaaaggagaaatctggggactacattgccaacctcagcctgttcagtagctccttcattcgagaaaacgagctaagctcaggcaagattctcgtgaagttgtccactcgcaagcagaacagtatgaaggtgatccttgacaggctcatcgacggcacttacgcaaaaggagcctccatgctgcacaagtacaagaacaagtggtatctctctgtcacttacaaggccaacgctattgaggaatctaagttcgatgaggacttcataatgggaattgacatgggaaaagtgaacgtactttactttgctttcaacaaggggtttatcagagggagtatctccggggaggagatagaggctttccgcaagaagattgagcacaggaggatcagcctgcttcgtcagggcaagtattgttccgagaaccggatcggcaagggccgcaaaaaacggattaagcctgtggacgttctgaatgacaaggttgcgaggttccgcaactctacgaaccacaaatacgccaactatatcgtccagcagtgcctcaagtacaagtgcgggtgcattcagcttgagaatctacagggtatctctaaagagcagactttcctcaagaactggacctatttcgacttacaggagaagattgaaaatcaggcaaaccagtacgggattaaggtggtgaagatcgctccaagttacactagccagcgatgtagcgagtgcggctacatccataagaacaaccgtcaggatcagtccaccttcgagtgccagcagtgcaacttaaaagtgcacgccgactacaacgcggccaagaacatcagcatctacaacatcgagaagttgatccagaagcagctcaaattacaggagaagctgaacagcaaaaagtatacagagcagtacaaagagcagatcgagaacatcacttag

SEQ ID NO: 3010 - DNA, 1332 bp, Unknown
  Bacillus sp. multi
atgaagtaccagatcgtctgtcccgtgaacatcgagtggaagacattcgagatatacctccggacactaagctaccacttccgcaccattggcaaccgcaccattcagaagctctgggagtacgacaaccagtcccttaagcacttcaaggacacaggccagtaccctagcgcccagcagctttacggctgcacgcagaagactatcagcgggtacatatacgatcagctcaaggaggagtaccaagacatcaacaaggccaatatgtccacaactctacagaaaacaattcgcacctggaacagtcgcaagaaagagatatggagcggcgagatgagcatacccagcttccgcaacaacctgccgattgatattcacggaaacagcatacagatcatcaaggagaagtctggcgactacatcgccagcgtttccttgttcagttcgaagttcattaacgagaacgaccttcctaacggcaagatcctagtgaagctaagcactaggaaacaaaactccatgaaggtgatccttgaccgcataattgactccacctacgcgaagggagcgtgcatgttgcacaagcacaaaaagaaatggtatcttagcatcacttacaaatccaacattaaggaggaattgaagttcgacgaagacctcataatgggcattgacatgggaaagatcaacgtcctgtacttcgcgttcaacaagggccttgttcgcggcgctatctcaggggaggagattgaagcgttccgcaagaagatagagcaccgtcggatcagccttctacgtcagggaaagtattgctccgggaaccgtattggaaagggccgcgagaagcgcattaagcccattgatgttctcaacgacaaggttgccaaattccgtaacgccacaaatcacaaatacgccaactatatcgtgcagcagtgcttgaagtacaactgcgggaccatccagcttgaagacctgaaagggatcagcaaagagcagacgttcctcaagaactggacatacttcgacctacaggagaagatcaaaaaccaggccaaccagtacggtgtgaaggtggtgaagatcgctcctagttacacatcacagcgatgcagtgagtgcgggtacatccataagaacaaccgccaggaccagagcaccttcgagtgccagcagtgcagcttcaaagtgcacgcggattacaacgctgccaagaacatctcggtttacaatatcgagaaggtgatccagaagcagcttgaactccaggagaagctgaaccagacgaagtacaaggagcagtacattgagcagatgaaaaatatcaattga

SEQ ID NO: 3011 - DNA, 1332 bp, Unknown
  Bacillus sp. multi
atgaagtaccagatcgtgtgcccggtcaacattgagtggaagacctttgagatatacctgagaaccctaagctatcacttccgtaccatcggcaaccgcacaattcagaaactgtgggagtacgacaaccagtcccttaagcacttcaaggacactggccaatacccctcggcccagcagctctacggatgcactcaaaaaactatctcaggctacatctacgaccagctcaaagaggaataccaagacatcaacaaggccaatatgtcaaccaccctccagaaaactatccgtacatggaacagtcgcaaaaaagagatatggagtggcgagatgtctataccctccttccggaacaacttgcccatcgacatacacgggaactccattcaaatcatcaaggagaagtctggcgactacattgcctccgtttcgctcttcagttccaaattcatcaatgagaacgacctgccaaacgggaaaatcctagttaaactgtccactcgaaagcagaactccatgaaggtgatccttgacagaatcatcgactctacctacgctaaaggagcctgcatgttgcataagcacaagaagaagtggtatctatctattacatacaaaagtaacattaaggaggagcttaagttcgacgaggatctgataatggggatagacatgggaaagatcaacgtcctgtacttcgcattcaataagggccttgtgcgtggtgctatctctggggaggagattgaagccttccgcaagaaaatcgagcaccgccgcatcagtctcctgcgccagggcaagtattgctccggcaacagaattgggaaggggcgcgagaagcggattaagccgattgacgtgctcaacgacaaagtggccaagttcagaaacgcaacgaaccacaagtacgcgaactacatcgtgcagcagtgcctcaagtacaactgcggtactattcaacttgaggacttgaaggggatctcaaaggagcagactttccttaagaactggacctacttcgacctccaggagaagatcaaaaaccaggccaaccagtacggcgttaaggtcgtcaagatcgcgcccagctacacctcccagaggtgcagcgagtgcggctacattcacaagaacaaccggcaagatcagagcacgttcgagtgccagcagtgcagcttcaaagtccacgccgactacaacgcggccaagaacatctcagtgtacaatatcgagaaggtcatccagaagcagttggagttacaggagaaactcaaccagaccaagtacaaggagcagtacatcgagcagatgaagaacattaactga

SEQ ID NO: 3012 - DNA, 1332 bp, Unknown
  Bacillus sp. multi
atgaagtaccagatcgtgtgccctgtcaatatcgagtggaagactttcgaaatctacctgcggacgctgagctaccacttccgaactatcggaaatcgcaccatccagaagctctgggagtacgacaaccagtctctcaagcacttcaaggacaccggtcagtacccgagtgcccagcagttgtacgggtgtacccagaaaactatctctggctatatctacgaccagcttaaagaggagtatcaggacatcaacaaggccaatatgtccacgacactccagaaaactatccggacgtggaactcccgcaaaaaggaaatctggagcggcgagatgagtatcccatcgtttcgcaacaacctgcctattgacatacacgggaacagcattcagatcatcaaggagaagtcgggcgactacatcgccagcgtgtcattgttctcatccaagttcatcaacgagaacgacttgcccaacggcaagatcctcgtgaagttgtcaaccaggaagcaaaactctatgaaggtcatccttgaccgtatcatcgactccacatacgccaaaggagcgtgcatgttacacaagcacaagaagaagtggtacttatccatcacctacaagagcaacattaaggaggagttgaagttcgacgaagacctcatcatggggatcgacatgggcaagattaacgtgctgtacttcgcctttaacaagggccttgtgcgaggtgcaatcagtggcgaggaaatcgaggcgttccgcaagaagattgagcaccgccgcatatccctgctcagacaggggaaatattgttcgggaaaccggatcgggaaggggcgcgagaagcgcatcaagcccatcgacgtcctcaacgacaaggtggccaagttccgaaacgctaccaaccacaagtacgcaaactacattgtccagcagtgcctcaagtacaattgcggcacgatacaattggaggacttgaagggcatctctaaggagcagactttccttaagaactggacatacttcgacctccaggaaaaaatcaagaaccaggccaaccagtacggagtgaaggtcgtaaagatcgctccaagttacacatcccagcggtgcagcgagtgcggttacatccacaagaacaaccggcaagaccaaagcactttcgagtgccagcagtgctcgttcaaggtccacgccgactacaatgcggccaagaacatctccgtttacaacattgagaaggtcattcaaaagcagcttgaactccaggaaaagttaaaccagaccaagtacaaggaacagtacatcgagcagatgaaaaatatcaattga

SEQ ID NO: 3013 - DNA, 1332 bp, Unknown
  Bacillus sp. multi
atgaagtaccaaatagtgtgtcccgtcaacattgagtggaaaacgttcgagatatacctcagaactctctcctaccacttccgcaccattgggaaccgcacgatacagaagttgtgggagtacgacaaccagagcctcaagcacttcaaggataccggacagtacccctccgcccagcagctctacgggtgcacgcagaagacaatctccggttacatctatgaccagctcaaagaggagtaccaggacatcaataaggcgaatatgagtacgaccctccagaaaacaatccggacttggaacagtcgcaaaaaagagatttggagcggggagatgtcgatcccctccttcagaaacaacctccccattgacatacacgggaacagcatacaaatcatcaaggagaagtctggcgactacatcgcatctgtgtccctgttctccagcaagttcatcaacgagaacgaccttcccaacggcaaaatcctcgtcaagttgagtacgaggaaacagaactccatgaaggttatcctggacaggataattgactcgacttacgcaaaaggagcttgcatgttacacaagcacaagaagaaatggtacttgagtatcacctacaagagcaacatcaaggaggaactcaaattcgacgaagacctgattatgggcatcgacatggggaagatcaacgtgctttacttcgctttcaataagggtttagtgaggggcgctatctccggcgaggagatcgaggcttttcgcaagaagatagagcaccggcgtatctctctgctgcgacagggcaaatattgttctggaaacaggatcggcaaggggcgcgagaagcggatcaagcctattgatgttctcaacgacaaggttgccaaattccgcaatgccaccaatcacaagtacgcgaactacatcgtgcagcagtgcctcaagtacaactgtgggaccatccagcttgaggacttgaagggaatttccaaagagcagacgttcctcaagaactggacctacttcgacctacaggaaaaaatcaagaaccaggcgaaccagtacggtgtgaaagtggtgaagattgcgccatcttacaccagccagcgctgctccgagtgcggctacatacacaagaacaaccgccaggaccagagcacattcgagtgccagcagtgcagcttcaaggttcacgccgactacaacgccgccaagaatatcagcgtgtacaacattgagaaggtgattcagaagcagcttgaactacaggagaagctcaaccagacgaagtacaaggagcagtatatcgaacagatgaaaaacatcaattga

SEQ ID NO: 3014 - DNA, 1332 bp, Unknown
  Bacillus sp. multi
atgaagtaccagatcgtgtgtccggtgaatatcgagtggaagaccttcgagatatacctgcgtacgctaagttaccacttccggaccatcggcaaccgtacgattcagaaactgtgggagtacgacaatcagtcactcaagcactttaaagatacgggccagtacccatctgcccagcagctttatgggtgcacgcagaaaactattagcggctacatctacgaccagcttaaggaggagtaccaggacatcaataaggcgaatatgtcaacaacactacagaaaactattcgcacgtggaactcccgcaaaaaagagatttggagcggcgaaatgtccatccccagcttccgtaacaatctgcctattgacatacacggcaacagcatccagatcatcaaggagaagtccggtgactacatcgcctctgtcagcctattcagctccaagttcattaacgagaacgacctgccgaacggcaagatattggtgaagctctcgacacgcaagcagaacagcatgaaggtcatcctcgaccgcatcattgactcgacttacgcaaagggtgcgtgcatgttacacaagcacaaaaagaagtggtatctgtcaatcacctacaagagtaacatcaaggaggagcttaagttcgacgaggacttgataatgggaatagacatgggcaagatcaacgtgctatacttcgcattcaacaagggccttgtcaggggcgcaatcagcggcgaggagatcgaggcttttcgcaagaagatagagcaccgtcgcatcagcctactcagacagggcaagtactgttctggaaaccgcatcggcaaggggcgggagaagcgcatcaagcctatcgacgtcttaaatgacaaagtggcgaaattcagaaacgccactaaccacaagtacgccaactacattgtgcagcagtgcttgaagtacaactgcggcaccatacaactcgaagacttgaaggggataagcaaggagcagacattcctcaagaattggacatacttcgacttacaggagaagatcaaaaaccaggctaaccagtacggagtcaaggtggtgaagatcgcacccagctacaccagtcagaggtgttctgagtgcgggtacatccacaagaacaacaggcaagatcagtccaccttcgagtgccagcagtgctcgttcaaggttcacgcagattacaacgccgccaagaacatctcagtttacaacatcgagaaggtgatccaaaagcaactagaattacaggagaagctcaaccagaccaagtacaaggagcagtacattgagcagatgaaaaatatcaattga

SEQ ID NO: 3015 - DNA, 1362 bp, Unknown
  Bacillus sp. multi
gttacctacctttccatcgccgttaaggtcatgaagtaccaaatcgtctgcccggtcaacatcgagtggaagaccttcgaaatctacctacgcaccttgtcctaccacttccgcactatcgggaaccggaccatccagaaactctgggagtacgacaaccagtcgctcaagcacttcaaggacacaggccagtaccccagcgcccagcagctctacggctgcacccagaagacaatcagcggctatatctacgatcaattgaaagaggagtaccaggacatcaacaaagccaatatgagtacaacacttcagaagacgatccggacctggaacagtcgcaagaaagagatatggagcggggagatgtccatcccctcgttcagaaacaatctcccgattgacattcacggcaacagtatccagatcatcaaggagaagtcgggtgactacatcgcttccgtgtcgctgttctctagcaaattcatcaacgagaacgaccttcccaatgggaagatcctggttaagttgtccactcgcaagcagaacagcatgaaggtgatccttgaccgcataatcgactcaacttatgcaaaaggtgcctgcatgttacacaagcacaagaaaaagtggtacttgagcatcacgtacaagtccaatatcaaggaggaattgaaattcgacgaagacctgataatggggattgacatgggcaagatcaacgtactatacttcgctttcaacaagggccttgtgcgtggcgcaatctccggggaggagattgaggctttccgcaagaagattgagcaccggcgcattagccttctacgtcaggggaagtattgctcggggaaccgcatcgggaaggggcgtgagaaacggattaagcctatcgacgtcttgaatgacaaggtggcgaagttccgcaacgccaccaatcacaagtacgctaactatatcgtccagcagtgccttaagtacaattgcgggaccatccaactcgaagacctaaagggtatttcaaaggagcagaccttcctcaagaactggacgtacttcgatctacaggagaagatcaaaaaccaggctaaccagtacggggtgaaggtcgtgaagattgcaccgtcctacaccagccagaggtgctccgagtgcggctacatacacaagaacaacagacaagaccaaagcacattcgagtgccagcagtgctcattcaaagtccacgccgactacaatgctgccaagaacattagcgtgtacaacattgagaaggttattcagaagcagctagagttacaggagaagctgaaccagactaagtacaaggagcagtacattgagcagatgaagaacatcaactga

SEQ ID NO: 3016 - DNA, 1362 bp, Unknown
  Bacillus sp. multi
gtgacctacctcagtattgcggtgaaggtgatgaagtaccaaatagtatgcccggtgaacatcgagtggaagactttcgagatatacctgaggacgctctcctaccactttcgcaccatcggcaaccgcaccatccagaagctgtgggagtacgacaaccagtccctcaaacactttaaggacacgggtcagtaccccagcgcccagcagttgtacggttgcacccagaagaccatctctggctatatctacgaccaacttaaagaggagtaccaggacattaacaaggcgaacatgagcacaacccttcaaaaaactattcggacctggaactcccgcaaaaaggaaatctggagtggcgaaatgtccattccctccttccgcaacaacttgccaattgatattcatggaaactcaattcagatcatcaaggagaagtcgggcgattacatcgcctccgtcagcctgttcagtagcaagttcatcaacgagaacgacttgcccaacggcaagatcctcgtgaagctatcaacccgcaagcagaactctatgaaggtcatccttgaccgtatcattgactccacttacgctaaaggtgcctgcatgttgcacaagcacaagaaaaagtggtacttgtcaatcacctacaagtcgaacattaaggaggagcttaagttcgacgaggacttaatcatgggcattgacatggggaagatcaacgtgctatacttcgcctttaacaaggggctggttcgcggcgcaatcagtggggaggagatcgaggcttttcgcaagaaaattgagcacagacgcatatcgctattaagacaagggaagtattgcagtggaaacaggatcgggaagggtcgtgagaagcgcatcaagcccatcgacgtcctcaacgataaggtggcgaagttcagaaacgctacgaaccacaagtacgccaactacattgtgcagcaatgcttgaagtacaactgcgggaccattcagcttgaagacttgaagggcatatctaaggagcagacattcctcaagaactggacctacttcgacctccaggagaagatcaaaaaccaggctaaccagtacggggttaaggtcgtgaagatcgctccgagctacacatcacagaggtgcagcgagtgcgggtacattcacaagaacaacagacaagaccaatccacattcgagtgccaacagtgcagcttcaaggttcacgcagattacaacgctgccaagaacatctcagtgtacaacatcgagaaggtcattcagaagcagttggaattacaggagaagctgaaccagacgaagtacaaggagcagtacatcgagcagatgaaaaatatcaactag

SEQ ID NO: 3017 - DNA, 1362 bp, Unknown
  Bacillus sp. multi
gttacctacctctccatcgccgtgaaggtgatgaagtaccagatagtgtgcccggtcaatatcgagtggaagaccttcgagatatacctgaggactctcagctaccacttccgcaccattgggaacagaacgattcagaagctctgggagtacgacaaccagtcgctcaagcacttcaaggacacgggacaataccctagcgcgcagcagctttacggctgcacacagaagaccatctccggctatatctacgaccagttgaaggaggaatatcaggatattaacaaggccaatatgtcaacgaccttgcagaagaccatccgcacctggaactctcgcaagaaggagatttggagtggagagatgagcataccatcctttcgtaacaacctacccatcgacattcacggcaacagcatccagatcattaaggagaagtctggggactacatcgccagcgtgagtctgttctcctctaagttcattaacgagaacgacctccccaacgggaagatccttgtgaagctgtccaccaggaagcagaacagcatgaaggtcatcctggacaggataattgactcaacctacgcaaaaggtgcctgcatgttacacaaacacaaaaagaaatggtacttgtccataacctacaagtcgaacattaaggaggagttgaaattcgacgaggacttgataatggggattgacatggggaagattaacgtcctgtacttcgcattcaacaaggggctcgtgcgaggcgctatcagcggcgaggagattgaagcgtttcgcaaaaagatcgagcaccgccgtattagcctcttgcgtcagggcaagtattgctcgggcaatcgaatcggcaagggccgtgagaagcggatcaagcctatcgacgtcctgaatgacaaagtggccaaattccgtaatgccaccaatcacaagtacgccaactacatcgtccaacagtgcttaaagtacaactgtggcacaattcagttagaggacttgaagggtatctctaaggagcagacattcctcaagaactggacctacttcgatctccaggaaaaaatcaagaatcaggcgaaccagtacggcgtcaaggtggtgaagatcgctcccagctacaccagtcagcgttgctcggagtgcggctacatccacaagaacaacagacaagatcagtcaaccttcgagtgccagcaatgcagtttcaaggtgcacgccgactacaacgcagccaagaacatctcagtgtacaacatcgaaaaggttatccagaagcagctagaactacaggagaagctaaaccagaccaagtacaaggagcagtacatcgaacagatgaaaaacatcaactga

SEQ ID NO: 3018 - DNA, 1362 bp, Unknown
  Bacillus sp. multi
gtgacatacctatccatcgcggtcaaggtcatgaagtaccaaatcgtctgcccagtcaacatcgagtggaagaccttcgaaatctacctccgcacactgtcttaccacttccgcactatcgggaacaggaccatccagaagctctgggagtatgacaatcagagtcttaagcacttcaaggatacaggccagtaccccagtgctcagcagctctacggttgcacccagaaaacgatcagcggctacatctacgaccagcttaaggaggaataccaggacatcaataaggccaatatgtccaccaccctccaaaaaactattcggacttggaactcacgcaagaaggaaatctggagtggggagatgagtatccccagctttcggaacaacctcccaattgatattcatggaaattcaatccagatcatcaaggagaagtcaggcgactacatcgccagcgtatcccttttcagctcaaagttcatcaacgagaacgaccttccgaacggaaagatcctagttaagttgagtacgcgcaagcagaactctatgaaggttatcttagaccgcatcattgactctacttacgcaaaaggtgcctgcatgttgcacaagcacaagaagaagtggtatctgagcatcacctacaagagcaacatcaaggaggagttgaaattcgacgaggacttgataatgggcatcgacatgggcaagatcaacgtcttgtactttgcattcaacaagggtctggttcgaggggccatatccggggaggaaatcgaggctttccgcaagaagattgagcaccgccgcatctcacttctgcgtcaggggaagtactgctcgggaaacaggatagggaaaggacgcgagaagcggattaagcctattgacgtacttaacgacaaagtggccaagttccgtaacgctactaatcacaagtacgcaaactacatcgtccaacagtgcctcaagtacaactgcgggaccatccagcttgaagacctaaagggcatcagcaaggagcagaccttcctcaagaattggacgtacttcgacctccaggaaaaaatcaagaatcaggcaaaccagtacggggtgaaggtggtgaagattgccccaagctacacatcccagaggtgctcggagtgcgggtacattcacaagaacaacagacaagaccagtccaccttcgagtgccagcagtgcagtttcaaggtgcacgcggactacaacgccgccaagaacatatccgtgtacaacatcgagaaggtgatccagaagcagttagaattacaggagaagctaaaccagacgaagtacaaggagcagtacatcgagcagatgaagaatatcaactga

SEQ ID NO: 3019 - DNA, 1362 bp, Unknown
  Bacillus sp. multi
gtcacctacctctccatcgcggtgaaggtgatgaagtaccagatcgtgtgccccgtgaacatcgaatggaagacgttcgagatatacctccgcacattgtcctatcacttccgcaccatcggaaatcggacaattcagaaactctgggagtacgacaaccagagtctcaaacacttcaaagacaccgggcagtacccgtccgcccagcagctctacggttgcacccagaaaacaatttcggggtacatctacgaccagctcaaggaggagtaccaagacatcaacaaggcgaatatgtcaaccaccttgcagaaaactatcagaacgtggaactcccgcaagaaggaaatctggagcggggagatgtcaataccctccttccgcaacaacctcccgattgacattcacggcaactcaatccaaatcatcaaggagaagtccggcgactatatcgcatcagtttccttgttcagctccaagttcatcaacgagaacgacctgcccaatggcaagatcctcgttaagctctccacccggaagcagaactccatgaaggtcatcttggatcggataattgactcgacctacgcaaagggtgcctgcatgttacataagcacaagaagaagtggtatttgagcatcacctacaagtcgaatatcaaggaggagttgaaattcgacgaagacttaatcatggggattgacatgggcaagatcaacgtattgtacttcgctttcaacaaggggctggtgcgaggagcgatcagtggggaggagattgaagccttccgcaaaaaaatcgagcaccggaggatctcgctgctacgtcaagggaagtattgttccgggaaccgcatcggcaaagggcgcgagaagcggattaagccgattgatgtcttgaatgacaaggtggccaaattccgtaacgcaactaaccacaagtacgccaactatatcgtgcagcagtgccttaagtacaactgtggaaccattcagcttgaggacttgaaggggatctcgaaggagcagaccttcctcaagaactggacttacttcgacctccaggagaagatcaaaaaccaggccaaccagtacggggtgaaagtggtcaagattgcaccgtcttacacctcgcagcggtgctccgagtgcgggtacattcacaagaacaacagacaggaccaaagtacgttcgagtgccagcagtgcagcttcaaggtgcacgccgactacaacgcagccaagaacatctcagtgtacaacatcgaaaaggtcatccagaagcagttggaactacaggagaaactcaaccagactaagtacaaggaacagtacatcgagcagatgaaaaacatcaactga

SEQ ID NO: 3020 - DNA, 1353 bp, Unknown
  Bacillus sp. multi
ctcagcattgccgttaaggtcatgaagtaccagatagtgtgtcccgtgaatatcgagtggaagaccttcgaaatctacttgagaaccctcagttaccacttccgcaccatcgggaaccgcaccattcagaagctctgggagtatgataaccagtctctcaagcacttcaaggatacaggacaatatccgagtgcccagcagttgtacggctgtacccaaaaaaccatctcaggctacatctacgaccaactcaaggaggagtaccaggacatcaacaaggccaatatgtccaccaccctccagaaaacgatccggacctggaactcccgcaaaaaagagatatggagcggagaaatgtcaatcccgtctttccgtaacaacctgcctatcgacatacacggaaattcgatccagatcatcaaggagaagtcaggagactacatcgcatcagtttcgctgtttagctcgaaattcatcaacgagaatgacttacctaacggcaagatcctcgtcaagttatctacccgcaagcagaactccatgaaggtgattctcgacaggatcatcgactcgacctacgctaagggtgcttgcatgttgcacaagcacaagaagaaatggtacttgagcataacctacaagtccaacatcaaggaggaactcaagttcgacgaagacctcataatgggaatagacatgggcaagatcaacgttctctatttcgccttcaacaaggggttggtacgcggggcgatcagtggggaggagatcgaggctttccgcaagaagattgagcacaggcggatctcgctcttgcgtcagggcaagtactgtagcgggaacaggatcggcaaggggcgcgagaagcggattaagcctattgacgtcctaaacgacaaggtggctaagttccgtaacgctacaaaccacaagtacgcgaactacattgtgcagcagtgcctcaagtacaactgcggcaccatccaacttgaggacttaaagggcatcagcaaggaacagacattccttaagaactggacctatttcgatctacaggagaagatcaaaaaccaggccaaccagtacggcgttaaagtggtcaagattgcgccatcttacacatcccagaggtgctcagagtgcggttacatccacaagaacaaccgacaggatcagtccaccttcgagtgccagcagtgctccttcaaagtgcacgccgattacaacgccgccaagaacatctcggtgtacaacatcgaaaaggtgatccagaagcagcttgaattacaggagaagttaaatcagacaaagtacaaggaacagtacattgagcagatgaaaaacatcaactga

SEQ ID NO: 3021 - DNA, 1353 bp, Unknown
  Bacillus sp. multi
ctgagcattgccgtgaaagttatgaagtaccagatagtctgccccgtgaacatcgagtggaagacgttcgagatatacctccgcaccctcagctaccactttcgtaccatcggaaaccgcacaatccagaagctctgggagtacgacaaccagtccctcaagcacttcaaggacaccggacagtacccctctgcccagcagctttacggatgcacccagaaaaccatctccgggtacatctacgaccagttaaaggaggaataccaggacattaacaaggcgaatatgtcaacaaccctccagaaaactatacgcacgtggaactcccgcaaaaaagagatatggagcggcgagatgagcatccccagcttccgaaacaacctccctatcgacatccacggcaactccatccagatcatcaaggagaaatctggcgactacattgcttccgtgtcgctcttcagctccaagttcatcaacgaaaacgacctcccaaacggaaagatcctggtgaagctctccactcgtaagcagaacagtatgaaggtcatccttgaccgcattatcgacagcacctacgcaaaaggggcctgcatgttgcacaagcacaagaagaagtggtacttgtcaatcacctacaagagcaacatcaaggaggagttgaagttcgacgaagacctcattatggggatcgacatgggcaagattaacgtcctatacttcgctttcaacaagggcttggtgaggggagcaataagcggggaggagatcgaagcctttcgcaagaaaatcgagcacaggaggatctcgctgctcagacaggggaaatattgttcggggaacagaatcggaaaaggccgtgagaagcggatcaagccaattgacgtcctgaacgacaaggtggcaaagttcagaaacgctacaaaccacaagtatgcgaactacatcgtgcagcagtgcctcaagtacaactgcgggacaattcaacttgaggacttgaaggggatcagtaaagagcagactttcctcaagaactggacctacttcgacttacaggagaagatcaaaaaccaggcgaatcagtacggagtcaaggtcgtaaagatagcgccgagctacaccagccagaggtgctcggagtgcggctacattcacaagaacaatcgccaggaccagtcaacgttcgagtgccagcagtgcagtttcaaggtccatgctgattacaacgctgccaagaatatctctgtgtacaacattgagaaggtgatccagaagcagctagagttacaggagaagctcaaccagacaaagtacaaggagcagtatatcgaacagatgaaaaatatcaactga

SEQ ID NO: 3022 - DNA, 1353 bp, Unknown
  Bacillus sp. multi
ctcagcatcgccgtgaaggtcatgaagtaccaaatagtatgccccgtgaacatcgagtggaagacattcgaaatctacttgcggactctttcgtaccactttcgtaccattggcaaccgcacgatccaaaagctctgggagtacgacaatcagtcactcaaacacttcaaggatacaggccagtacccgtccgctcagcagctttacgggtgcacgcaaaaaacgatcagtggctatatctatgaccagctcaaggaggagtaccaggacatcaataaggccaacatgagcaccaccctacagaagaccatccggacctggaactcccgcaaaaaggaaatctggagcggtgaaatgtccatccccagcttccgtaacaatctccctatcgacatccacgggaactccatccagatcattaaggagaaatcaggggactacatcgcctctgtgtccttgttctccagcaagttcatcaacgagaacgacttgcccaacgggaagattctggtgaaactgagtaccaggaaacagaactcgatgaaggtcatccttgatcgcataatcgactctacctacgcgaaaggtgcctgcatgttgcataagcacaaaaagaagtggtacttgtctattacatacaagtccaacatcaaggaggagttgaagttcgacgaagacttaatcatggggattgatatgggcaagatcaacgtgctctacttcgccttcaacaaggggcttgtcaggggagcaatctctggggaggagatcgaggcttttcgcaagaaaatcgagcacagacgcatctcgctgctcagacagggcaagtattgctcggggaacagaatcgggaaaggccgggagaagcgcatcaagcccatcgacgtactgaacgataaggtcgccaagttccggaatgcaacgaaccacaagtacgccaactacattgttcagcaatgcctcaagtacaattgcggaacgatacaattggaagacttgaagggtatctcaaaggagcagactttcctcaagaactggacctacttcgacttacaggagaagatcaaaaaccaggcgaaccagtacggggttaaggttgtcaaaatcgcgccctcttacacgagccagagatgtagcgagtgcggttacattcacaagaacaaccgccaggaccagtcaaccttcgaatgccaacagtgctccttcaaagtccacgcggactacaatgcggccaagaacataagcgtgtacaatatcgaaaaggtcatccagaagcagttggaattacaggagaagctgaaccagaccaagtacaaagagcagtacattgaacagatgaaaaatatcaactga

SEQ ID NO: 3023 - DNA, 1353 bp, Unknown
  Bacillus sp. multi
ctgagcattgccgtgaaggttatgaagtaccagattgtctgcccagtgaacatcgagtggaagacgttcgagatatacctccggacgctttcctaccacttccgcaccatcggaaaccggacaatccagaagctctgggagtatgacaaccagtcgttgaagcacttcaaagacacgggacagtacccctcagcccagcagctttacgggtgtacgcagaaaaccatcagcgggtacatctacgaccagctcaaagaggagtaccaggacatcaacaaggccaatatgagcacaaccctccagaagaccattcgcacatggaacagccgcaagaaggaaatctggagcggcgagatgtccatcccgtcgttccgtaacaacttgcccattgacattcacggcaactcaatccagatcatcaaggagaaatcgggtgattacattgccagcgtatccctcttcagtagcaaattcatcaacgagaacgacctgccaaacgggaagatcctcgtgaagctaagcaccaggaagcagaacagtatgaaggtcatcctcgaccgcatcatcgacagcacctacgccaaaggggcgtgcatgttgcacaagcacaaaaaaaagtggtatttgagtattacctacaagtcgaacatcaaggaggagttgaaattcgacgaagacctcattatgggcatcgacatggggaagataaacgttctctacttcgctttcaacaagggactcgtcagaggagcaatctccggggaggaaatcgaggcgttccgcaagaaaatcgagcaccgtcggattagcctgctgcgccaggggaaatattgctccggaaaccgtatcgggaagggccgggagaaacgtattaagcctattgacgtccttaacgacaaggtggccaagttccgcaacgccaccaaccacaagtacgcgaactacattgtccagcagtgcttgaagtacaattgcggcactatacagttggaagacttgaaggggattagcaaggagcagaccttccttaagaactggacttacttcgacctacaggagaagatcaaaaaccaggccaaccagtacggggtgaaggtggtcaagatcgcgccttcatacacatcacagcgttgctccgagtgcggctacatacacaagaacaaccgacaggatcagtccactttcgagtgccagcagtgcagcttcaaggtccacgccgactacaacgcggccaagaacatcagcgtgtacaatatcgagaaggttatccagaagcagctagaattacaggagaagctaaaccagacgaagtacaaggagcagtatatcgaacagatgaagaacatcaactga

SEQ ID NO: 3024 - DNA, 1353 bp, Unknown
  Bacillus sp. multi
ctgagcatcgcggtcaaggtgatgaagtaccagatcgtgtgccccgtgaacatcgagtggaagacattcgaaatctacctaagaaccctctcgtaccacttccgtaccattgggaacagaaccattcagaagctctgggagtacgacaatcagagcctcaagcacttcaaggatacgggccagtaccccagcgcccagcagctttacgggtgcacacagaagacaatctcggggtatatctatgaccaactcaaggaggagtaccaggacatcaacaaggccaatatgtccacaaccctccagaaaaccatcaggacatggaactcacgcaaaaaggagatatggagcggcgagatgagcatcccctccttccggaacaacttgcctatcgacatccacggaaactcgatccagatcatcaaggaaaagtccggggactacatcgcatcggtgtccttattctcatccaaattcatcaacgagaatgatcttcccaacggaaagattctcgtgaaattgtccacccggaaacagaactccatgaaggtgatcctcgaccgcataattgactccacttacgcgaagggagcctgcatgttgcacaagcacaagaaaaagtggtatctgagtattacctacaagtcaaacatcaaggaggaattgaagttcgacgaggacttaatcatggggatagacatgggcaagattaacgtcctgtacttcgccttcaataagggcctggttcgcggtgctatctccggggaggagattgaggcttttcgcaagaagattgagcaccgccgaatctcgttattgagacaagggaaatattgttccggcaatcgcattgggaaagggcgcgagaaacgcatcaagcctattgacgtccttaacgacaaggtggctaagttcagaaatgcgaccaaccacaagtacgcaaactacatcgtgcagcagtgcctcaagtacaattgcggaaccatacagttggaagacttgaaggggattagcaaggagcagacattcctcaagaactggacgtacttcgacctccaggagaagatcaaaaaccaggcaaaccagtacggcgtcaaggtcgtcaagatcgcaccgtcttacacctctcagcgttgctccgagtgcggctacatacacaagaacaaccgacaggaccaatccaccttcgagtgccagcagtgcagcttcaaggtccacgccgactacaacgcggccaagaatatctccgtttacaacatcgagaaggtgatccagaagcagctagagttacaggagaagctcaaccagacgaagtacaaggaacagtacattgaacagatgaagaacatcaactga

SEQ ID NO: 3025 - DNA, 1332 bp, Unknown
  Bacillus sp. multi
atgaagtaccagatagtctgccccgtgaatatcgagtggaaggcgttcgagatatacctccgtaccctctcgtaccactttcgcaccatcggcaaccgtaccattcagaagctctgggagtacgacaaccagagtctaaagcactttaaagatactgggcagtatcccagcgctcagcagttgtacgggtgcactcagaaaaccatctccggctacatctatgaccagttgaaggaggaataccaggacattaacaaggccaatatgagtaccacccttcagaaaacgattaagacttggaacagccgcaagaaggaaatctggagcggcgagatgagcatcccgtccttccgcaacaacttgcccatcgacattcacggcaactccatccaaatcattaaggagaagtctggcgactacatcgccagcgtgagcttgttctcaagcaagttcatcaaggagaacgacctccccaacgggaaaatcctagtcaagctatccactaggaagcagaacagcatgaaggtgatcctggaccgcattatcgacagcacctacgctaagggtgcctgcatgttgcacaaacacaagaagaaatggtacttgagcattacttacaagtccaacattaaggaggagttgaagttcgacaaggatctgattatggggatcgacatgggcaagataaacgtgctctacttcgccttcaacaagggccttgttcgtggtgccatctctggcgaggagattgaggcgttccgcaaaaaaatcgagcaccggagaatctcattgctgcgtcagggcaagtattgttctggaaaccgaatagggaaaggccgcgagaaacgtattaagcctatcgacgtgctcaacgacaaggtggctaagttccgcaacgccactaaccacaagtatgcgaactatatcgtacaacaatgcctcaagtacaattgcgggaccattcagcttgaggacttaaagggcatcagtaaggaacagactttcctcaagaactggacttacttcgacctccaggagaagattaaaaaccaggccaaccagtacggtgtcaaggttgtcaagattgacccgtcctacacgagccagagatgcagcgagtgcgggtacattcacaagaacaaccgtcaggaccagtccacgtttgagtgccagcaatgttccttcaaggtccacgccgattacaacgcagctaagaatatctccatgtacaacatcgagaaggtgatccagaagcaactggaactccaggagaagttgaatctcaccaagtacaaggagcagtacctggagcagatggagaacatcaactga

SEQ ID NO: 3026 - DNA, 1332 bp, Unknown
  Bacillus sp. multi
atgaagtaccagatcgtgtgcccggtgaacatcgagtggaaagcgttcgaaatctatctccgcacgctctcgtaccacttcagaaccatcggcaaccgcacgatccagaagttgtgggagtacgacaaccagtccctcaagcactttaaggacacaggccagtacccctcggcacagcagctctacggctgcacccaaaaaaccatctcgggctacatctacgaccaacttaaggaggaataccaggacatcaacaaggccaacatgagcaccaccctccagaagactattaagacatggaacagccgcaagaaggagatatggagtggggagatgtccatcccttcgtttcggaacaaccttcccattgacatccacggcaattcgatccagatcattaaggaaaagtcgggcgactatatcgcgtccgtatctctgttcagttctaagttcatcaaggagaacgatctgcccaacgggaagattctcgtgaagctctccactaggaagcagaactcgatgaaggtgatcctggacaggatcattgactccacctacgctaagggagcctgcatgttgcacaagcacaagaagaagtggtatttgagtatcacctacaagtccaacatcaaggaggagttgaaattcgacaaagacctcatcatggggatcgacatgggaaagatcaacgtgctatacttcgcattcaacaagggtctagtccgtggagccatctccggcgaggagattgaagcctttcgcaaaaaaatcgagcacaggcgaatttccttattacgtcagggcaaatattgctccggaaaccggattggaaagggccgtgagaagcgtatcaagccaattgacgttctcaatgacaaggtggccaagttccgtaatgccacgaaccacaagtacgccaactacattgttcagcagtgcctcaagtacaactgtgggaccatccagcttgaagatttgaaagggatttcgaaggagcagaccttccttaagaattggacatactttgacctccaggaaaaaattaagaatcaggcaaaccagtacggcgtgaaagtggtgaagatcgacccatcctacacctcccagagatgttccgaatgcgggtacatccacaagaacaacagacaagaccagtcaaccttcgagtgccagcagtgctctttcaaagtccacgcggactacaatgccgccaagaacattagcatgtacaatatcgaaaaggtcatccagaagcagcttgagctacaggagaagctcaacctgacaaagtacaaggagcagtacctggagcagatggagaacatcaactga

SEQ ID NO: 3027 - DNA, 1332 bp, Unknown
  Bacillus sp. multi
atgaagtaccagatcgtttgcccggtcaacattgagtggaaagcctttgaaatctacttgcggaccctaagctaccacttcagaaccattggaaaccgtaccatccagaagctctgggagtacgacaaccagtctctcaagcacttcaaagataccgggcagtaccccagcgcgcagcagctctacggttgcactcagaaaacaatctcaggctacatctacgaccagctcaaggaggagtaccaggacattaacaaagccaacatgagcaccaccttgcagaaaacgattaagacctggaactcccgcaaaaaggagatatggagcggcgaaatgtctatcccctccttccgaaacaacttgccaattgacattcacggaaacagcatccagatcattaaggagaagtcgggcgactacattgcctccgtcagcctctttagctccaagttcatcaaggagaacgacttgccgaacgggaagattctggtgaaactctctactaggaagcagaactccatgaaggtgatactggaccgcatcatcgacagcacctacgccaaaggggcctgcatgttacacaagcacaagaaaaagtggtatctctctattacttacaagtcgaacatcaaggaggaattgaagttcgacaaagacctaatcatggggattgacatggggaagatcaacgtactatacttcgccttcaacaagggtcttgtgcggggtgcgatcagcggcgaggagattgaggctttccgcaagaagattgagcaccggcgcatctccctcctccgacaggggaaatattgttcgggaaatcgaatcggaaagggccgggagaagcgcatcaagccaattgatgtcttgaacgacaaagtggccaaattccgtaacgcaacaaaccacaagtacgctaactatatcgtgcagcagtgcctcaagtacaactgcggcacgatccagcttgaggacttgaagggtatcagtaaagagcagaccttcctcaagaattggacctacttcgacctccaggagaagatcaaaaaccaggcgaaccagtacggggttaaggtggtgaagatagacccctcctataccagccagcgatgcagcgagtgcgggtacattcacaagaacaacagacaagaccaaagcactttcgagtgccagcagtgctccttcaaggtccacgcagactacaacgccgctaagaacatcagcatgtacaacatcgaaaaggtcattcagaagcagctagaattacaggagaagctgaatctcacgaagtacaaggaacaatacctggagcagatggagaacatcaactag

SEQ ID NO: 3028 - DNA, 1332 bp, Unknown
  Bacillus sp. multi
atgaagtaccagatagtgtgtcccgtgaacatcgagtggaaggcgttcgaaatctacttacgaactctgagttatcacttccggaccattggcaaccgcaccatccagaagctctgggagtacgacaaccagagtctcaagcacttcaaagacaccgggcagtacccctccgcgcagcagctttacggttgcactcaaaaaacaatctccgggtatatctatgaccaattgaaggaggagtaccaggacatcaacaaagccaacatgagcacgaccctccagaaaaccattaagacctggaactcccgcaagaaagagatttggagcggcgagatgtctatcccctcgttccgcaacaacttgcctattgatattcacgggaactccattcagatcatcaaggagaagtccggggactacatcgcgtccgtgagccttttcagcagcaagttcatcaaggagaacgatctcccaaacggcaagatcctggttaagttgtcaacgcgaaagcagaactctatgaaggtcatacttgaccgcataattgacagcacctatgcaaagggtgcctgcatgttacacaagcacaagaagaagtggtatttgagtattacttacaaaagtaacatcaaggaggagttgaaattcgacaaagacctcattatgggcatcgacatggggaagattaacgtgctgtacttcgccttcaacaaggggctggtcaggggtgctatcagtggggaggagattgaggctttccgcaaaaagatcgagcacaggcgcatatcgctcctgagacaaggcaaatattgttcgggcaacaggatcgggaaggggcgcgagaagcggattaagcctatcgacgttctgaatgacaaggtggccaagttccgaaacgcgaccaaccataagtacgccaactacattgtccagcagtgcttgaagtacaattgcggcacgatacagcttgaagacttgaaggggatctctaaggaacagacattccttaagaactggacctacttcgacctccaggagaagatcaaaaaccaggcgaaccagtacggggtgaaggtcgtcaagatcgaccccagctacacctctcaacggtgctccgagtgcgggtacatacacaagaacaaccgtcaggaccagtccaccttcgagtgccagcagtgctctttcaaagtgcacgccgactacaacgcagccaagaatatcagcatgtacaacattgagaaggtgattcagaagcagttggaactccaggagaagctcaaccttacgaagtacaaggagcagtaccttgagcagatggagaacatcaactag

SEQ ID NO: 3029 - DNA, 1332 bp, Unknown
  Bacillus sp. multi
atgaagtaccaaatagtgtgccccgtgaacatcgagtggaaagcctttgagatatacctgcgaaccctcagttaccacttccgtaccatcggcaaccggaccatccagaagctctgggaatacgacaatcagagcctcaaacacttcaaagacaccggccaatacccttcggcccagcagctctacggatgcacgcagaagacaatctccggctacatctacgaccagctcaaggaggaataccaggacatcaacaaggcgaatatgtccaccaccttacagaaaacgattaagacctggaacagccgcaaaaaggaaatctggagcggcgagatgtctataccttcattccgtaacaacctccctattgacattcacggcaactcgatccagatcattaaggagaagtccggcgactacatcgcaagtgtctcgttgttctcaagcaagttcatcaaggagaacgacttacctaacgggaagatcctggttaagctgagcaccaggaagcagaactccatgaaggtgatcctcgacaggataatcgactccacctacgctaaaggagcgtgcatgttgcacaaacacaagaagaaatggtacttgagcattacctacaagtcgaacatcaaggaggagcttaagttcgacaaagacctaatcatgggcattgacatggggaagattaacgtcttgtacttcgcattcaacaagggccttgtgcgtggtgctatctcaggggaggagattgaagccttccgcaagaagatagagcaccgaaggatcagcctcttaagacaggggaaatattgttctggcaaccggatagggaaaggtcgtgagaagcgtattaagcccattgacgtccttaacgataaggtggccaaattccgtaatgctaccaaccacaagtacgccaactacatcgtccaacaatgccttaagtacaactgcgggaccattcagctcgaagaccttaaagggatcagcaaggagcaaaccttcctcaagaattggacctacttcgacctccaggagaagatcaaaaaccaggccaaccagtacggggtgaaggttgtgaagatcgacccctcctacacatcccaacggtgtagtgagtgtggctacatccacaagaacaaccgccaggaccagagcactttcgagtgccagcagtgcagtttcaaggtgcacgcggactacaacgccgctaagaacatctccatgtacaacatcgagaaggtgattcagaagcaattggagctacaggagaaactgaacctgacgaagtacaaggagcaatatctggaacagatggagaacatcaactga

SEQ ID NO: 3030 - DNA, 1353 bp, Unknown
  Bacillus sp. multi
ttgtcgattgccgtgaaggtcatgaagtaccaaatagtgtgtcccgtcaacatcgaatggaagaccttcgagatatacctccgcaccctttcgtatcacttcagaaccatcggaaaccgcaccattcagaagctctgggagtacgataaccagtccctcaagcacttcaaggacaccggtcagtacccgtctgcccaacagctctacggttgcacacaaaaaacaatctctggctacatatacgatcagttgaaagaggaataccaagacatcaacaaggcgaacatgagcaccactttgcagaagactatccgaacctggaacagccgcaagaaggaaatctggagcggggagatgagcatcccgtctttccggaacaacctaccaattgacatccacggcaactcgatacagattatcaaggaaaagtctggcgactacatcgcgtctgtctcgctgttctcctccaagttcatcaaggagaacgacttaccgaacggcaagattctggtgaagttgtccacacgaaagcagaactccatgaaggtgatcctcgaccggattatcgactccacctacgctaagggtgcgtgcatgttacacaagcacaaaaaaaagtggtatctatccatcacttacaagtccaatatcaaggaggagctgaaattcgacgaagaccttatcatgggaatagacatgggcaagattaacgttctgtacttcgctttcaacaaggggcttgtcaggggagctatttccggggaggagatcgaggctttccgcaagaagattgagcaccgccgtatcagtctcctgcgccaggggaaatattgttccgggaaccgaatcggcaagggccgtgaaaagcgcattaagccgattgacgtacttaacgataaggtggcgaaattccgtaatgcgactaaccacaagtacgccaactacattgtgcaacaatgcttgaagtacaattgtggtacaatccagttagaggatctcaagggaatctcgaaggagcagacattcctcaagaattggacgtactttgacctccaggaaaaaatcaagaatcaggctaaccagtacggggtgaaggtggtcaagatcgacccgtcctataccagccagaggtgctccgagtgcggctacattcacaagaataaccgccaggaccagagcactttcgagtgccagcagtgctcgttcaaggtgcacgcagactacaacgccgccaagaacatcagcgtgtacaacatcgaaaaggttattcagaagcaacttgaactccaggagaagctcaatcagacgaagtacaaggaacagtatatcgaacagatgaagaacattaactaa

SEQ ID NO: 3031 - DNA, 1353 bp, Unknown
  Bacillus sp. multi
ttgtccatagccgtgaaggttatgaagtaccagatagtgtgccccgtgaacattgaatggaagaccttcgaaatctacctcagaaccctctcctaccacttccgcacaatcggaaaccgaaccatccagaagctctgggagtacgataaccagtccctcaagcacttcaaggacactggtcagtacccctccgctcagcaactttacggttgtacccagaagacaatctccgggtacatctatgaccagctcaaagaggagtaccaggacatcaacaaggcgaatatgagcaccacccttcaaaaaactatccggacctggaacagccgcaagaaggaaatctggagcggggagatgagtattccctccttcagaaacaatctcccaatcgacatccacggaaattctatccagatcatcaaggagaagtccggggactatatcgccagtgtttccctctttagctcgaaattcatcaaggagaatgacctacccaacgggaagatcctggtgaagctatccacccgcaagcagaactccatgaaggtgattctggacaggatcatcgactccacgtacgctaaaggagcttgcatgttgcacaaacacaagaaaaagtggtacttatccattacctacaagtcgaacatcaaggaggagttgaaattcgatgaagacctcataatggggattgacatgggcaagatcaacgtgctgtacttcgcgttcaacaaggggctcgtgaggggtgcaatctcaggcgaggagatcgaggcgttccgcaagaagattgagcaccggagaatcagtctgctgcgacagggcaagtattgcagcggcaaccggatagggaagggacgtgaaaagcgcattaagcctatcgacgttctcaacgataaggttgcgaagttcagaaatgcgaccaaccacaagtacgctaactacattgtgcagcagtgtcttaagtacaactgcggaacaatccagttggaagatttgaagggcatctcgaaggaacagacattcctcaagaattggacctactttgacctccaggagaagatcaaaaaccaggccaatcagtacggtgttaaggtggtgaagatcgacccctcatacactagccaacgatgcagtgaatgcggctacatccacaaaaacaaccgccaagaccaatccacgttcgagtgccagcagtgctccttcaaggtgcacgccgactacaacgccgctaagaacatcagcgtttacaacatcgaaaaggttatccagaagcagttggagttacaggagaagctgaaccagacgaagtacaaggagcagtacatcgagcagatgaagaatatcaactga

SEQ ID NO: 3032 - DNA, 1353 bp, Unknown
  Bacillus sp. multi
ctgagcattgcggtgaaagtcatgaagtaccaaatcgtttgtccagtcaacatcgaatggaagacgttcgagatatacctcagaaccttgtcctaccacttccgcaccatcggcaatcggaccatacagaagctctgggaatacgacaatcagtcattgaaacactttaaggacaccgggcagtacccaagcgcccaacaactctacggatgcacccaaaaaaccatctctggctacatctacgaccagcttaaggaggagtaccaggacatcaacaaggccaacatgagcaccaccctccagaaaaccatcaggacttggaactcccgcaagaaggaaatctggagcggcgagatgtccatcccttccttccgaaacaacctccccatcgacatccacggcaacagcatccagatcattaaggagaaatccggtgactacatcgcgtcagtgtccctcttcagtagcaaattcatcaaggagaacgatcttccgaacggcaaaatcctggttaaactcagcacccgtaagcagaacagcatgaaggtgattctcgaccgtatcatcgactctacctacgcaaagggcgcgtgcatgttgcacaagcacaagaaaaagtggtacttgagtatcacttacaagagcaacatcaaggaggaattgaagttcgacgaagacctcattatggggatcgacatgggaaagatcaacgtgctgtactttgccttcaacaagggcctggtgcgcggtgcgatctcaggggaggagatcgaggctttccgcaaaaagattgagcaccgtcgtatcagtctgctacgacaggggaagtactgctccgggaaccgaatcggcaaaggacgcgagaaacgcatcaagcctatagacgtgctgaacgacaaggtggccaagttcagaaacgccacaaaccacaagtacgccaactacatcgtgcaacagtgcttgaagtacaattgcgggaccatccagcttgaggacttgaagggaatatccaaagagcagaccttcctcaagaactggacatacttcgacctccaggagaagatcaaaaaccaggccaaccagtacggcgtgaaggttgtgaagatcgacccatcatatacaagtcagcgatgctccgagtgcggctacatccacaagaacaaccgtcaagaccagagcacctttgagtgccaacagtgctcattcaaggtgcacgccgactacaacgccgccaagaacatcagtgtttacaatatcgagaaggttatccagaagcaactagaactccaggagaaactaaaccagaccaagtacaaggagcagtacatcgagcagatgaagaacattaactga

SEQ ID NO: 3033 - DNA, 1353 bp, Unknown
  Bacillus sp. multi
ctatccatcgccgtgaaggtgatgaagtaccagatcgtgtgcccggtcaacatcgagtggaagacattcgaaatctacctgcggaccctctcataccacttcagaaccatcggaaaccgcacgatacaaaagctctgggagtacgataaccagagcctcaaacacttcaaggacaccggtcagtacccctcagcccagcaactttacggctgcactcagaaaaccatcagcggctatatctacgaccagcttaaggaggagtaccaggacattaacaaggcaaacatgagcaccactcttcaaaaaactattcgcacgtggaacagtcgcaagaaagagatttggagtggcgagatgtccattccgtcctttcgcaacaacttgcctattgacatccacggcaactctatccagatcattaaggagaagtcaggggactacatcgcgtccgtctccttgttcagctccaagttcatcaaggagaatgacttgcccaacgggaagatattggtcaagctctctacacggaagcagaacagcatgaaggtgatccttgacaggatcatcgactcaacgtacgctaaaggcgcttgcatgttgcacaagcacaagaaaaaatggtatcttagtatcacatacaagtccaacatcaaggaggagttaaagttcgacgaagacttaatcatggggattgacatgggcaagatcaacgttctctacttcgccttcaacaagggactggtacgcggtgcaatatctggtgaggagatagaggcttttcgcaagaagattgagcatcggagaatttcccttctgcgccagggcaagtactgttccggcaacagaatcggcaaggggcgcgagaagcggattaagcctattgacgtgctcaacgacaaagtagccaaattccgaaacgctacgaaccacaagtacgcaaactacattgtgcagcagtgcttgaagtacaactgcggcacgatccagttggaagatttgaaagggatctcaaaggagcagaccttcctcaagaactggacctactttgacctccaggagaagatcaaaaaccaggccaaccagtacggcgtcaaggtggtgaagatagacccttcatacacctcccagaggtgctccgagtgcgggtacattcacaagaacaacagacaggatcaatccacgttcgagtgccaacagtgctccttcaaggtgcacgccgactacaatgccgccaagaacatatctgtgtacaacatcgaaaaggtgatccagaagcagttggagctacaggagaagctcaatcagaccaagtacaaagagcagtacatcgagcagatgaaaaatatcaactga

SEQ ID NO: 3034 - DNA, 1353 bp, Unknown
  Bacillus sp. multi
ctctctatagctgtgaaggtcatgaagtaccagatcgtatgcccggtgaacatcgagtggaagaccttcgaaatctacttacggaccctcagctaccacttccgcaccattggcaaccgcaccatccagaaactgtgggagtacgacaatcagtcccttaagcacttcaaggacacggggcaatacccttccgcgcagcagctatacggttgcacccaaaaaactatctccgggtacatctatgaccagctaaaggaggagtaccaggacatcaacaaggcgaacatgagcaccaccctccagaagactatccgtacatggaactcacgcaaaaaggagatttggagtggcgagatgtcgatcccctctttccgaaacaacctccccattgacattcacgggaacagcattcagatcatcaaggaaaagtcaggggactacatcgcctctgtgagcctcttcagttcaaagttcatcaaggagaacgacctgcccaacggcaagattctcgtaaaactatccacgcggaaacagaacagtatgaaggtgatcctggacaggataatcgactccacgtatgcgaaaggcgcttgcatgttgcacaagcacaagaagaagtggtatctgagcattacttacaagtccaacatcaaggaggagttgaagttcgacgaagacttaatcatggggatagacatgggcaagattaacgtcctgtactttgcattcaacaagggcctagtgcgaggtgctatcagcggggaggagattgaagcgtttcgcaagaagatcgagcaccgccgaatctcactgttacgacaggggaagtactgctcgggaaatcggatcggcaagggtcgtgagaaacggatcaagccaattgacgtcttgaacgacaaggttgccaagttccgcaacgctacaaaccacaagtacgcaaactacatcgtacagcagtgcctcaagtacaactgtgggaccatacagcttgaagacctgaaagggataagtaaggagcagacgttccttaagaactggacgtactttgacttacaggaaaaaatcaagaaccaggccaaccagtacggtgtgaaggtcgtgaagatcgacccgagctacaccagtcagcgctgttctgagtgcggctacatccacaagaacaacaggcaagaccagtccacgttcgagtgccagcagtgcagtttcaaggtgcacgccgactacaacgcagccaagaatatctcagtgtacaacattgagaaggtgattcagaaacaacttgaactccaggagaaactcaaccagaccaagtacaaagagcagtacattgagcagatgaagaatatcaactga

SEQ ID NO: 3035 - DNA, 1353 bp, Unknown
  Bacillus sp. multi
ctctccattgcagtgaaggtgatgaagtaccagatcgtgtgccccgtgaacatcgagtggaagacctttgagatatacctaagaactctgtcctaccacttccgcaccattggaaatcgcacgatccagaagctctgggagtacgacaatcactcccttaagcacttcaaagacaccgggcaatacccctccgcccagcagctatacggctgcacgcagaagaccatctcaggctatatctacgaccagcttaaggaggagtaccaggacattaacaaggcgaatatgagcaccaccttgcaaaaaaccatacggacatggaactcacgcaaaaaggaaatctggagcggcgagatgagcatcccctccttccgtaacaacctccctatcgacatccacgggaacagcatacagatcattaaggagaagtctggcgactacattgccagcgtttcactattctcgtctaagttcatcaaggagaacgacttacctaatgggaagatcctcgtcaagttgtccacgcgcaagcagaactcgatgaaggttatcttagacagaatcattgacagtacctacgcaaaaggtgcgtgcatgttgcacaaacacaagaaaaagtggtacttgtcgatcacctacaagtccaacatcaaggaggaattgaaattcgacgaagacctcatcatggggatagacatggggaagatcaacgtcctctactttgccttcaacaaggggctcgtccggggagcaatttccggtgaggagatcgaagcgttccgcaaaaagatcgagcataggcgaatttccctactccgacaggggaagtattgctccggaaacagaattgggaagggccgggagaagcggatcaagcctattgacgtgctaaatgacaaggtggccaagttccgcaacgccactaatcacaagtacgccaactatatcgtgcagcagtgcctcaagtacaactgtgggacaatccagcttgaggacttaaagggaatttcgaaggagcagaccttccttaagaactggacctatttcgacttacaggagaagatcaaaaaccaggccaaccagtacggggtcaaagtcgtcaagatcgaccccagctacacatctcaaaggtgttcagagtgcggttacattcacaagaacaaccgccaggaccagtccacgtttgagtgtcagcagtgctcgtttaaggtgcacgcggactacaacgcggccaagaacatatccgtttacaacatcgagaaggtgatccagaagcaattggagttacaggagaaactcaaccagaccaagtacaaggagaagtacattgagcagatgaagaacattaactaa

SEQ ID NO: 3036 - DNA, 1353 bp, Unknown
  Bacillus sp. multi
ttgtccatcgccgtcaaagtgatgaagtaccagatcgtgtgccccgtgaacatcgagtggaagacctttgaaatctacctgagaactctaagttaccacttccgcaccatcggcaaccgcaccatccagaagctatgggagtacgacaaccacagccttaagcacttcaaggataccggccagtacccctcggcccagcagctttacggttgcacccagaaaaccatctccggctatatctatgaccagttgaaggaggagtaccaggacatcaacaaagccaacatgagcactaccttgcagaagacaatccgcacctggaactctcgcaagaaggaaatctggagcggcgagatgtccattccttccttccggaacaaccttcccattgacattcatggcaactcaattcagatcatcaaggagaaatccggagactacatcgccagcgtcagtctgttctcctccaagttcattaaggagaacgacctgccgaacgggaagatacttgtgaagctcagcaccaggaagcagaactcgatgaaggtcatattggacaggataatcgactcaacctacgcaaaaggagcctgcatgttgcacaaacacaagaagaaatggtatttgagcataacctacaagagcaacattaaggaggagttgaagttcgacgaagaccttatcatggggatcgacatggggaagattaacgtgctctacttcgccttcaacaagggcttggtgaggggagccatcagcggcgaggagatcgaggcttttcgcaagaaaatcgagcaccggcggatcagtctgcttcgtcaggggaaatattgctctggaaaccgtatcgggaaggggagggagaagcgcattaagcccattgacgtgctcaacgataaggtggccaagttccgtaatgcaactaaccacaagtacgccaactacattgtgcagcagtgcttgaagtacaattgtgggaccatccagcttgaagacttgaaggggattagcaaagagcagacgttcctcaagaactggacctacttcgacctacaggagaagatcaaaaaccaggccaaccagtacggagttaaggtcgtgaagattgaccccagctacacatctcagcggtgctccgaatgcgggtacattcacaagaacaaccgccaggatcagtccaccttcgaatgccagcagtgttccttcaaggtgcacgccgactacaacgcggctaagaacataagtgtttacaacatcgagaaggtcatccagaaacaacttgagctacaggagaagctcaatcagaccaagtacaaggagaagtacatcgagcagatgaagaatatcaactga

SEQ ID NO: 3037 - DNA, 1353 bp, Unknown
  Bacillus sp. multi
ttgtccattgccgtgaaggtgatgaagtaccagatcgtgtgccccgtcaacatcgagtggaaaaccttcgagatatacttgcggaccctcagttaccacttccgcaccatcgggaatcgcaccatccagaagctctgggaatacgacaaccactcactcaagcacttcaaggataccgggcagtacccctcagcccagcagctttacggttgcacgcaaaaaactatcagcgggtacatctacgaccagcttaaggaggaataccaggacatcaacaaggccaacatgagtaccaccctccagaaaacgattcgcacgtggaactcccgcaagaaggaaatatggagcggggagatgagcataccttcgtttcgcaacaatctgcctatcgacatccacgggaactccatacagatcatcaaggagaagtcgggcgactacattgcatccgtgtctctgttcagctcaaagttcatcaaggagaacgacctccccaacgggaagatccttgtgaaactgtccacccgaaagcagaacagcatgaaggtgatattggacaggatcattgacagcacctacgcaaagggagcttgcatgttacacaagcacaaaaagaagtggtatttgagtattacctacaagtcaaacatcaaggaggaattgaagttcgatgaagaccttatcatgggaatcgacatggggaagataaacgtcctctactttgctttcaacaaggggcttgtgaggggtgcaatctcaggcgaggaaattgaggctttccgcaagaaaatcgagcatcgccggattagcctactgcgccaggggaagtattgttctgggaaccgtatcggcaaaggccgcgagaagcgcatcaagcccatcgacgtcctaaacgacaaggttgctaagttccgcaacgctacaaaccacaagtacgctaactacatcgtacagcagtgcttgaagtacaattgcgggaccatccagcttgaagacttgaaggggatctcaaaggagcagaccttcctcaagaactggacgtacttcgacctccaggagaagatcaaaaaccaggcgaatcagtacggcgttaaggttgtcaagatagacccctcctacacgagccagcgttgctccgagtgcgggtacatccacaaaaacaatcgtcaagaccagagtaccttcgagtgccagcaatgctctttcaaagttcacgcagactacaacgcggccaagaacattagcgtgtacaatatcgagaaggtgatacagaagcaacttgaactccaggagaagctaaaccagactaagtacaaggagaagtacattgagcagatgaaaaatatcaattga

SEQ ID NO: 3038 - DNA, 1353 bp, Unknown
  Bacillus sp. multi
ctctctatcgcggtgaaggtcatgaagtaccaaatcgtttgccccgtcaacatcgagtggaagacgttcgagatataccttagaactctgtcttaccacttccgtaccatcggcaacaggactatccaaaagctgtgggagtatgacaaccactctctcaaacacttcaaggacacggggcagtacccttccgcccaacaactatacggctgcacccagaaaactatctctggctatatctatgaccagctcaaggaggagtaccaagacattaacaaggccaacatgagcacaacactccagaagactatccgcacctggaacagccgcaaaaaagagatctggagcggagagatgtccataccctcgtttcgcaacaacctacccattgacatccacggaaactccatccagatcatcaaggagaagtctggcgactacatcgcgtccgtgagcttgttctcgtccaagttcatcaaggagaatgacttgcccaacggcaagatcctagtgaagctgtccacccgtaagcagaactctatgaaggtgatacttgacaggataatcgactccacctacgctaaaggtgcctgcatgttgcacaagcacaagaaaaagtggtacttgtcaatcacatacaagagtaacattaaggaggagttgaagttcgacgaagacttgataatggggattgacatgggcaagattaacgtcctttacttcgctttcaacaagggattggtccggggagcaatcagcggcgaggagatagaggcgtttcgcaagaaaatcgagcaccgcagaatctccctcctccgccaggggaaatattgttccggcaaccgcatcggaaagggccgggagaaacgcattaagccaattgacgtgctcaacgacaaggttgcaaagttccgcaacgccacaaaccataagtacgccaactacatcgtgcaacagtgcttgaagtacaactgcggcacgatacaattggaggacttgaagggaatttcgaaggagcaaactttccttaagaactggacatacttcgatctccaggagaagatcaaaaaccaggctaaccagtacggtgtcaaggtggtgaagattgaccccagttacacttcccagcggtgctcggagtgcggctacatccacaagaacaacagacaggaccaatctactttcgagtgccagcagtgctcgttcaaggtgcacgccgactacaacgccgccaagaacatatctgtttacaacatcgagaaggtgattcagaagcagctagaactacaggagaagctgaaccagaccaagtacaaggagaagtacatcgagcagatgaagaacatcaactga

SEQ ID NO: 3039 - DNA, 1353 bp, Unknown
  Bacillus sp. multi
ctgtctatcgccgtgaaggtgatgaagtaccaaatagtctgtccagtcaacatcgagtggaagacctttgagatatacctccgcacgctctcctaccacttccggacgattggcaaccgcacgatccagaagctatgggagtacgataaccattcgctgaaacactttaaggacaccgggcagtacccctccgcgcagcagctttacggctgcactcagaaaacaatcagtggctatatctatgaccagctcaaggaggagtaccaggacattaacaaggcgaacatgagtaccaccctccagaaaaccattcgcacctggaacagccgcaaaaaagagatttggagcggggagatgtcaatccccagtttccgtaacaacctgcccattgacattcacgggaactctatccagatcatcaaggagaaatcaggggactacatcgccagcgtttccttgttctcgtctaagttcattaaggagaacgaccttccaaacggcaagatacttgtgaagttgtccacaaggaagcaaaactctatgaaggtgatcctggacaggatcatcgacagtacctacgcaaaaggagcctgcatgttgcacaaacacaaaaagaagtggtacttgtccattacctacaagtcgaatatcaaggaggaattgaagttcgacgaagacctcattatgggcatcgacatgggaaagattaacgtcctctacttcgccttcaacaaggggctggtgcgcggagccatctcgggcgaggaaattgaggcgttccgcaagaaaatcgagcacaggcggatctccctcctgcgtcagggcaaatactgttctgggaaccgtatcgggaagggtcgtgagaagcggattaagcctattgatgttctaaacgataaggttgccaagttccgtaacgctaccaaccacaagtacgcgaactacatcgtccagcagtgccttaagtacaactgcggcaccatacagttggaggacttgaagggtatcagcaaggaacagaccttcctcaagaactggacttactttgacctacaggagaagatcaaaaaccaggccaatcagtacggcgttaaagtagttaagatcgacccatcctacaccagccagaggtgctcggagtgcgggtacatccacaagaacaaccggcaagaccagagcacattcgagtgccagcagtgcagcttcaaggtccacgccgactacaacgcagccaagaatatctccgtgtacaacatcgagaaggtgatccagaaacaacttgaactccaggagaaactaaaccagacgaagtacaaggagaagtacattgagcagatgaagaatatcaactag

SEQ ID NO: 3040 - DNA, 1332 bp, Unknown
  Bacillus sp. multi
atgaagtaccagatcgtgtgcccggtcaacatcgaatggaagaccttcgaaatctacctccgtaccttgtcctatcacttccgcaccattggaaaccggaccatccagaaattgtgggagtacgacaatcagagtcttaaacacttcaaagatacgggtcagtacccgtccgcgcagcagctctacggttgtacccagaaaacgatctccggctacatctacgaccagttgaaagaggagtaccaggatattaacaaagcgaatatgagcaccactcttcagaaaacgattcgtacttggaactcccgcaaaaaggaaatctggagtggcgagatgtctatcccctcgtttcgtaacaacttgcctattgacatccacgggaactctattcagatcatcaaggagaagtccggggactacatcgcgtcggtcagcttgttcagtagtaagttcattaaggagaacgacctccccaacgggaagatacttgtgaagttatctacgcggaagcagaactctatgaaggtcatcctcgaccggatcatcgactctacttacgcaaagggtgcgtgcatgttacacaagcacaagaagaagtggtatcttagcattacttacaaaagcaacatcaaggaggaattgaaattcgatgaagacctcattatgggaattgacatggggaagattaacgtcctttacttcgctttcaacaaggggctcgtgcggggcgcaatctcgggcgaggagattgaggcttttcgcaaaaaaatcgagcaccggcgcataagcctgctccggcaaggcaaatattgttctggcaaccggattggcaagggacgcgagaagcggattaagcccatcgacgtcctcaacgacaaagtagccaagttccgtaatgccacgaaccacaaatacgccaactacatcgtccagcaatgcttgaagtacaactgtggtactatccagcttgaggacttgaagggaatctctaaggagcagacgttccttaagaattggacatacttcgacctccaggagaagatcaaaaaccaggccaaccagtacggggtcaaggtggtgaagattgatccctcctacactagccagcggtgctcggagtgcggctacatccacaagaacaaccgccaggaccagagtaccttcgaatgccagcaatgctccttcaaagtccatgctgactacaacgccgctaagaacatctcggtgtacaacattgagaaggtgatccagaaacagctcgaattacaggagaagctgaaccagaccaagtacaaggagcagtatatcgagcagatgaagaatatcaactga

SEQ ID NO: 3041 - DNA, 1332 bp, Unknown
  Bacillus sp. multi
atgaagtaccagatagtgtgcccggtcaatatcgaatggaagactttcgaaatctacctcagaactctctcctaccactttagaactatcggaaaccgcactatccagaagttgtgggagtacgacaaccagtccctcaagcacttcaaggataccgggcagtacccatccgcgcagcaactctacggttgtacccagaagacaatctcaggctacatatacgaccagctcaaggaggaataccaggacatcaacaaggcgaacatgagcacaaccttacagaagacaatccgcacctggaactcccgcaagaaggaaatctggagcggcgagatgagcatcccctcattccggaacaacctccctatcgacattcacggaaacagcatacagatcatcaaggagaagtctggcgactacatcgcgtccgtgtccctattctctagtaagttcatcaaggagaacgatctgccgaacgggaagatcctggtgaagctctccactcgcaagcaaaacagtatgaaggttatcctagaccggatcattgactcgacatacgcgaaaggagcctgcatgttgcacaaacacaaaaagaaatggtatcttagcataacctacaaaagtaacatcaaggaggaattgaagttcgacgaagaccttatcatgggcatcgacatggggaagatcaacgttctctactttgctttcaacaaggggctcgtgcgaggggctatatctggcgaggagatcgaggcttttcgcaagaagattgagcaccgcagaatttcgctcctccgtcagggcaagtactgttctggaaaccggattgggaaagggcgcgagaagcggatcaagccaattgatgtcctgaacgacaaggtggcaaagttcagaaacgccaccaatcacaagtacgcgaactacatcgtccagcagtgccttaagtacaactgcgggacaatccagttggaggacttgaaagggattagcaaggagcagacctttctcaagaactggacctacttcgacctacaggagaagatcaaaaaccaggccaaccagtacggcgtgaaggtggtcaagatagacccttcctacacctcccagcgttgctccgagtgcgggtacatccacaagaataaccgacaagaccagtccaccttcgaatgccagcagtgcagtttcaaggtgcacgccgactacaacgccgccaagaacatcagcgtttacaacatcgagaaggtgatccagaagcagttggagctacaggagaaactcaaccagaccaagtacaaggagcagtacattgagcagatgaaaaatatcaactga

SEQ ID NO: 3042 - DNA, 1332 bp, Unknown
  Bacillus sp. multi
atgaagtaccagatcgtgtgcccggtgaacatcgagtggaagacgtttgagatatacctcagaacccttagttaccacttccgcaccatcgggaacaggaccattcagaaattgtgggagtacgataaccagagcctcaagcacttcaaggacaccggtcagtaccctagcgcccagcagctctacggctgcacccaaaaaaccatctccggctatatctatgaccagttaaaggaggagtaccaggacatcaacaaggccaatatgagtaccaccctccagaagaccatccggacgtggaactcgcgcaagaaggagatttggagcggggagatgtccatcccctccttccgcaacaacctcccgattgacattcacggcaattccatacagatcattaaggagaagtctggcgactacatcgcaagcgtgagcctattctccagcaaattcatcaaggagaacgacctccccaacgggaagatccttgtgaaactctcgactcggaagcaaaactccatgaaggtcatcctcgaccgcatcatcgactccacctacgcaaaaggagcctgcatgttacacaaacacaagaagaaatggtatctaagtatcacgtacaagagcaacattaaggaggagttgaagttcgatgaagacctcatcatgggcatcgacatgggcaagatcaacgtcttgtacttcgctttcaacaagggtcttgtccgtggtgctatcagcggtgaggaaattgaggcgttccgcaaaaaaatcgagcaccgacgcatcagcctcctgagacaaggaaagtattgctccgggaaccggatagggaaaggccgtgagaagcgcatcaagcctattgacgtgctgaacgacaaggttgccaaattccgcaacgcaactaaccacaagtacgccaactacatcgtgcagcagtgcctcaagtacaattgcggcaccatccagttggaggacttgaagggcatcagcaaggaacagacgttcctcaagaattggacctacttcgacttacaggaaaaaatcaagaatcaggccaaccagtatggcgtcaaagttgtcaagatcgacccatcctacacctctcagaggtgcagcgagtgcggctacatacacaaaaacaatcgacaggatcagagcaccttcgagtgccagcagtgcagcttcaaggtccacgccgattacaacgccgccaagaacatctccgtgtacaacatcgagaaggtgattcagaagcagttggagctacaggaaaagctaaatcagacgaagtacaaggaacagtacatcgaacagatgaaaaatatcaactga

SEQ ID NO: 3043 - DNA, 1332 bp, Unknown
  Bacillus sp. multi
atgaagtaccaaatcgtttgccccgtaaacatcgagtggaagaccttcgaaatctacctccgcaccctctcctaccacttcagaaccatagggaaccggacgatccagaagctctgggaatacgacaaccagtcccttaaacactttaaggataccgggcagtacccctccgcccagcagctatacggatgtactcaaaaaaccatctcaggctatatctatgaccaacttaaggaggagtaccaggacattaacaaggcgaatatgagcacaacgctccagaaaaccatccggacttggaactcccgcaagaaggagatttggagtggagaaatgtccattccatcctttcgcaacaacctgccaatcgacatccacgggaactccatccagatcatcaaggagaagtctggagactacattgcatcagtctctctgtttagcagcaagttcatcaaggagaatgacctacccaacggcaagattctcgtgaaattgtccacccgcaagcagaactccatgaaggtgatccttgaccgcataatcgactccacctacgcaaaaggtgcttgcatgttgcataagcacaagaaaaaatggtatcttagcatcacctacaaatccaacatcaaggaggagttgaaattcgatgaagacctgataatgggcatcgacatggggaagattaacgtgctgtacttcgccttcaacaagggtctggtgcgtggggccatcagcggtgaggaaatagaggcgttccgcaagaagattgagcacaggcgaatatccctcctccgacaaggcaagtactgttccgggaaccgaatcggcaagggccgggagaagcgtatcaagccgatagacgtcctgaacgataaggtggccaagttccgcaacgcgaccaaccacaagtatgctaactacatcgtgcagcagtgcctcaagtacaactgcggcactatacaattggaggatctcaagggcatctcaaaggagcagacattcctcaagaactggacctacttcgacctccaggagaagatcaaaaaccaggccaaccagtacggggtgaaggtggtgaagatcgacccaagctacacatcgcagcgatgcagcgagtgcgggtatatccacaagaacaatcgtcaggaccagtccactttcgagtgccagcagtgctcattcaaagttcacgccgactacaacgccgccaagaatatctctgtttacaacatcgagaaggtgatccagaagcaattggagttacaggagaagctgaatcagaccaagtacaaagagcagtacattgagcagatgaagaacatcaactga

SEQ ID NO: 3044 - DNA, 1332 bp, Unknown
  Bacillus sp. multi
atgaagtatcagatcgtgtgccccgtgaacattgagtggaagacctttgagatataccttcgcacgctctcgtatcacttccgcaccatcggcaacaggacaattcagaagctctgggagtacgacaaccagagcctcaagcacttcaaggataccgggcaatacccctccgcccagcaactctacggctgcacccagaagacgatctccgggtacatctacgatcaactcaaggaggaatatcaggacatcaacaaggccaatatgtcaactaccctccagaaaacaatccgaacctggaactcgcgcaaaaaggagatttggagcggggagatgtctatcccctcattccgcaacaacctccccatcgacatccacggcaatagcatccagatcattaaggagaagtcgggtgactacatcgccagcgtctcacttttcagctcgaagttcatcaaggagaacgacctgccgaacggaaagatccttgtgaaactcagcactaggaagcagaactccatgaaggttatcttggacaggatcatcgactccacctacgcaaagggagcttgcatgttgcacaaacacaagaagaaatggtacttatctatcacctacaagtccaacattaaggaggagcttaagttcgacgaagacctgataatggggatcgacatgggcaagattaacgtcctctactttgctttcaacaagggactcgtacgtggagcaatctccggggaggaaatcgaggctttccgcaagaagattgagcaccgacgtatctccctcctccgacaagggaaatattgcagcggcaatcgcatcggcaaggggcgtgagaagcggatcaagccgatagacgtcctcaatgacaaagttgcgaagttccgcaacgccactaaccacaagtacgctaactacatcgtccagcagtgcctcaagtacaactgcggtacaattcagttggaggacttgaaaggaatatcgaaggagcaaactttcctcaagaactggacgtacttcgacctccaggagaagatcaaaaaccaggcgaaccagtatggagtgaaggtggtcaagattgacccgagttacacctcccagagatgctccgagtgcggttacattcacaagaataaccgtcaagatcaatcgaccttcgagtgccagcagtgcagcttcaaagtccatgcagactacaacgcggccaagaatatctccgtgtacaacatcgaaaaggtgatacagaagcagcttgagctacaggagaagctgaaccagacaaagtacaaggagcagtacatcgagcagatgaagaatatcaactga

SEQ ID NO: 3045 - DNA, 1353 bp, Unknown
  Bacillus sp. multi
ttgagtctggcagtcaaagttatgaagtaccagatcgtgtgcccagtcaacgtcgagtggaaggtcttcgaaacatacctccgcaccctctcctaccaatcacgtaccatcggaaaccgcaccatacagaaaatctgggagttcgacaacctctccctaaagcacttcaaggagaccggcgagtacccctcggcgcagcagttgtacggctgcacacagaagaccatctcaggctacatctacgaccagctcaaagaggagtacaaagacatcaacaaggcgaacatgagcaccaccattcagaagaccctcaagaactggaactcacgcaagaaggagatttggaggggcgagatgtccatcccttccttccgctccgaccttcctatcgacatccacggcaactcgattcaactcattaaggagaagggaggagactacatcgcaagcgtgtcgttgttctcctctaagttcattaaggagaatgacctccctaacggcaagattctggttaagctgagcacccgcaagcagaacagcatgaaggtgatcttggaccgtctgataaactctacttacagtaagggtgcctgcatgttgcacaagcacaagaagaaatggtacttgagtatcacgtacaagtccaacatcaaggaggagttgaaattcgatgaagacttgataatgggaattgacatgggaaagattaacgtgctttacttcgctttcaacaagagtctggttcgtggggcaatctcgggcgaggagattgaggcgttccgcaaaaaaatcgagcaccgccgcatcagtctgcttagacagggcaagtactgctctgggaacaggatcgggaagggccgggaaaagcggatcaagccgattgacgtacttaatgacaaggtggccaagttcagaaacgccaccaaccacaagtacgccaactacatcgtacagcagtgcctcaagtacaactgcggcaccattcagcttgaggacttgaagggaatttcgaaggagcagacattcctcaagaattggacgtacttcgacctccaggagaagatcaaaaaccaggcaaaccagtacggcgtcaaggtggttaagattgacccatcctacacctctcagcggtgctcggagtgcggctacatccacaaggacaaccgccaggaccagagcacattcgagtgcttgcagtgctcattcaaggtgcacgcagactacaacgccgccaagaatatctctgtgtacaatatcgagaaggtcatccagaagcagctagaactccaggagaaactgaacctgaccaagtacaaggaacactatatcgaacagatgaagaacataaactga

SEQ ID NO: 3046 - DNA, 1353 bp, Unknown
  Bacillus sp. multi
ctctcgttggctgtgaaggtgatgaagtaccaaatcgtttgccccgtgaacgtcgagtggaaggtcttcgagacttacctgaggacgctctcctaccagtcccggaccattgggaaccgtactatccagaaaatctgggagtttgacaacctgtccctcaagcacttcaaggagaccggagagtacccttccgcccagcagctctacgggtgtacccaaaaaaccatctccggctatatctacgaccaactcaaggaggagtacaaggacatcaacaaagccaatatgagtacgaccattcagaaaactctcaagaattggaacagtcgcaagaaggagatttggcgtggagagatgtcgattcccagctttcgctccgacctgccgatagacatccacggcaactccattcaacttatcaaggaaaagggtggcgactacatcgcctcagtctccctctttagtagtaagttcatcaaggagaacgacctgcccaacggcaagattctcgtgaaactgtccacgaggaagcagaacagcatgaaggtgatccttgacaggcttatcaactcaacatacagcaagggtgcgtgcatgttacacaagcacaagaagaagtggtacttgagcatcacttacaagtccaacatcaaggaggagttgaaattcgacgaggacttaatcatggggatcgacatggggaagattaacgttctgtacttcgccttcaacaagtcattggtgcgaggggctatatctggggaggagatcgaagcctttcgcaaaaaaatcgagcacagacggatctcattactgaggcaaggaaagtattgctcaggcaatcgcattggcaagggaagggagaagcgcatcaagccaattgatgtacttaacgacaaagtagccaagttccggaatgcgacaaatcacaagtacgcaaactacattgtgcagcagtgcctcaagtacaactgcggaactattcagcttgaggacttaaaggggatctcgaaagagcagacattcctcaagaactggacgtacttcgacctccaggagaagatcaaaaaccaggccaaccagtacggcgtcaaggtggtgaagattgaccctagctacactagccagcgttgctccgagtgcgggtacatccacaaggacaaccgacaggaccagtccaccttcgagtgcttgcagtgttcattcaaggtccacgccgactacaacgcagccaagaacatcagcgtgtacaacatcgagaaggtgatccagaagcagttagagttacaggagaagctcaacctgaccaagtacaaggagcactatatcgagcagatgaagaatatcaactag

SEQ ID NO: 3047 - DNA, 1353 bp, Unknown
  Bacillus sp. multi
ctttccctcgccgtaaaggtgatgaagtaccagatagtctgcccggtgaacgtggagtggaaggtgttcgaaacctacctcaggacactctcctaccagagtcgcacgatagggaaccgcaccatccagaagatatgggagttcgacaacctcagcctcaagcacttcaaggagaccggggagtaccccagcgcccagcagctctacggctgcacccagaaaaccatcagcgggtatatctatgaccagctcaaggaggagtacaaggacatcaacaaagcgaacatgagcaccaccatccagaaaactctcaagaattggaactcccgcaagaaagagatatggaggggcgaaatgagcatcccgtccttccgatccgacctccccattgacatccacggcaactctattcagcttattaaggaaaagggtggtgactacatcgcttccgtcagcttgttctcctcgaagttcattaaggagaacgacctccccaacggcaagatactggtcaagttgtccacgcgaaagcagaactccatgaaggtcatattggataggcttatcaactctacctactcgaagggcgcgtgcatgttgcataagcacaagaagaaatggtatttgagcatcacgtacaagagtaacatcaaggaggagttgaaattcgacgaagacctcattatgggaatcgacatggggaagatcaacgtcctttacttcgctttcaataagagcttggtgaggggagctatatccggggaggaaattgaggcgtttcgcaagaagatcgagcacaggcgcatcagcctgctacgacaagggaaatattgcagcggcaatcgtatcggcaagggccgtgagaagcgcattaagcccattgacgtgctgaacgacaaggtggccaaattccgcaatgcgaccaaccacaagtacgccaactacatcgtgcaacagtgccttaagtacaattgcggcaccattcaacttgaagacctaaagggtatcagcaaagagcagaccttccttaagaactggacctacttcgacttacaggaaaaaatcaagaaccaggccaaccagtatggagtgaaggtggtgaagattgatccatcctacacaagccaaaggtgctcagagtgcgggtacatacacaaggacaacagacaagatcagtcaacgttcgagtgcttacagtgctccttcaaggtgcacgcagactacaatgccgccaagaatatctccgtttacaacatcgagaaggtcattcagaagcagttagaactccaggaaaagctgaaccttaccaagtacaaggagcattacatcgagcagatgaaaaatatcaactga

SEQ ID NO: 3048 - DNA, 1353 bp, Unknown
  Bacillus sp. multi
ttgtcgctcgccgtgaaggtgatgaagtaccagatcgtgtgcccagtgaacgtggagtggaaggtgttcgagacctacctcagaactctttcctaccaaagccgcaccatcggcaacaggaccatccagaagatatgggagttcgacaacctctccttaaaacacttcaaggagaccggcgagtatccgtccgcccagcagttgtacgggtgcacacagaagacgatcagcggctacatctacgaccagctcaaggaggagtacaaggacattaacaaagccaatatgagcaccaccattcagaaaactctcaagaattggaactctcgcaagaaggagatttggcgtggcgagatgagcatacccagcttccgcagcgacctgcccatcgacatccacgggaacagcatccagctcatcaaggagaagggtggtgactacatcgcctcagtgtcgctgttctcctccaaattcattaaggagaacgatcttcccaacgggaagattctggttaagctgtccactcggaaacaaaacagcatgaaggtgatcctcgaccgtcttatcaactcgacttactctaaaggggcttgcatgttgcacaagcacaagaaaaaatggtacttgagtatcacgtacaaatccaacatcaaggaggaactgaaattcgacgaggacttgataatgggcatcgacatggggaagataaacgtgctttacttcgccttcaacaagtcattggtcagaggggcaataagtggcgaggaaatcgaagccttccgcaagaagattgagcatcggcgcatctcactactccgacaggggaagtattgttcggggaaccgaatcggcaaggggcgtgagaaacggattaagcctatcgacgtgctcaatgacaaggtggcaaagttccgtaacgcgacaaaccacaagtatgctaactacatcgttcagcagtgcctcaagtacaattgtgggaccatacaacttgaagacctcaaagggatcagtaaggagcagaccttcctcaagaactggacctacttcgacttacaggagaagatcaaaaaccaggccaaccagtatggagttaaggtggtgaagattgacccctcctacacttcgcagcggtgttcggagtgcggctacatccacaaagacaaccgccaggaccaaagtacgttcgagtgcctccagtgctcgttcaaggtgcacgcggactacaacgctgctaagaacatctccgtgtacaacatcgaaaaggtcatccagaagcagttggagttacaggagaaattgaacctcactaagtacaaggagcattacattgagcagatgaaaaatatcaattga

SEQ ID NO: 3049 - DNA, 1353 bp, Unknown
  Bacillus sp. multi
ctcagcctcgctgtcaaggtgatgaagtaccaaatcgtgtgtcccgtaaacgtcgaatggaaggttttcgagacctatctcagaactctgtcctaccagtcccgaaccattgggaaccgcacaatccagaagatatgggagttcgataacctttcgttgaagcacttcaaggagacaggcgagtacccgtccgcgcagcagctctacggctgcacccagaagacaatctctggctacatctacgaccagttgaaggaggagtacaaggacatcaacaaggcaaacatgagtacaacaattcagaagacgcttaagaactggaacagccgcaaaaaggagatatggcgcggggagatgtctattccgagcttccgcagcgacctacccattgacattcacggaaacagcattcagctcatcaaggagaagggtggagactacatcgcctcggtcagcctctttagttccaaattcatcaaggaaaatgaccttccgaacggcaagattcttgtgaagctgtccaccaggaagcagaactctatgaaggttattcttgaccgtctcatcaactctacctacagcaagggtgcctgcatgttgcacaagcacaaaaagaagtggtatctgagcataacctacaagtcaaacattaaggaggagttgaaattcgacgaagacctaatcatgggcattgacatggggaagataaacgtgctgtacttcgctttcaacaagtctctggtgcgtggggcgatcagtggggaggagattgaggctttccgcaagaaaatcgagcaccgtcgtatttccctacttcgacagggcaagtattgctctggcaaccgcattgggaaaggtcgggagaagcgcatcaagcccatcgacgtgcttaacgacaaggtggccaaattcagaaatgccaccaaccacaagtacgcaaattacatcgtgcagcaatgcctcaagtacaactgcgggactatacaattggaagacctaaaggggatcagcaaggagcagaccttcctcaagaactggacctatttcgatctccaggaaaaaatcaagaaccaggcgaaccagtacggagtgaaggtggttaagatcgaccctagctacacctcccaacgatgcagcgagtgcggctacatccacaaggacaaccgccaggaccaatccaccttcgagtgcctccaatgctctttcaaggtgcacgccgactacaacgccgccaagaacatctctgtttacaatatcgagaaggtcatccagaagcagcttgagctacaggagaagctcaacctcacaaagtacaaggagcactacattgagcagatgaaaaatatcaattga

SEQ ID NO: 3050 - DNA, 1353 bp, Unknown
  Bacillus sp. multi
ctgagtattgccgtcaaagtcatgaagtaccaaatagtatgcccggtgaacatcgagtggaagacgttcgaaatctacctccgaaccctcagctaccacttccgtaccatcggcaatcggacaatccagaagctatgggagtacgacaaccagtctttgaagcacttcaaggacacgggccagtacccctcggcgcagcaactctacggctgcactcagaagactatctccggttacatctacgaccagctcaaggaggagtaccaggacatcaacaaggccaacatgagcacaacgctccagaagaccatcaagacctggaactcccgcaaaaaggagatatggagtggcgagatgtctattccatccttccgcaacaaccttcctattgatattcatgggaactccattcagatcattaaggagaagtctggcgattacattgcgtcggtgtccctgttcagctcaaagttcattaaggagaacgaccttcctaacggcaaaatccttgtcaaactttctactcggaaacagaactcgatgaaggtgatcctcgaccgtatcatcgactcaacctacgctaaaggggcctgcatgttgcacaaacacaagaaaaaatggtacttgagtatcacatacaagtcgaacatcaaggaggagttgaaattcgacgaagacttaatcatgggcatcgacatggggaagatcaacgtgctttacttcgcgttcaacaaagggctcgtcagaggcgcaatcagcggcgaggagatcgaggcgttccgcaagaagatcgagcaccggcgtatctccctactgagacaagggaagtactgttccggcaacaggatcggcaaggggcgcaagaaacgtattaagccgattgaagttctaaacgacaaaatcgccaaattccgcaacgccactaaccacaagtacgcaaactacattgtgcagcagtgcttgaagtacaactgcggcaccattcaattggaagacctccaggggataagtaaggagcagacgttcctcaagaattggacctacttcgacctacaggagaagatcaaaaaccttgcaaaccagtacgggattaaggtcgtgaagatcgacccgagttacacctcccagcggtgctcggaatgcggctacatccacaagaacaaccgccagaatcagagcaccttcgagtgccagcagtgcagtttcaaggtgcacgccgactacaacgccgccaagaacatctctgtgtacaatatcgagaaggtgatccagaagcaattgaaactccaggagaagctaaacctgaccaagtacaaggagcagtacattgagcagatggagaatatcaactag

SEQ ID NO: 3051 - DNA, 1353 bp, Unknown
  Bacillus sp. multi
ctcagcatcgccgtgaaagttatgaagtaccagatcgtgtgccctgtgaacatcgagtggaagaccttcgaaatctaccttagaaccctgtcgtaccacttccggaccatcggcaaccgcacgatccagaagctgtgggagtacgacaatcagtcactcaaacacttcaaagacactgggcagtacccctccgctcagcagctctacggttgcactcaaaaaaccatcagcgggtacatatacgaccaactcaaagaggagtaccaggacattaacaaggccaatatgagcactacccttcagaaaacgatcaagacctggaacagtcgcaagaaagagatatggagtggagagatgtccatcccctcattccggaacaacctacccatcgacatacacggcaacagcattcagatcatcaaggagaaatcgggcgactacatcgcttccgtgtccctgttctcctcgaagttcatcaaggagaacgacctgcctaacgggaagattctagtgaagttgtccaccaggaagcagaactctatgaaggtgattctcgacaggatcatcgactccacgtatgcgaagggtgcctgcatgttacacaaacacaagaaaaagtggtacttgagcattacctacaagagcaacatcaaggaggagctaaagttcgatgaagacctcattatggggatagacatgggcaagatcaacgtgctgtacttcgccttcaacaagggtcttgtgaggggtgccattagcggcgaggaaatcgaagcctttcgcaagaagatcgagcacaggcggataagcctactacggcaaggaaagtattgctccgggaaccgcatcgggaagggacgcaagaagcgcatcaagcccattgaagttctcaacgacaagatcgccaaattccggaacgctacaaaccacaagtacgccaactacatcgtgcagcagtgcctcaagtacaattgcggcacgatccagttggaagacctgcaaggaatatcgaaggagcagactttcctcaagaactggacctacttcgacctacaggagaagatcaaaaacctcgcaaaccagtacggtattaaggtggtcaagatcgacccctcatacacctcacagcgatgcagcgagtgcggctatatccacaagaacaatcgccagaaccagtccactttcgagtgccagcaatgctcattcaaggttcacgcagactacaacgcagccaagaacatctcggtgtacaacatcgagaaggtgatccagaagcagctcaaactacaggaaaagctcaacctgactaagtacaaggagcagtacatcgaacagatggagaatatcaattga

SEQ ID NO: 3052 - DNA, 1353 bp, Unknown
  Bacillus sp. multi
ttgtccatcgcggtgaaggtgatgaagtaccagatcgtgtgccctgtgaacattgagtggaagactttcgagatatacctccgcacgctctcctaccactttagaaccatcgggaaccgtaccatccagaagctctgggaatacgataaccagtccctcaagcacttcaaggataccggccagtaccctagtgcccagcagctctacggctgcacgcagaaaacgataagcggctacatctacgaccagctcaaggaggagtaccaagacatcaacaaggcaaacatgagcaccaccttgcagaagactatcaagacctggaactcccgcaaaaaagagatctggagtggagagatgagcattccgtcgttccgcaacaacctccctatagacatccacggcaactccatacagatcatcaaggagaaatctggcgactacatcgcatccgtgtcccttttcagtagcaaattcatcaaggaaaacgacctgccaaacgggaaaatccttgtgaaattgtccacccgtaagcagaacagcatgaaggtgatcctcgacagaatcattgacagcacctacgcgaagggtgcgtgcatgttgcacaagcacaagaagaagtggtacttgagcatcacctacaagagcaacatcaaggaggagttgaagttcgacgaagacttaatcatgggcatcgacatgggcaagatcaacgttctgtacttcgcattcaataaggggcttgttcgaggcgcaatcagcggggaggagatcgaggctttccgcaaaaaaatcgagcatcggcgaatatctctgctgagacaagggaagtattgcagtggaaaccgaattggcaagggccgcaaaaagcgtatcaagcccatcgaggtgttgaatgacaagatcgccaaattccgtaatgcgacgaaccacaagtacgccaattacatcgttcagcagtgcttgaagtacaattgcgggacgattcagcttgaggacttacaggggattagcaaggagcagacctttctcaagaattggacctacttcgacctacaggaaaaaatcaagaacctagccaaccagtacggcatcaaggtggtcaagatcgacccctcatacacatctcagcggtgctccgagtgcggctacatccacaagaacaaccgccagaaccagtcaacgttcgagtgccagcagtgcagcttcaaggtgcacgctgactacaacgccgccaagaacatcagcgtttacaacatcgagaaggtgatccaaaagcaactgaaattacaggagaagctgaacctcacgaagtacaaggagcagtacatcgagcagatggagaacatcaactga

SEQ ID NO: 3053 - DNA, 1353 bp, Unknown
  Bacillus sp. multi
ctctctatcgcggtgaaggtgatgaagtaccagatcgtgtgtcctgtgaacatcgagtggaagaccttcgaaatctacctcaggacgctaagttaccacttccgcacaatcggcaatcgcacaatccaaaagctctgggagtacgacaaccagtccctcaagcacttcaaggacactgggcaatacccttccgcacaacagctctacggttgcacgcagaagacgatctccggctacatctacgaccaactcaaggaggaataccaggacatcaacaaggccaatatgtccacaacattgcagaagactatcaagacatggaactcccgcaagaaggaaatctggagcggagagatgtccatcccctccttccgcaacaaccttcccatcgacatccacggaaactcgatacagatcatcaaggagaagtctggggactacattgcatcagtatcgttgttcagtagcaaattcatcaaggaaaacgacctccccaacggcaagattctcgtgaagttgtccacccgcaagcagaacagcatgaaggtcatccttgaccggataatcgactccacctacgctaaaggagcctgcatgttgcacaagcacaaaaagaaatggtatctctctattacttacaagtcgaacatcaaggaggagttgaaattcgacgaagacctgataatgggcattgacatgggaaagatcaacgtcctgtacttcgcgttcaacaagggactcgtgcgaggtgccataagcggggaggaaatcgaggcttttcgcaagaaaatcgagcacaggcgcataagtctccttcgccaggggaagtattgttccgggaacagaatcgggaaggggcgcaagaaacgcatcaagccaatcgaagtccttaacgacaagatcgccaaattccgcaacgccacaaatcacaagtacgcgaattacatcgtgcagcagtgcctaaagtacaactgcggaacgattcagctagaggatctgcaaggaatttcaaaggagcagaccttcctcaagaactggacctacttcgatctacaggaaaaaatcaagaacctggccaaccagtacggtatcaaggtggtcaagattgacccgagttacacgagccagcgttgctccgagtgcggctacatccacaaaaacaatcgccagaaccagagtacattcgagtgccagcagtgcagcttcaaggtccacgccgactacaatgcggctaagaacatatccgtttacaatatcgaaaaggtgattcagaaacagctcaaactacaggagaagctcaacctcaccaagtacaaggaacagtatatcgagcaaatggagaacatcaactga

SEQ ID NO: 3054 - DNA, 1353 bp, Unknown
  Bacillus sp. multi
ctttccatcgcagtgaaggtcatgaagtaccaaatcgtctgcccggtgaacatcgagtggaagaccttcgagatatacctccgaacgttgtcctatcactttcgaaccatagggaatcgcacaattcagaagctctgggagtacgacaaccagtccctcaagcactttaaggacacgggacagtacccttctgcccagcagctttacggatgcacccagaagaccatctccggctatatctatgaccagctcaaggaggagtaccaggacatcaacaaggccaacatgagcaccactctccaaaaaaccatcaagacttggaactcccgcaagaaagagatatggagtggcgagatgtccatcccttccttccgcaacaaccttcctattgacatccacggcaattctatccagatcatcaaggagaagtctggggactacatcgcctcagtgtccctctttagttctaagttcatcaaggagaacgacctccccaacgggaagatcctcgttaagctcagcacccggaagcagaactctatgaaggtgatcttggaccggattatcgactccacgtacgcaaagggagcgtgcatgttacacaagcacaagaaaaagtggtatcttagcattacctacaagtccaatatcaaggaggagcttaagttcgacgaagaccttatcatggggatagacatgggcaagataaacgtcctctactttgccttcaacaagggtctggtccgaggcgcgatctctggggaggaaattgaagcgtttcgcaagaagatcgagcaccgccgtatttccctcctaagacagggcaaatattgttccggcaatcgcatcggaaaagggcgcaaaaaacgcatcaagcctatcgaggtgctgaacgacaagatcgccaagttccgcaacgctacaaaccacaagtacgcgaactacatcgtgcagcagtgtttaaagtacaactgcgggacgattcaattggaagacctacaggggatctccaaagagcagacgttcctcaagaactggacctactttgacctacaggaaaaaatcaagaatctggccaaccagtacggcatcaaggtcgtcaagattgaccccagttacaccagccagaggtgttcagagtgtggctacatacacaagaacaaccgccaaaatcagagtaccttcgagtgccagcagtgcagcttcaaggttcacgccgactacaacgccgccaagaacatcagtgtgtacaacatcgagaaggtgatacagaagcaattgaaactccaggagaaactgaacctcaccaagtacaaggagcagtacatcgagcagatggagaacatcaactga

SEQ ID NO: 3055 - DNA, 1353 bp, Bacillus thuringiensis
ctctccatcgccgtcaaggtgatgaagtaccagatcgtctgccccgtgaacatcgaatggaagacgttcgaaatctacttaagaaccctgagttatcacttccgcaccatcggcaatcggacgatacagaagctctgggagtacgacaaccagtccctcaagcacttcaaggacaccggtcagtacccaagcgctcagcaactctacggttgcacgcagaaaaccatcagtggctacatctacgaccaacttaaggaggaataccaagacatcaacaaggccaatatgagcactaccctccagaaaacgatcaggacgtggaacagccgcaagaaggagatttggagcggggagatgtccattccctccttccgtaacaacctccccattgacattcacggaaattctatccagatcatcaaggagaagtccggcgactatatcgcttccgtgagccttttcagttccaagttcattaaggagaacgacctgccaaacggcaaaatcctcgtcaagctctccactcggaagcagaacagcatgaaggtgatactcgacagaatcatcgactcgacctatgctaagggtgcctgcatgttgcacaagcacaagaaaaaatggtacttatccatcacttacaagagtaacatcaaggaggagttgaagttcgacgaagacctgattatgggcatcgacatggggaagattaacgtgctatacttcgctttcaacaagggccttgtgcgaggagctatcagcggggaggaaatcgaggcttttcgcaagaagattgagcacagacgcatctccctgctcagacaggggaagtactgctctggaaaccgcatcgggaaagggagggagaagcggatcaagcccattgacgtcctcaacgacaaagttgccaaattccgcaatgccaccaaccacaagtacgctaactatatcgtccagcagtgcttgaagtacaactgcggcacaattcagcttgaggacttgaaaggaatctctaaggagcagacattcctcaagaactggacctacttcgacctacaggagaagatcaaaaaccaggctaatcagtacggtatgaaggttgtgaagattgacccatcctacaccagtcagcggtgctcggagtgcggctacattcacaagaacaacagacaagaccagtcaacgttcgagtgccagcagtgctccttcaaggtccacgcggactacaacgcggccaagaacattagcgtgtacaacatcgagaaggtgattcagaagcagttggaactccaggagaagctcaatcagacaaagtacaaagagcagtatatcgagcagatgaaaaatatcaactga

SEQ ID NO: 3056 - DNA, 1353 bp, Bacillus thuringiensis
ctcagtattgctgtgaaggttatgaagtaccagatcgtgtgcccggtcaacattgagtggaagactttcgaaatctaccttagaaccctctcgtaccactttcgcacaatcgggaaccggacgatccagaagttgtgggagtacgacaaccagagcctcaagcactttaaagatacggggcagtacccgtccgcccagcagctttatggctgcactcaaaaaacaatctctggctacatctacgaccagttgaaggaggagtaccaggatattaacaaggcgaacatgagcactacacttcaaaaaactatccgtacttggaacagccgcaagaaagagatatggagtggtgagatgagcataccatccttccgcaacaacttgccaatagacatacacggcaacagcatccagattatcaaggagaaatccggcgactacattgccagcgtctccttgttcagcagcaaattcatcaaggaaaacgacctccccaacgggaagatcctggtgaagttatccactcgaaagcagaactctatgaaggtcatcctcgaccggatcattgacagcacctacgcaaagggtgcgtgcatgttgcacaagcacaagaagaagtggtacttgagtatcacgtacaagagcaacatcaaggaggaattgaaattcgacgaagacttaatcatggggattgacatgggaaagataaacgtgctatacttcgccttcaacaaggggctcgtcaggggcgctatcagcggggaggaaatcgaggctttccgcaaaaaaatcgagcacaggagaatatctctgctacgtcagggcaaatattgttccgggaaccgtattggcaaaggtcgggagaagcggattaagccgattgacgtcctcaatgacaaggtggccaaattcagaaacgccaccaaccacaagtacgcaaactacattgttcagcagtgccttaagtacaactgcggcaccatccagcttgaagacttgaaggggatcagcaaagagcagactttccttaagaactggacctacttcgacctccaggagaagatcaaaaaccaggcaaaccagtatgggatgaaggttgtgaagatcgacccgtcctacacatctcagcgatgctccgagtgcgggtacatccacaagaacaaccgtcaggaccagagcaccttcgagtgccagcagtgctccttcaaagtgcacgccgactacaacgccgccaagaacatcagcgtgtacaacattgagaaggtcatccagaagcaactggagctacaggagaaactcaatcagaccaagtacaaggaacagtacattgagcagatgaagaacattaactga

SEQ ID NO: 3057 - DNA, 1353 bp, Bacillus thuringiensis
ttaagtatcgcggtgaaggtgatgaagtaccaaatcgtctgtcccgtgaacatcgagtggaaaacattcgaaatctacctgcggacactcagctaccacttccggaccatcggcaacagaaccatccagaagttgtgggagtacgacaaccagagcctcaagcacttcaaggacacaggccaatacccctccgcccagcagctttacggttgtactcagaagaccatcagcggctatatctacgaccagcttaaggaggagtaccaggacatcaacaaggcgaacatgagcactaccctccagaaaactatccgcacatggaactcccgcaaaaaggaaatctggagtggggagatgagcattccctcctttcgcaacaaccttccgatagacatccacggcaatagcattcagatcatcaaggagaagtcaggggactacatcgcctccgtcagtctgttcagctcgaagttcatcaaggaaaacgacctgcccaacgggaagatcctggtcaagttgtcaacccggaaacagaactctatgaaggtgatattggaccgcattatcgactccacgtacgcgaagggcgcgtgcatgttacacaagcacaagaagaagtggtacttgagtatcacttacaagtcaaacattaaggaggagttgaaattcgacgaagacctcataatgggaatcgacatgggcaagatcaatgtgctgtacttcgcattcaacaagggccttgtccgtggggctatctcgggtgaggagatcgaggcttttcgcaaaaagatcgagcaccgccgtatatcgctgctgagacaggggaagtactgctccgggaacagaatcgggaagggccgggagaaacggattaagccgattgatgtgctgaacgacaaggtggctaagttcagaaacgcgaccaaccacaagtacgcgaactacatcgtgcagcagtgcttaaagtacaattgcgggactatccagttggaagacctgaaagggatcagcaaggagcagaccttcctcaagaactggacctacttcgacctccaggaaaaaatcaagaaccaggccaaccagtacggcatgaaggtcgtgaagattgacccatcctatacctctcagcgctgttcagagtgcggttacatccataagaacaacaggcaagaccagtccactttcgagtgccaacagtgctcgttcaaggtgcacgccgactacaatgccgccaagaatatctcagtttacaacatcgagaaggtgatacagaagcaactagaactacaggagaagctcaaccagacgaagtacaaagagcagtacatcgaacagatgaaaaacatcaactaa

SEQ ID NO: 3058 - DNA, 1353 bp, Bacillus thuringiensis
ctctcgatagcagtgaaggtgatgaagtaccagatagtgtgtcccgtcaacatcgagtggaagaccttcgagatatacctacgcactttgagttaccacttcagaaccattgggaaccggaccatccagaagctgtgggagtacgacaaccagtcattgaaacacttcaaggatacgggccagtaccccagcgcccagcagttgtacggctgcacgcagaagacaatctcagggtacatctacgaccagttgaaggaggagtaccaggacattaacaaggccaatatgagcacaaccctccagaaaactatccgcacatggaactcccgcaagaaggaaatctggagtggggaaatgtcgatcccgtccttccgtaacaaccttcccatcgacatccacggaaatagcatccagattatcaaggagaagtcgggcgactacattgcttctgtctccttgttcagtagcaagttcatcaaggagaacgaccttcccaatgggaagatactggtgaaattgtcaacccgaaaacagaacagtatgaaggtcatcttggaccggatcattgacagtacctacgctaaaggagcttgcatgttgcacaagcacaaaaaaaaatggtatctgtcgattacctacaagtccaacatcaaggaggagcttaagttcgacgaagacctgattatgggcatcgacatgggcaagattaacgtcctatacttcgcgttcaataagggcttggtccgaggcgctatatcaggggaggagatcgaggctttccgcaagaagattgagcatcggaggatctccctgctgcgtcagggcaagtactgttccgggaaccgcatcggaaaaggccgcgagaagcgcatcaagccaatcgacgtgctcaacgataaggttgctaagttccgaaacgctaccaatcacaagtacgcaaactacatcgtgcagcagtgtctaaagtacaactgcggcacaatccagttggaggacttgaaaggaatctcgaaagagcagacattccttaagaactggacatacttcgacctccaggagaagatcaaaaaccaggccaaccagtacggcatgaaggtggtgaaaatcgacccctcatacacttctcagcggtgcagcgagtgcggctacatccacaagaacaaccgccaggaccagtcaaccttcgagtgccagcagtgctcgttcaaggtgcacgctgactacaacgctgctaagaacatatccgtgtacaacatcgagaaggtcattcagaagcagttggagctacaggagaagctgaaccagaccaagtacaaagagcagtacatcgagcagatgaaaaacatcaattga

SEQ ID NO: 3059 - DNA, 1353 bp, Bacillus thuringiensis
ctgagcatagctgtgaaagtgatgaagtaccaaatcgtgtgccccgtgaacatcgagtggaaaaccttcgagatatacctgagaaccctatcttaccacttccgtacaatcgggaaccgaacaatccagaagctctgggagtacgacaaccagtcccttaaacacttcaaggataccgggcagtatccctcggctcagcagctctacggatgtactcagaagacaatcagcggctatatctacgatcagcttaaggaggaataccaggacattaacaaggccaatatgagcacgactctccagaaaactatcagaacatggaactcccgcaaaaaagagatatggagcggggagatgagcatcccgtcattccgcaacaacctgcccatcgacatacacgggaatagcatccagatcatcaaggaaaagtccggcgactacatcgcgtctgtctccctattctccagcaagttcattaaggagaacgacttgcccaacgggaagattctcgtcaagctgagtacgaggaagcagaacagcatgaaggtcatcctggacaggatcatcgacagcacctacgctaaaggagcctgcatgttacataagcacaaaaagaaatggtatcttagcattacttacaagtcaaacatcaaggaggaattgaagttcgacgaagacctcattatgggcatcgacatggggaagatcaacgtcctgtacttcgcgttcaacaagggcttggtccgaggtgcaatctccggcgaggaaattgaagcgttccgcaagaaaatcgagcacaggcgtatttcgctgctcagacagggcaagtactgttccgggaaccgtatcgggaaaggacgcgagaagcggatcaagcctatagacgtcctgaacgataaggttgccaaattcagaaacgccaccaaccacaagtacgccaactatatcgtccagcaatgcttgaagtacaactgcgggacgattcaacttgaagatttgaaggggatctcgaaggagcagaccttccttaagaactggacgtacttcgacctccaggaaaaaatcaagaatcaggccaatcagtacgggatgaaggtggtcaagatcgaccctagctacacctcacagaggtgctctgagtgcggctacatacacaagaacaaccgccaggaccagagcacgttcgaatgccaacagtgcagcttcaaggtgcacgcagactacaacgccgccaagaacatctcggtgtacaacatcgaaaaggtcatccagaagcagcttgaactacaggagaagctcaaccagacgaagtacaaagagcagtacattgagcagatgaagaacattaactga

SEQ ID NO: 3060 - DNA, 1353 bp, Unknown
  Bacillus sp. multi
ctgtccatcgcggtcaaggttatgaagtaccagatagtctgcccggtgaacatcgaatggaaaactttcgagatatacctgcgaacactttcctatcacttccgtacaattggcaacaggacgatccagaaactgtgggagtacgacaaccagtcgctcaaacacttcaaagataccggccaatacccgtccgcgcagcagctctacggctgcacacagaaaacgatcagcggctatatctatgaccaactcaaggaggagtaccaggacatcaacaaggccaatatgtccacaacgctccagaaaacgatcagaacttggaacagtcgcaaaaaggagatttggagtggagagatgagtattccctccttccgaaacaacctccccattgacatacacgggaactctatccagatcatcaaggagaagtccggcgactacatcgcctccgtttcgctgttcagctcaaagttcattaaggagaacgaccttccaaacgggaaaatcctggtgaagctgtcaacgcgcaagcaaaacagtatgaaggtcatcctggaccggataatcgactcgacgtacgctaaaggggcttgcatgttacataagcacaagaagaaatggtatctctctatcacctacaagagcaacattaaggaggagctaaagttcgacgaggacttgataatgggcattgatatggggaagatcaacgtcttgtactttgctttcaacaagggcctcgtcaggggagcaatcagcggggaggagatcgaggcgtttcgcaaaaagatcgagcaccgtcgcatctcactgctccgccaggggaagtactgtagcggcaaccggatagggaagggacgcgagaagcgtatcaagccaatagacgtgctgaacgacaaggtggctaagttccggaatgcaacaaaccataagtatgcgaactatatcgtacagcagtgtctcaagtacaactgcggcactatccagcttgaagacttgaagggtatcagcaaggagcagaccttcctcaagaactggacctacttcgacctccaggagaagatcaaaaaccaggcgaaccagtacggggtgaaagtcgtcaagattgatccttcctacacctcccagcgatgctcggaatgcggttacatacacaagaacaatcgtcaggaccagagcacgttcgagtgccagcaatgctccttcaaggtccacgccgattacaacgctgccaagaatatcagcgtgtacaatatcgagaaggtgatccagaagcaattggagctacaggagaaattgaaccagaccaagtacaaggaaaagtacatcgagcagatgaagaacattaactga

SEQ ID NO: 3061 - DNA, 1353 bp, Unknown
  Bacillus sp. multi
ctctccattgccgtaaaggtcatgaagtaccagatcgtttgccccgtgaacatcgagtggaagaccttcgagatatacctccgtactctctcctaccacttccgcacaatcggcaacagaacgattcaaaagttgtgggagtacgacaaccagagcttgaagcacttcaaggacacgggccagtacccgtccgcacagcaactctacgggtgcacgcagaaaaccatcagcggctatatctatgaccagctcaaagaggagtatcaggacatcaacaaggcgaatatgtccaccactttgcagaaaaccatccgcacctggaactcccgcaaaaaagagatatggagtggcgagatgtccatcccctccttccggaacaacttgccaattgacatccacgggaatagcatccagatcatcaaggagaagtctggagactacattgcgtcagtgtcgcttttcagttcgaaattcatcaaggagaacgacttgcccaacgggaagatcctcgtcaaactgtccactcgcaagcagaacagcatgaaggtgatacttgacaggatcattgacagcacttacgctaaaggagcgtgcatgttacacaagcacaagaaaaagtggtatttgagtattacatacaaaagcaacatcaaggaggaattgaaattcgacgaagacttaatcatgggaatagacatgggcaagatcaatgtactttactttgctttcaacaagggcctcgtacgcggcgcaatcagcggggaggagattgaggcttttcgcaagaagatcgagcacagacgtatctcactcctgcgacaagggaagtactgctccggaaaccgcatcggcaagggtagggagaagcggattaagcccatcgacgtcctaaacgacaaggttgcgaagttccgtaacgcgacaaaccacaagtacgcgaactacatcgtccagcagtgcctcaagtacaattgcgggaccattcaattggaggatctaaagggcatctcaaaggagcagaccttccttaagaactggacgtacttcgacctccaggagaagatcaaaaaccaggcaaaccagtacggcgtcaaggtggtgaagatagacccgtcctacactagccagagatgcagtgagtgcggctacattcacaagaataaccgccaggaccagtccaccttcgagtgccagcagtgctccttcaaggtccacgccgactacaacgccgccaagaacatctcggtttacaacatcgagaaggttatccaaaagcagcttgaactacaggagaagctcaatcagactaagtacaaggagaagtacatcgagcagatgaaaaatatcaactag

SEQ ID NO: 3062 - DNA, 1353 bp, Unknown
  Bacillus sp. multi
ctcagcatcgctgtgaaggtgatgaagtaccaaatcgtttgccctgtgaacatcgagtggaagaccttcgagatatacctcaggacactctcctatcacttccggaccatcgggaaccgaaccatccagaagctgtgggagtacgacaaccagtcactaaaacactttaaagataccggccagtacccttccgcccagcagctttacggttgcacccagaagactatctccggctatatctacgaccagctcaaggaggagtatcaggacattaacaaggcgaacatgagtaccacattacagaagactatccgcacctggaactcccgcaagaaagagatatggagcggagagatgtccatccccagcttccgaaacaacctgcccatcgacattcacggcaacagcattcagatcattaaggagaagtcgggcgattacatcgcctcagtttcgctgttctcaagtaagttcatcaaggagaacgacctgcctaacgggaaaatcctcgtaaagctctccacaaggaagcagaactctatgaaggttatcctcgaccgtatcatcgactcaacctacgctaaaggagcctgcatgttgcacaaacacaagaagaaatggtacttgtctattacctacaaaagcaacattaaggaggagttgaaattcgacgaagacttaatcatgggcatcgacatggggaagatcaacgtcctctacttcgctttcaacaaggggttggtacgaggggctatctccggggaggaaattgaagcctttcgcaagaaaatcgagcaccggcggatctccctgctccgccaggggaagtattgcagcggcaacaggatcggcaagggacgtgagaagcgtatcaagccgattgacgtgcttaacgacaaggtggccaagttccgtaatgccacgaaccacaagtatgccaactacatcgtgcagcagtgcctcaagtacaattgcggcaccatccagcttgaggacttgaagggaatatctaaggagcagacattccttaagaattggacgtacttcgatctccaggagaagatcaaaaaccaggcgaaccagtacggcgttaaggttgtgaaaatcgacccatcctacacctcccagcgctgctccgagtgcgggtacattcacaagaacaaccgccaggaccaaagtacgttcgagtgccaacagtgctccttcaaagtccatgctgactacaacgctgccaagaacataagcgtgtacaacatcgagaaggttatccagaaacagttggaattacaggagaagctaaaccagacaaagtacaaggagaagtacatcgagcagatgaagaacatcaactag

SEQ ID NO: 3063 - DNA, 1353 bp, Unknown
  Bacillus sp. multi
ctgtccatcgccgtgaaggtcatgaagtaccaaatcgtgtgccccgtcaacatcgagtggaagaccttcgagatatacctccgcacgttgtcttaccactttcgcaccattggaaaccggacaatccagaagctgtgggaatacgataatcagagcctcaaacacttcaaggacacgggccagtatccttctgcccagcagctctacggctgcacgcaaaaaacaatctccggttacatatacgaccagttgaaggaggagtaccaggacattaacaaagcgaacatgagcacgactttgcaaaaaaccatccgcacgtggaactcccgcaaaaaggagatatggagtggggaaatgagcatcccttcctttcgtaacaacttgccgattgacattcacggaaactctatacagatcatcaaggagaagtctggcgactacattgcctcagtgagcttgttcagttcaaagttcatcaaggagaacgacctccccaacgggaagatactggtcaagttatcaacgcggaagcagaacagcatgaaggtgatccttgacaggatcattgactctacatacgcaaagggtgcctgcatgttacacaagcacaagaagaagtggtatcttagcatcacctacaagtcgaacatcaaggaggagttaaagttcgacgaagacctcatcatgggcattgacatggggaagattaacgtgctgtacttcgcctttaacaaaggtctggtccggggtgcaatctcaggcgaggagatcgaagccttccgcaaaaagatcgagcaccgtcggatctcgctgctgcgacagggcaaatattgcagcgggaaccggatcggcaaggggagggagaagcgtattaagcctattgacgtcctcaatgacaaagttgccaagttccgcaatgccaccaaccacaagtacgctaactacatcgtccagcagtgccttaagtacaactgcggaaccatccagttggaagatttgaagggcatctccaaagagcagacgttcctcaagaactggacgtacttcgacctacaggagaagatcaaaaaccaggcgaatcagtacggggtgaaggtggtgaagatcgacccctcctacacctctcagcggtgctccgagtgcgggtacattcacaagaacaaccgacaagatcagtcaacattcgagtgccagcagtgcagcttcaaggtccacgccgactacaacgccgccaagaacatctctgtttacaacattgagaaggtcatccagaagcaattggaactacaggagaaactcaatcagacaaagtacaaggagaagtacattgagcagatgaaaaatatcaattga

SEQ ID NO: 3064 - DNA, 1353 bp, Unknown
  Bacillus sp. multi
ctgagcattgcggtgaaggtgatgaagtaccagatcgtgtgtccggtgaatatcgagtggaagaccttcgaaatctacctccgaacactctcctaccactttcggaccattgggaatcgtaccatccagaagctgtgggagtacgacaaccagtccctgaaacacttcaaggacacagggcaatacccctcggctcagcagctctacggctgcactcagaagacaatctccggctatatctacgaccagctcaaggaggaataccaggacatcaacaaggccaatatgtccaccacactacagaaaacgatccgaacttggaactcccgcaagaaggagatatggagtggggagatgtccatcccctctttcagaaacaacctccccattgacatacacgggaactccatccagatcatcaaggagaagtccggggactacatcgcctccgtgagcctctttagctcgaagttcatcaaggaaaacgacctccccaacgggaagatcctcgtgaagctgtcaactcgcaagcaaaacagtatgaaggtcattctcgacaggatcatcgactctacctatgcgaaaggtgcctgcatgttgcataagcacaagaagaaatggtatctcagcatcacttacaagtcgaacatcaaggaggagttgaaattcgacgaagacctgattatgggcatcgacatgggcaagatcaacgtactgtacttcgcgttcaacaaggggctcgtgaggggtgcaataagcggcgaggaaattgaagcgttccgcaaaaagatagagcaccgccgcattagccttttacgtcaagggaagtattgctctggcaaccggattggaaaagggcgggagaagcgtattaagcccattgacgtcctcaacgacaaggtggccaagttccgtaacgccaccaaccacaagtacgccaactacatcgtacaacagtgcttaaagtacaactgcggcacgatccagcttgaggacttaaaggggattagcaaggagcagacattccttaagaattggacatacttcgatctacaggagaagatcaaaaaccaggcaaaccagtacggggtcaaggtggtgaaaatcgacccgagctacaccagccaacggtgctcagaatgcgggtacatccacaagaacaaccgacaggaccagagcacgttcgagtgccagcagtgcagcttcaaagttcacgctgactacaacgcggccaagaacatctcagtttacaatatcgagaaggtgatccagaagcaacttgaattacaggagaagctaaaccagacgaagtacaaggagaagtacatcgagcagatgaaaaacatcaattga

SEQ ID NO: 3065 - DNA, 1353 bp, Unknown
  Bacillus sp. multi
ctcagcatcgcggttaaggttatgaagtaccagatcgtctgcccagtgaacattgagtggaagaccttcgagatatacctgcgtaccctgtcataccacttccgaacaattgggaacagaactatccagaagctctgggaatacgacaaccagtcccttaagcacttcaaggataccggacaatacccctccgcccaacagctctacggttgcacccagaaaaccatctcggggtacatctacgaccagctaaaggaggagtaccaggacattaacaaggccaatatgagcactacattgcagaagactattcggacctggaactcccgcaagaaagagatatggagtggcgagatgagcatacccagcttccggaacaatctcccgattgacatccacggcaactccatacagatcattaaggagaagtcgggcgactatatcgcctccgtgtccctgttctcgtccaagttcattaaggagaacgaccttccgaacgggaagatccttgtcaaactcagcacccgcaagcaaaacagcatgaaggtcatcctggacaggatcatcgactccacctatgcaaagggagcgtgcatgttgcacaagcacaaaaagaagtggtacttgtcaatcacctacaaatccaacattaaggaggagttgaagttcgacgaagaccttatcatggggatcgacatgggcaagatcaacgtcctgtactttgctttcaacaaggggctggtgaggggcgcgatcagcggggaggagattgaggcgtttcgcaaaaagatcgagcatcgacgcatcagcctactgagacaaggcaaatattgttctggcaaccggattggcaagggtcgggagaaacgcattaagccaattgacgtactaaacgacaaggtggccaagttccgtaatgcgaccaatcacaagtacgccaactacattgtccagcagtgcctcaagtacaattgcggcaccattcagcttgaagacttaaaggggatctccaaagagcagacattcctcaagaactggacctacttcgatctacaggaaaaaatcaagaatcaggccaaccagtacggtgtgaaggtggtcaagatcgacccgagctacacatctcagcgctgctccgagtgcgggtacatccacaagaacaaccgacaagatcagtcaaccttcgagtgccagcagtgcagcttcaaggttcacgccgattacaatgcggctaagaatatctcactatacaacatcgagaaggtgatccagaagcaacttgaactacaggagaagctgaatcagacgaagtacaaggagcagtacatcgagcagatgaagaacatcaactga

SEQ ID NO: 3066 - DNA, 1353 bp, Unknown
  Bacillus sp. multi
ttgtcaatcgcagtgaaggtgatgaagtaccaaatagtgtgccccgtgaacattgagtggaagaccttcgaaatctacctcagaactctaagttaccacttccgcaccattggcaaccgtaccatccagaagctctgggagtacgacaaccagtccctcaagcactttaaagacaccgggcagtacccgtccgcccagcagctttacgggtgcacacagaagactatctccggctacatctacgaccagctaaaggaggaataccaagacatcaacaaggccaatatgagtacgaccttgcagaaaacgatccgtacatggaactcccgcaagaaggagatttggagcggcgagatgtccatcccctcattccgtaacaatttgcccattgacatccacggcaactccatccagatcattaaggagaagtcgggagattacatcgccagcgtcagcctattctcaagcaaattcatcaaggagaatgaccttcctaatggcaagatcctcgtaaagttgtccacacggaagcagaactccatgaaggtgatcctggaccgcatcatcgacagtacatacgcaaaaggagcgtgcatgttgcacaagcacaagaaaaaatggtatctgtctatcacctacaagtcgaacatcaaggaggaactcaagttcgacgaggacttgataatgggaatagacatgggcaagattaacgtgctctacttcgccttcaacaaggggcttgtgaggggcgctatctccggcgaggaaattgaggcgttccgcaagaagattgagcacaggcggatctcgctcctccgtcaggggaagtactgttccggcaaccggatagggaagggtcgggagaagcgtatcaagcccatcgacgtcctgaatgacaaggtggcgaaattccgcaacgccaccaaccacaagtatgccaactacattgtgcagcagtgcctcaagtacaactgtggtacgatccagttggaagaccttaagggtatctcgaaggaacagaccttcctcaagaactggacctacttcgacctccaggagaagatcaaaaaccaggcaaaccagtacggcgtgaaagtggtgaagattgatccgtcctacaccagccaaaggtgctctgagtgcggttacatacacaagaacaacagacaagatcagtcaaccttcgaatgccagcagtgctccttcaaggttcacgctgactacaatgccgccaagaacatctccctgtacaatatcgagaaggttattcagaaacagctagagctacaggagaagctcaaccagacgaagtacaaggagcagtacattgagcagatgaagaacatcaactga

SEQ ID NO: 3067 - DNA, 1353 bp, Unknown
  Bacillus sp. multi
ctttcaatcgctgtcaaggtcatgaagtaccagatcgtgtgccccgtgaacatcgaatggaagacattcgagatatacctcagaactctgtcttaccactttcggacaatcggcaaccgaactatacagaagctctgggaatacgacaaccagtctctcaagcacttcaaggacacagggcagtacccctcagctcaacaattgtacggctgcactcagaagacaatcagcgggtacatctacgaccagctcaaggaggagtaccaggacatcaacaaggccaatatgtcaaccacccttcaaaaaacaatccgtacttggaactcacgcaagaaagagatttggagcggcgagatgtctattccgtccttccgcaacaacctgcctatagacattcacggcaacagtatccagatcatcaaggagaagtcaggcgactacattgcctccgtgagcctattctcctccaagttcatcaaggagaacgacctaccaaacggcaagattctcgtgaaactgtcaacccgcaagcaaaactcgatgaaggtgattctggaccgaatcattgactccacctacgcgaaaggtgcctgcatgttgcacaaacacaagaagaaatggtatctctcaatcacctacaagtccaacatcaaggaggagcttaagttcgacgaagacctgataatgggcatcgacatggggaagataaacgtgctctacttcgcattcaacaagggactggtgcggggcgcaatcagtggtgaggaaattgaggcgtttcgcaagaagatcgagcaccggcggatctctctactccgccagggcaagtactgttctggcaaccggatcggcaagggccgcgagaagcgcatcaagccaattgacgtcctcaatgacaaggttgccaagttccgtaacgccaccaaccacaagtacgcgaattacatcgttcagcagtgcctaaagtacaattgcggcaccattcagttggaggatcttaagggcatcagcaaggagcagaccttccttaagaattggacgtacttcgatctacaggaaaaaatcaagaatcaggccaaccagtacggtgtgaaggtggtgaagattgatcccagttacaccagccagaggtgcagcgagtgcggctacatccacaagaataaccgtcaggaccagtccacctttgagtgccagcagtgctctttcaaggtgcacgcagactacaacgctgccaagaatatctctctctacaacatcgaaaaggtcatccaaaagcagttagaattacaggagaagctcaaccagactaagtacaaggagcagtacatcgagcagatgaagaatatcaactga

SEQ ID NO: 3068 - DNA, 1353 bp, Unknown
  Bacillus sp. multi
ctcagcatcgccgtgaaggtcatgaagtaccagatcgtgtgtccagtgaacatcgagtggaagaccttcgagatatacctccggaccttgagctaccacttccgcactatcgggaaccggactatccagaagttatgggagtacgataaccagagccttaaacactttaaggacactgggcagtacccctccgcgcagcagctctacggatgcacccagaaaacaatttccggctacatctacgaccagcttaaggaggagtatcaggacatcaacaaggccaatatgtcaaccaccttgcagaaaaccatccggacctggaactcccgcaagaaggagatatggagcggcgagatgtctatcccctcgttccgtaacaacctgcctattgatattcacgggaacagcattcagatcattaaggagaagtctggcgactacatcgcctcagtgagcctcttcagttctaagttcatcaaggagaacgaccttccaaacgggaagatccttgtgaaactatcgacaaggaagcagaactcgatgaaggtgatcctggacaggatcattgactccacctatgccaaaggagcgtgcatgttgcacaagcacaaaaagaagtggtatttgagtatcacttacaagtccaacatcaaggaggaattgaaattcgacgaagacttaatcatggggatcgacatggggaagataaacgtcctgtacttcgcgttcaacaagggtctggtgcgaggcgctatctccggtgaggaaatcgaggcgttccgcaaaaaaatcgagcaccggcgcatctctctgttgagacagggcaaatactgctctgggaacaggatcgggaaaggccgcgagaagcgcattaagcctatcgacgttctgaacgacaaagtggcaaagttccgcaacgcgaccaaccacaagtacgcgaattacatcgtacaacagtgccttaagtacaattgcggtactatacaacttgaagacctaaaagggatctcgaaggagcagaccttcctcaagaactggacatacttcgacctacaggagaagatcaaaaaccaggcaaaccagtacggcgtgaaggtggtcaagattgacccaagctacactagccagcgatgctctgagtgcggctacatccacaagaacaaccgccaggaccagtccaccttcgagtgccagcagtgcagtttcaaggtgcacgcggattacaacgctgccaagaacatctcgctttacaacattgaaaaggtgatccagaagcaactagaactccaggagaagctgaaccagactaagtacaaggagcagtacatcgaacagatgaaaaacatcaattga

SEQ ID NO: 3069 - DNA, 1353 bp, Unknown
  Bacillus sp. multi
ttgagcatcgcagtgaaggtgatgaagtaccagatcgtctgccccgtcaatatcgagtggaagacgttcgaaatctaccttcgaaccttatcataccacttccgaaccatcggcaaccgcaccattcagaagctgtgggaatacgacaatcagtcgctcaaacacttcaaggacaccggccagtacccctctgcccagcagctctacggatgtactcagaaaaccatctccggctacatctacgaccagctcaaggaggagtatcaagacattaacaaggccaatatgagcacgactcttcagaagaccatacggacgtggaactcccgcaagaaagagatttggagtggcgagatgtccatcccgtccttccgcaacaacctcccaattgacattcacggcaactcaatccagatcatcaaggagaaatcgggcgactacatcgcttctgtctcccttttcagtagcaagttcatcaaggagaacgacttgcctaacgggaaaatcctggtcaaattgtccaccaggaagcaaaacagcatgaaggtgatactcgacagaatcatcgacagcacttacgcaaaaggggcctgcatgttgcacaagcacaagaaaaagtggtatctctccatcacttacaagtccaacatcaaggaggagttgaagttcgacgaggatctaatcatgggaatagacatggggaagattaacgtcctgtactttgctttcaacaaggggttggtgcgtggggctatatcaggggaggagatcgaggctttccgcaagaagattgagcaccgccgaatctccctgctccgacagggcaaatattgttctggcaacaggatcgggaagggccgtgagaagcgtattaagcccattgacgtgctcaacgacaaggttgccaagttcagaaatgccaccaaccacaaatacgcgaactacattgttcagcagtgcctcaagtacaattgcgggaccatccaactggaagacctaaagggcatcagcaaggagcagaccttcctcaagaactggacttacttcgacctacaggagaagatcaaaaaccaggcaaaccagtacggggtcaaggtggtcaagatcgaccccagttacacatcacagaggtgttcagagtgcgggtacattcacaagaacaacagacaagaccagagcacgttcgaatgccagcaatgctcgttcaaagtgcacgccgactacaacgccgccaagaacatctcgctgtacaacatcgagaaggtgatccagaagcagttggaattacaggagaagctaaaccagacgaagtacaaggagcagtacatcgagcagatgaaaaatatcaactga

SEQ ID NO: 3070 - DNA, 1197 bp, Unknown
  Bacillus sp. multi
ttgaaggacttcaaagacacaggccagtacccgtcagcgcagcagctctacggctgcacgcagaagacgatctccggctacatctacgaccaacttaaggaggagtaccaagacattaacaaggccaacatgagcacgaccctccagaaaactattaagacctggaactcccgcaagaaggagatttggagcggtgaaatgagcattcccagcttccggaacaacctcccaattgacatccacggcaacagcatccagatcatcaaggagaagtccggagactacatcgcatcagtgtccctgttctccagcaagttcatcaaggagaacgatctacccaacgggaagatcctcgtgaaactctccactcgcaagcagaatagtatgaaggtgattctggacaggatcatcgacaatacctacgcaaagggtgcctgcatgttgcataagcacaagaagaaatggtacttatctattacatacaagagcaacatcaaggaggagctgaaattcgatgaagacctaatcatggggatagacatggggaagatcaacgttctctacttcgcattcaataaggggcttgttcgcggagggatcagtggtgaggagatcgaggcgttccgcaagaagattgagcaccgccgcatctcgctgctcagacaaggaaagtattgctcagggaaccgcatcgggaaggggcgcaaaaaacggattaagcccattgaagtgctaaatgacaagatcgccaagttccgcaacgcaacgaaccacaagtacgctaactacatcgtccagcagtgcttgaagtacaactgtggcaccattcagcttgaggacttgcaagggatcagtaaagagcagacattcctcaagaattggacctacttcgacctccaggagaagatcaaaaaccaggcgaatcagtacggcatcaaggtggtcaagattgaccctagttacacctcccagaggtgctctgaatgcggctacattcacaagaacaacaggcagaaccagtccaccttcgagtgccagcagtgctccttcaaagtccacgcggattacaacgcggccaagaacatcagtgtttacaatatcgagaaggttatccaaaagcaacttaagctccaggagaagctgaacttgacaaagtacaaggagcagtacatcgagcagatggagaacatcaactga

SEQ ID NO: 3071 - DNA, 1197 bp, Unknown
  Bacillus sp. multi
ttgaaggacttcaaggacaccggccagtacccctccgcgcaacagttgtacgggtgcacacagaaaaccatcagcggctacatctatgaccaactcaaagaggagtaccaggacatcaacaaggccaatatgtccactactttgcagaaaactattaagacctggaactcccgcaagaaggagatttggagcggtgagatgagcatcccgtcgttccgcaacaacctccccattgacattcacgggaactccatccagatcatcaaggagaagtcaggcgactacatcgctagtgtttcccttttcagttctaagttcatcaaggaaaacgacctcccgaacgggaagatactggttaagctgtccactaggaaacagaactccatgaaggttatcctcgaccgtatcattgataacacctacgctaaaggtgcctgcatgttgcacaagcacaaaaaaaagtggtacttgtccatcacttacaaatccaacatcaaggaggagttgaagttcgatgaagacctgattatgggaatagacatggggaagatcaacgtcctttactttgccttcaacaaggggttggtgcgtggcggcattagcggcgaggaaattgaggctttccgcaagaagatagagcacaggcgaatctcgctcctccgccaggggaaatactgttcggggaacagaatcggaaaagggcgcaaaaaacgcatcaagccaatcgaggtgttaaacgacaagatcgccaaattccgcaacgccaccaaccacaagtacgccaactacatcgtgcagcagtgcctcaagtacaactgcggtacgatacaattggaagacttacaggggatctctaaagagcagactttcctcaagaactggacctacttcgacctacaggagaagatcaaaaaccaggccaaccagtacgggatcaaggtggtcaagatcgacccgtcctacaccagccagcggtgctctgagtgcgggtacattcacaagaacaaccgacagaaccagagtaccttcgagtgccagcagtgttcctttaaggtgcacgcagactacaacgccgccaagaacataagcgtgtacaacatcgagaaggtgattcagaagcagctcaaactccaggagaagctcaacctgacgaagtacaaggagcagtacatcgagcagatggagaatatcaactga

SEQ ID NO: 3072 - DNA, 1197 bp, Unknown
  Bacillus sp. multi
ctcaaagactttaaggacacggggcagtaccccagcgcacagcaactttacggctgcacgcagaaaacaatctcaggctacatctacgaccagctcaaggaggagtaccaggacattaacaaggccaatatgtccacaaccctccagaaaactatcaagacgtggaactcccgcaagaaggagatttggagcggggagatgtccattcccagcttccgcaacaacctgcctatcgacatccacggcaactccattcagatcatcaaggagaagtcgggtgattacatcgcatccgtgtccctattctcatccaagttcatcaaggagaacgacctccctaacggcaagattctcgttaagctgtccacccgcaagcagaactcgatgaaggtgatcctcgaccgcatcatcgacaatacctacgctaagggcgcgtgcatgttgcacaagcacaaaaagaaatggtatctgagcattacctacaagagcaacatcaaggaggagcttaagttcgacgaagacttgataatggggattgacatggggaagataaacgtgctttacttcgctttcaacaaggggctcgtgcgaggtgggattagcggggaggagattgaagcgttccgcaagaagatcgagcacaggaggatctcactcctgcgccagggcaagtactgctctggaaatcgtatcggcaaggggcgcaagaagcgcatcaagcctatcgaagtcctcaacgacaagatagcaaagttccgcaatgccactaaccataagtacgccaactacattgtgcagcagtgcctaaagtacaactgcgggaccattcagttggaggacttgcaaggaatcagcaaggagcagacgttcctcaagaattggacctacttcgatctccaggaaaaaatcaagaatcaggcaaaccagtacgggattaaggtggtcaagatcgacccgagctacacaagccagcgatgctccgagtgcggctacattcacaagaacaaccgtcagaaccagtccaccttcgagtgtcagcagtgctcgttcaaggtgcacgcggactacaacgccgctaagaacatcagcgtttacaatatcgagaaggtgatccagaagcaacttaagctacaggagaagctaaacctgaccaagtacaaggaacagtacatcgaacagatggagaacattaactag

SEQ ID NO: 3073 - DNA, 1197 bp, Unknown
  Bacillus sp. multi
cttaaagacttcaaggacacgggccagtaccccagcgcgcagcaactgtacgggtgcactcagaagaccatctccggctacatctacgaccaacttaaggaggagtatcaggacatcaataaggccaatatgagcaccacgctccagaaaactatcaagacctggaacagtcgcaaaaaagagatttggagtggggagatgtccatcccctccttccggaacaatctccctatagacatccacggcaacagtatccagatcatcaaggagaaatctggtgactacatcgcatcagtgagcttgttctctagcaagttcatcaaggagaacgacctccccaacgggaagatcctcgtgaagctgtccacccgcaagcagaatagcatgaaggtgatacttgaccgcatcatcgacaacacctacgcaaagggtgcctgcatgttgcataagcacaagaagaagtggtacttatcaattacatacaagagcaacatcaaggaggaactcaaattcgacgaagacttaatcatgggcatcgacatgggcaagataaacgtactttacttcgccttcaacaagggcctcgtgcgtggtgggatctctggtgaggaaattgaagccttccgcaaaaagattgagcaccggcgcatctctctattacgccaggggaagtactgttctggcaaccggatcggaaaggggcgcaaaaagcgcatcaagcccattgaagtgctgaacgataagatcgccaagttccgtaacgccactaaccacaagtatgccaactacatcgtgcagcagtgcttgaagtacaactgtgggaccatccagttggaagacctacagggcatcagcaaggagcagacattccttaagaactggacctacttcgacctccaggaaaaaatcaagaaccaggccaaccagtacgggatcaaggtggtgaagatcgaccccagttacacttcacagcggtgctctgagtgcggctacatccacaagaataaccgccagaaccagtccacctttgagtgccagcagtgctcattcaaggtccacgctgactacaacgctgccaagaacatctccgtgtacaatatcgagaaggtcattcagaagcagttgaagttacaggagaagctgaatctcaccaagtacaaggaacagtacatcgagcagatggagaacatcaactga

SEQ ID NO: 3074 - DNA, 1197 bp, Unknown
  Bacillus sp. multi
cttaaagacttcaaggacacggggcagtaccctagtgctcaacagctatacgggtgcacgcagaagacgatcagtggctacatctacgaccagcttaaagaggagtaccaggacattaacaaggcaaacatgagcaccaccttgcagaagaccatcaagacctggaactcccgcaaaaaggaaatctggagcggggagatgtccattccctcattccggaacaacctccccatcgacatacacgggaactcgatccagatcatcaaggagaagtccggggactacatcgccagcgtgagcctgttctccagcaagttcatcaaggaaaatgacctcccaaacggcaagatacttgttaagctatctacccgtaaacagaactccatgaaggtcattctggaccggatcatcgacaacacctacgctaaaggagcctgcatgttgcacaagcacaaaaagaagtggtatttgagcatcacgtacaaatccaacatcaaggaggaattgaaattcgatgaagacctaatcatggggatcgacatgggcaagatcaacgtactctactttgccttcaacaaggggcttgttcggggcgggatctccggcgaggaaattgaggctttccgcaaaaagatcgagcacaggaggatctccctgctacgtcagggcaaatattgttccggcaaccgcattggcaaggggcgcaaaaagcggattaagcccatcgaggtgcttaacgacaagatcgcaaagttcagaaacgcgactaaccacaagtacgcgaactacatcgtccaacagtgcctcaagtacaactgcgggaccatccagttggaagacctgcaagggatctctaaggagcagacgttccttaagaactggacctacttcgacctccaggagaagatcaaaaaccaggccaatcagtatggcatcaaggtggtcaagatcgaccccagctacactagccagcgctgctccgagtgcggttacatccacaagaataaccgccagaatcagtccacgttcgagtgccagcagtgctcattcaaggtccatgccgactacaacgcggccaagaacatcagtgtttacaacatcgagaaggttatccagaaacagctcaaactccaggagaagctgaacctcaccaagtacaaggaacagtatatcgaacaaatggagaacatcaactag

SEQ ID NO: 3075 - DNA, 1353 bp, Unknown
  Bacillus sp. multi
ctttctatagccgtgaaggtcatgaagtaccagatcgtgtgtcctgtcaacatcgagtggaagacctttgaaatctatcttcggacgctctcctaccacttccgcacaatcggaaacaggactatccagaaactgtgggagtacgacaatcagtctctcaagcacttcaaggacaccgggcagtaccccagcgcgcagcagctctacggatgcactcagaaaaccatctccggctacatctacgaccagctcaaagaggaataccaggacatcaataaggcaaacatgagtaccacacttcaaaaaactatccgtacatggaacagccgcaagaaggaaatctggagcggtgagatgtccatcccctctttccggaacaaccttcccatcgacatccacgggaactctatccagatcatcaaggagaagtccggcgactacatcgcctccgtctcattgttctctagcaagttcatcaaggagaacgacttgccgaacgggaagatccttgtgaagctctctaccaggaagcagaacagcatgaaggtgatcttggacaggatcatcgactcaacctacgcgaagggagcttgcatgttgcacaagcacaagaagaaatggtacttgtctatcacttacaagtccaacatcaaggaggagttgaaattcgacgaagacctgataatgggcatcgacatgggcaagatcaacgtcctgtacttcgcgttcaacaagggacttgtgcgtggagcaatctcgggcgaggaaattgaggctttccgcaagaaaatcgagcaccggcgtatatcactgctgagacaagggaagtactgctctggcaaccgcatcggaaaggggagggagaagcggatcaagccaatcgacgtgctcaacgacaaagtggccaagttccgtaatgccaccaatcacaagtacgccaattacattgtccagcagtgcctaaagtacaactgcggaacgattcagcttgaggacttaaaggggatctcaaaggagcagaccttccttaagaactggacatacttcgacttacaggagaagatcaaaaaccaggccaacctctacggggtgaaggtcatgaagatcgacccaagctacaccagtcaacgatgttcagagtgcgggtacatccacaaaaacaatcgtcagaatcagagcaccttcgagtgccagcagtgcagcttcaaagtgcacgccgactacaacgcggctaagaatatcagtctgtacaacatcgagaaggttattcagaagcagcttgaattacaggagaaactgaacttgacgaagtacaaggagcagtacatggagcagatgaaaaatatcaattga

SEQ ID NO: 3076 - DNA, 1353 bp, Unknown
  Bacillus sp. multi
ttgtccatagccgtgaaggtgatgaagtaccagatcgtctgtcccgtcaacatcgagtggaagaccttcgagatatacctccgcacactctcctatcacttccgcacaattgggaaccgtaccatccaaaagctctgggagtacgacaatcagtcactcaagcacttcaaggacaccgggcagtacccctccgcgcagcagttgtacggttgcacccagaaaacgatcagcggctatatctacgaccagcttaaggaggagtaccaggacatcaacaaggccaacatgagtaccaccttgcagaagactatccgtacctggaacagccgcaagaaggagatatggagcggcgaaatgagcatcccgtccttccgtaacaacctgcccatcgacattcatggcaactcaatccagattatcaaggagaagtcaggagactacatcgcatctgtgtccttattcagcagcaagttcatcaaggagaacgacttgcctaacggcaagatcctcgtaaaactaagcacccgcaagcagaactccatgaaggtcatcctggaccgaatcattgacagcacctatgctaaaggggcctgcatgttacacaagcacaagaagaagtggtatttgagcatcacgtacaagagcaacatcaaggaggagcttaagttcgacgaagaccttatcatgggaatcgacatgggaaagattaacgtcctctacttcgcgttcaacaaggggctggtgaggggcgctatctcgggcgaggaaattgaagccttccgcaaaaaaatcgagcacaggcgcatcagccttctgagacaggggaaatattgttccggaaaccgcatcggaaaggggcgggagaagcggatcaagcctatcgacgtccttaacgacaaggttgcgaagttccgcaacgcgaccaatcacaagtacgccaactacattgtgcagcagtgtctcaagtacaattgcgggacaatccagttggaggacttgaagggtatatcgaaggagcagacgttcctcaagaattggacgtacttcgacctacaggagaagatcaaaaaccaggcgaacctctatggggttaaagtgatgaagatcgaccccagctacaccagtcagaggtgtagtgagtgcgggtacatccacaagaataaccgccagaaccagtcaacattcgagtgccagcagtgcagcttcaaggtccacgccgactacaacgctgctaagaacatatcactgtacaacatcgaaaaggttatccagaagcagcttgagctacaggagaaactgaacctgacgaagtacaaagagcagtacatggagcagatgaagaatatcaactga

SEQ ID NO: 3077 - DNA, 1353 bp, Unknown
  Bacillus sp. multi
ctctccatcgccgtcaaggtgatgaagtaccagatcgtctgtccggtgaacattgagtggaagacattcgaaatctacttgaggacactaagctaccactttcgcaccatcgggaacagaaccattcagaaactctgggagtacgacaatcagtcgctcaagcactttaaggacaccggccagtatccgagcgcgcaacagctctacggctgcacccagaaaacgatctcgggctacatctacgaccaacttaaggaggaataccaggacatcaacaaggccaatatgtccacaactctccagaagacaattcggacttggaactcccgcaagaaggaaatctggagtggggagatgtccatccccagcttcagaaacaatctgcctatagacattcatgggaactcaattcagatcatcaaggagaagtcaggagactacattgcctccgtttccctgttctcctccaagttcatcaaggagaacgacctgcctaacggaaagattctagtcaagctctccacccggaaacaaaactctatgaaggtgattctcgacaggatcatcgactccacatacgcgaaaggtgcgtgcatgttgcacaagcacaaaaagaaatggtatctcagcatcacttacaagtccaacattaaggaggagttaaagttcgacgaagacctgattatggggatcgacatggggaagataaacgttctctacttcgcgttcaacaagggactcgtgcgcggggcaatcagtggggaggagattgaggcgttccgcaaaaaaatagagcaccgacggatctccctgttgcgacaagggaaatattgttccggcaaccgaattggcaaggggagggaaaagcgcatcaagccaatcgacgtgctaaatgacaaggttgcgaagttccgcaacgccaccaaccacaagtatgcaaactacatcgtccagcagtgcctcaagtacaactgcgggaccatccagctagaggatctcaagggtattagcaaagagcagactttccttaagaactggacatacttcgacctccaggagaagatcaaaaaccaggccaacctctacggagtgaaggttatgaagatcgacccgagctatacgtctcagcgctgctctgagtgcggctacattcacaagaataaccggcagaatcagagtaccttcgagtgccagcaatgctccttcaaggtgcacgctgactacaacgcagccaagaacatctccctgtacaacatcgaaaaggtcattcagaagcagttggaattacaggagaaactgaacctcactaagtacaaggagcagtacatggagcagatgaagaacattaactga

SEQ ID NO: 3078 - DNA, 1353 bp, Unknown
  Bacillus sp. multi
ttgtccatcgccgtcaaggtgatgaagtaccagatagtctgtccggtgaacatcgagtggaagaccttcgaaatctaccttcggacgttaagctaccacttccggaccatcggcaacaggaccatccagaagctctgggagtacgataaccagtcactcaaacacttcaaggacacgggccagtacccctcggcccagcagctttacggctgcacccagaagacaatcagcggctacatctacgaccagctcaaggaggagtaccaggacattaacaaggcaaacatgagcacgacgcttcagaaaacgatcaggacgtggaactcccgcaagaaggaaatctggagcggcgagatgagcattccgtctttccgcaacaacctgcctattgacatccacgggaactccatccagatcatcaaggagaaaagcggagactacatcgccagcgtgtccctattcagctcgaagttcatcaaggagaacgacctgcctaacggcaagatcctcgtgaagctcagcacacgaaaacagaatagcatgaaggtcattctcgaccgaatcatcgactcgacgtacgcaaagggagcctgcatgttgcacaagcacaagaagaaatggtatctatccattacctacaaatcgaacatcaaggaggaactgaaattcgacgaagacctgattatggggatcgacatggggaagatcaacgtgctttacttcgctttcaacaagggtttagtacggggagctatatccggtgaggagatcgaagcgttccgcaaaaaaatcgagcacagacgcatctcactcttacgtcagggcaagtactgttccggcaaccgcatcgggaagggtcgggaaaagcgtattaagcctatcgacgtgctgaacgacaaggtggcaaagttccgtaatgcgacaaatcacaagtacgccaattacatcgtccagcagtgccttaagtacaactgcggcacgattcagcttgaagacctcaagggtatcagcaaggagcagaccttccttaagaattggacttacttcgacctacaggagaagatcaaaaaccaggcgaacttgtacggggtgaaggtgatgaagattgaccccagctacacaagccagcgttgctccgaatgcggctacattcacaagaacaatcgccaaaaccagtccaccttcgagtgccagcagtgctctttcaaggttcatgcagactacaacgctgccaagaacatatcgttgtacaatatcgagaaggtcatccagaagcagttggaattacaggagaagctgaacttgacaaagtacaaggagcagtatatggagcagatgaagaatatcaactga

SEQ ID NO: 3079 - DNA, 1353 bp, Unknown
  Bacillus sp. multi
ctctcaatcgccgtcaaggtcatgaagtaccagatcgtttgccccgtgaacatcgagtggaagacgttcgagatatacttgagaacgctaagctatcactttcgaacaatcgggaatcgaactatacagaagctctgggagtacgacaatcagtccttgaagcacttcaaagacaccggccagtaccccagcgcgcagcagctctacgggtgtacgcagaaaacaatctcggggtacatctacgaccagctcaaagaggagtaccaggacattaacaaggcgaatatgagtacaaccctacagaaaaccatccggacctggaacagccgcaagaaagagatttggagtggggaaatgtccatcccctcgttcagaaacaacctgcctatcgacatccacgggaactccatccagatcatcaaggagaaatctggcgactacatcgcttccgtctcgctattctcctcgaagttcatcaaggagaacgacctgccgaacggaaagatacttgtcaagctatccactcggaaacagaacagcatgaaggttatcttggaccgcatcattgacagcacttacgcgaaaggggcgtgcatgttgcacaagcacaagaaaaaatggtacttgagcatcacttacaagtccaacatcaaggaggagttgaagttcgacgaggacttaatcatgggcattgacatggggaagatcaatgttctatacttcgctttcaataaggggctggtgcggggtgccatatcaggcgaggaaattgaggctttccgcaaaaagattgagcaccgccgtatcagcctcctcagacagggcaagtactgctctgggaatcgaatcggcaagggtcgtgagaagcgtatcaagccgatagacgtgctgaacgataaggtcgccaaattccggaacgcgaccaaccacaagtatgcaaactacatcgtgcagcagtgcttgaagtacaactgcggcacaatccagttggaagacttaaagggaatcagcaaggaacagacattcctcaagaactggacctacttcgacctccaggagaagatcaaaaaccaggcaaacctctacggggtcaaagtcatgaagatagacccgagttacacttcccagcggtgctcagagtgcgggtacattcacaagaacaaccggcagaatcagagtaccttcgagtgccagcagtgtagtttcaaagtgcacgcggactacaacgcagccaagaacatatctctgtacaacatcgagaaggtgatccagaagcagctagaattacaggagaagctaaacctcaccaagtacaaggagcagtacatggagcagatgaagaatatcaactag

SEQ ID NO: 3080 - DNA, 1353 bp, Unknown
  Bacillus sp. multi
cttagcatcgcggttaaggtgatgaagtaccagatcgtctgccccgtcaatatcgagtggaagaccttcgagatatacctccgtaccctcagctatcacttccgcaccatcggcaaccgtacgatacagaagctatgggagtatgataaccagtcccttaaacacttcaaagacaccgggcaatatccgtccgcacagcaactgtacggctgcacccagaaaacaatatcaggctacatctacgaccagctcaaggaggagtaccaggacattaacaaggccaatatgtccacaaccctccagaaaaccatcaggacatggaactctcgcaaaaaggagatttggagcggggagatgagcattccatcctttcgtaacaatttgcccattgatattcacggcaactccatccagatcatcaaggagaagtccggcgactatatcgcaagcgtgagcctgttctcatccaaattcattaaggagaatgaccttccgaacgggaagatcctggtgaagctatccaccaggaagcagaacagcatgaaggtgatccttgaccgcatcatcgactctacttacgcaaagggtgcctgcatgttgcataagcacaagaaaaagtggtacttgtccatcacgtacaagtcaaacatcaaggaggagttgaaattcgacgaggacttgataatggggatcgacatggggaagattaacgttctatacttcgctttcaacaagggacttgtccgtggggctatatccggggaggagattgaagccttccgcaagaagatagagcaccgaagtatctctctgctgcgtcaggggaagtattgttctgggaaccgtatcgggaaggggagggagaaacggatcaagcctattgatgttctgaacgacaaggtggccaagttccgcaatgcaacgaaccacaagtacgccaactatatcgtccagcagtgcctaaagtacaactgcgggacgattcaactcgaagaccttaaagggatcagcaaggagcagaccttcctcaagaactggacttacttcgacctccaggaaaaaatcaagaatcaggccaaccagtacggcgtgaaggtggtgaagatcgacccgtcatacaccagccagcggtgctcggagtgcggctacatccacaagaacaatagacaagatcaatctacgttcgaatgccagcagtgcagcttcaaggtgcacgccgactacaatgcagccaagaacatctccctttacaacatcgaaaaggttatccagaagcagcttgaattacaggagaagctgaaccagacgaagtacaaggaacagtacatcgagcagatgaaaaatatcaactga

SEQ ID NO: 3081 - DNA, 1353 bp, Unknown
  Bacillus sp. multi
ttgagcatagctgtgaaggtgatgaagtaccagatcgtgtgcccggtgaatatcgagtggaagacattcgagatatacctccgcacgctatcctaccacttccggaccatagggaaccgcaccatccagaaactatgggagtacgacaaccagagtctcaagcacttcaaggacaccggccagtacccatctgcccagcagctctacggttgcacgcagaagactatctcgggttacatctacgaccagcttaaagaggagtaccaggacattaacaaggccaatatgagcacaaccttacaaaaaaccatccgtacttggaactcccgcaaaaaagagatttggagtggggagatgagcattccgtccttccgcaacaacctccccatcgacatccacggcaacagcatccagatcatcaaggagaaatcaggggactacattgcatccgtgtcactgttctccagcaaattcatcaaggaaaacgaccttccgaacggcaagatcctggttaagctctccacccgcaagcagaacagcatgaaggtgatactcgaccggataatcgactcaacgtatgcgaagggtgcctgcatgttgcacaaacacaagaagaagtggtatctgtccattacatacaagagcaacattaaggaggaactgaaattcgacgaagacctcatcatggggattgacatgggcaagattaacgtcctttactttgcgttcaacaaggggcttgttcggggcgctatcagcggcgaggaaatcgaggctttccgcaagaagatcgagcaccgaagtatcagccttctgcgccagggcaagtactgctcgggaaaccggatcggcaaggggcgcgagaagcgtattaagcccattgacgttcttaacgataaggtggccaaattccgaaacgcgactaaccacaagtatgcgaattacatcgttcagcagtgcttgaagtacaactgcgggacgatacagcttgaagacctcaagggtattagcaaggaacagactttccttaagaactggacgtacttcgacctccaggaaaaaatcaagaatcaggccaaccagtacggggttaaggtcgtcaagatcgacccgtcctacacttcccagcgctgctccgagtgcggctacatccataagaacaaccgccaggaccagagtaccttcgagtgccagcagtgctccttcaaagtgcacgccgactacaacgcggccaagaatatcagcctctacaacattgagaaggtgattcagaagcaattggagttacaggagaagctgaatcagaccaagtacaaggaacagtacattgagcagatgaagaacattaactga

SEQ ID NO: 3082 - DNA, 1353 bp, Unknown
  Bacillus sp. multi
ctgtctattgcagtgaaggttatgaagtaccagatagtgtgcccggtgaacatcgagtggaagaccttcgagatataccttcggaccttgagctaccactttcgaaccatcgggaacaggactatccagaagctatgggagtacgataaccagtctctcaagcacttcaaggacactggacagtacccctccgctcagcagctttacggctgcacgcagaaaacgatcagcggctacatctacgaccagcttaaggaggagtaccaggacatcaacaaggccaatatgtcaaccacgcttcagaagactatccgcacctggaactcacgcaagaaagagatttggagcggcgagatgagcatcccttccttccgcaacaacctacctattgacatacacgggaactccatccagatcatcaaggagaaaagtggagactacatcgccagtgtctcattgttctctagtaagttcatcaaggagaacgacctcccaaacggcaagatcctcgtgaagctgagtacccgaaagcaaaacagcatgaaggtgatccttgaccgcatcattgacagcacctacgcgaaaggggcctgcatgttgcacaagcacaaaaagaaatggtatctgtccattacctacaagagcaacatcaaggaggagttgaagttcgacgaggacttgataatggggattgacatggggaagataaacgtgctttactttgcattcaataagggactcgtcagaggagccataagtggggaggaaatcgaggcttttcgcaagaaaatcgagcatcgcagtatatctctgctcagacaggggaaatattgttctggaaaccgcattgggaagggccgtgagaagcgcatcaagccgattgatgttcttaacgacaaagttgccaaattccggaacgccaccaatcacaagtacgccaactacatcgtgcagcagtgcttaaagtacaactgcggcaccatacagcttgaggatctcaagggtatttccaaagagcagactttcctcaagaactggacatacttcgacctccaggagaagatcaaaaaccaggccaaccagtacggagtgaaggttgtgaagatcgacccctcttacacaagccagaggtgctccgagtgcgggtacatacacaagaacaaccgccaggaccaatccactttcgagtgccagcagtgctctttcaaagtccacgctgactacaacgccgccaagaatatctcgctttacaacatcgagaaggtgatccagaagcaactggaactacaggagaagctcaaccagacgaagtacaaagagcagtacatcgagcagatgaaaaacatcaactga

SEQ ID NO: 3083 - DNA, 1353 bp, Unknown
  Bacillus sp. multi
ctgtctatcgcggtgaaggttatgaagtaccagatcgtgtgcccagtcaacattgagtggaagacgttcgaaatctacttgagaaccctcagctaccactttagaactatcggcaaccgaaccatccagaaactgtgggagtacgacaaccagtcgctcaagcacttcaaggacaccggccagtacccctctgcccagcagctctatggctgcacccagaagactatcagcggctacatctacgaccagcttaaggaggaataccaggacattaacaaagccaatatgagcacaacccttcagaaaactattcggacgtggaactcccgcaagaaggagatttggagcggcgagatgagtattccttccttccgcaacaacttgccgattgacattcacgggaactccatccagatcatcaaggagaagtcgggcgactacatcgcctcagtttcgcttttcagcagcaaattcatcaaggagaacgacctgcccaacgggaagattctcgtgaagctctccactaggaagcaaaactccatgaaggtcatcctcgaccggatcatcgactcgacatacgcaaaaggagcctgcatgttgcacaaacacaagaaaaaatggtacttgtcaattacctacaagtccaacatcaaggaggaactcaagttcgacgaagaccttatcatgggcattgacatgggcaagatcaacgtgctttacttcgccttcaataagggtcttgttcgaggtgcaatctccggcgaggagatcgaagccttccgcaagaaaatcgagcaccgcagcatcagcctcttgcgacaggggaaatattgctctggaaaccgcatcggaaaaggacgtgagaagcgtatcaagcccattgatgtgctcaacgacaaggtggctaagttccgtaacgcgaccaaccacaagtacgccaactacatcgtgcagcagtgcttgaagtacaactgcggaaccattcaattggaagaccttaaggggatctcaaaggagcagacgttcctcaagaattggacttacttcgacctacaggagaagatcaaaaaccaggccaaccagtacggggtcaaagtcgtgaagattgacccgtcttacacctcgcagcggtgcagcgagtgcggctacatccacaagaacaacaggcaagatcagagtaccttcgagtgccagcagtgcagtttcaaggtgcacgcggactacaacgccgccaagaacatcagcctatacaacattgagaaggtgatccagaagcaactggagctacaggagaagttaaaccagaccaagtacaaggagcagtatatcgagcagatgaaaaatatcaattga

SEQ ID NO: 3084 - DNA, 1353 bp, Unknown
  Bacillus sp. multi
ctctcgattgccgtgaaggtgatgaagtaccagatcgtgtgccccgtgaacatcgagtggaagaccttcgagatatacctcagaaccttatcataccactttcgcaccatcgggaaccggaccatacagaagctctgggagtacgacaaccagagccttaaacacttcaaggacaccggtcagtacccctccgcccaacagctctacggatgtacgcagaaaactatcagtggctatatctacgaccagctcaaagaggagtaccaggatattaacaaagccaatatgtcaacaactcttcagaagactatccgcacttggaactcccgcaaaaaggagatttggagtggcgagatgtctatccctagtttccggaacaacttgcctattgacattcacggcaacagtatccagatcatcaaggagaagtccggggactacatcgcaagcgtgtccctgttctctagcaagttcatcaaggagaacgacctgcctaacggaaagatcctcgtgaagttgtccaccaggaagcagaactccatgaaggtgattctcgaccggataatcgactcgacgtatgcaaagggtgcctgcatgttgcacaagcacaaaaagaaatggtacttgagcataacgtacaagtccaacatcaaggaggaactgaaattcgacgaagacctcattatgggcattgacatgggcaagatcaatgtgctgtactttgccttcaacaaagggttggtgcgcggtgctatcagtggcgaggagatcgaggctttccgcaagaaaatcgagcaccggtctatctccctgctacgccaggggaagtactgttctggaaaccggattggaaagggccgggagaagcgtatcaagcctatcgacgtccttaacgacaaggtggccaagttccgcaacgccactaaccacaagtacgccaattacatcgtccagcagtgccttaagtacaattgcgggaccattcaattggaagatttgaaggggatcagcaaggagcagactttccttaagaactggacctacttcgacttacaggaaaaaatcaagaaccaggctaaccagtacggggtcaaggtggtgaagattgacccttcctataccagtcagcggtgctccgagtgcgggtacatccacaagaataaccgccaggaccagtccaccttcgaatgtcagcagtgcagcttcaaggtgcacgcggactacaacgctgccaagaatatctcactctacaacattgagaaggtgatccagaagcagctcgaattacaggagaaactcaatcagactaagtacaaggagcagtacatcgagcagatgaagaatatcaattga

SEQ ID NO: 3085 - DNA, 1353 bp, Unknown
  Bacillus sp. multi
ctctccacggtggtgaaggtcatgaagtaccagatagtgtgccccgtcaacatcgagtggaaggcgttcgaaacttacctgagaactctctcctatcaagtccggacaatcgggaaccgcacgatccagaagctgtgggacttcgacaaccagtctttgaaccactttcgggaaaacggcgtttacccgtccgcccagcaactttacggttgcactcagaaaacaataagcggctacatctatgaccaactgaaagaggaataccaggacatcaacaaggcgaacatgagcactacccttcaaaaaactatcaagacatggaacagccgcaaaaaggaaatccgttctggggagatgtccatcccctcattcagaaacaacttgcctattgacatccacggcaacagcatccagatcacgaaggagaaatccggtgactacattgcctccttgagtctgtttagctcaaacttcatcaaggaaaacaacctaccaaatgggaagatccaagtgaaattgagtacaaggaagcagaactcgatgaaggtgatcttggaccggatcatcgagaacacttatgctaaaggtgcttgcatgttgcacaagcacaagaacaagtggtacttatctatcatctacaagcccactgtgaaggaggaacacaacttcgaggaggacttggtgatggggatcgacatgggcaagatcaacgtattgtacttttccttcaacaaaggatggatcaggggagcaatcagcggtgaggagatcgaggcgtttcgcaagaagattgagcaccggcgtatcagcttgctccggcaaggcaagtattgctccgggaatcgtgtggggaaggggcgcgagaagcggattaagccgattgacgtgctcaacaacaaggtcgccaagttccggaatgctacaaaccacaagtacgccaactatatcgttcagcagtgcctcaagtacaactgcgggacgattcagcttgagaatctccagggaatatctaaggagcagactttcctcaagaattggacttacttcgacctccaggagaagattaaacaacaggcgcaccagtacgggattaaggtcgtaaccatcgacccctcctacacctctcagaggtgctcagagtgcgggtacatccacaagaacaatcgtcagtcgcaaagtacattcgagtgccagcagtgcaacctcaaggttcacgccgactacaacgcggccaagaatatcagcatctacaacatcgagaaggtgatacagaagcagttaaaactccaggagaagctgaactccaagaagtttaccgagcagtacatcgagcagatcgagaacatcaactaa

SEQ ID NO: 3086 - DNA, 1353 bp, Unknown
  Bacillus sp. multi
ctctccactgtcgtgaaggtgatgaagtaccagatcgtgtgccccgtgaacattgaatggaaagccttcgagacttaccttcggaccctgagttatcaagtgagaacaattgggaaccgcacaattcagaagttgtgggacttcgacaaccagagcctcaaccacttccgggaaaacggggtgtacccgtccgcacagcagctttacggatgcacccagaagaccatctccgggtacatctacgaccaacttaaggaggaatatcaggacatcaacaaggcgaatatgagcaccacccttcagaaaaccattaagacctggaactcccgcaagaaggagatccgctccggcgaaatgtcgatcccctcctttcgaaacaacctccccattgacattcatggcaactcaatccagatcactaaggagaagtcgggcgactacatcgcctccctcagcttattcagctcgaacttcatcaaggaaaacaacctgcctaacggcaagatccaagtgaagctcagcacccgaaagcagaactccatgaaggtgattctggaccgcataattgagaacacttacgcaaaaggagcgtgcatgttgcacaagcacaagaataagtggtacttgtctatcatctacaaacctacagtgaaagaggagcacaacttcgaggaagacctggtgatgggcatcgacatggggaagatcaacgtcctttacttcagcttcaacaaaggatggattcgtggtgctatctccggtgaggagattgaggcgtttcgcaagaagatcgagcaccgacggatctccctgctgcgtcagggcaagtactgctccgggaaccgtgttgggaaggggcgggagaagcgtattaagcccatcgacgttctgaacaataaggtggctaagttccgtaatgccacaaaccacaagtacgccaactacatcgtgcagcagtgcttaaagtacaattgcgggacgatacagcttgagaacttgcaagggatttccaaagagcagacgttccttaagaactggacctacttcgacctccaggaaaaaatcaagcagcaagcacaccagtacgggattaaggtcgtcacgatagacccatcctatacaagccagaggtgcagcgagtgtggctacatccacaagaacaacaggcagtcgcagtccactttcgagtgccagcagtgtaacctaaaagtgcacgctgactacaacgccgccaagaacatcagcatctacaatatcgagaaggtcatccagaaacagttgaagctacaggagaaactcaattccaagaaattcacagagcagtatatcgagcaaatcgagaacatcaactga

SEQ ID NO: 3087 - DNA, 1353 bp, Unknown
  Bacillus sp. multi
ctgagcacggtcgtgaaggtgatgaagtaccagatcgtgtgccctgtcaacatcgagtggaaagccttcgagacctacctgaggacgctctcctaccaagttcgtacaattgggaaccgcactatacagaagctgtgggacttcgacaaccagtcactaaaccacttccgcgagaacggtgtctatcctagcgcccagcagctctacggatgcacgcagaaaactatcagcggctacatctacgaccagctcaaggaggagtaccaggacattaacaaagccaatatgtcaactaccttacaaaaaaccatcaagacatggaactcccgcaagaaagagattcggtccggggagatgagcatcccgtcctttcgaaacaatctccccatcgacattcacggcaactctatacagataactaaggagaagtctggcgactacatcgcctcgctctccctgttcagttccaacttcattaaggagaacaatctgccaaacggcaaaatccaagtcaagctctccaccaggaagcagaactctatgaaggtgatactggacaggatcatcgagaacacatacgcaaaaggcgcgtgcatgttgcacaagcacaagaacaagtggtatctgtccatcatctacaagcctacagtcaaggaggagcataacttcgaggaagacctggtgatggggatcgacatgggaaagattaacgtcttgtacttcagtttcaacaagggttggattcggggagccatcagcggtgaggaaatcgaagccttccgcaagaagattgagcacaggcgcattagccttctccggcaagggaaatattgttctggaaaccgcgttgggaaagggagggagaagcggattaagcccatcgacgtcctcaacaacaaggttgccaaattcagaaatgcaacgaaccacaagtacgccaactacatcgtgcagcagtgcctcaagtacaattgtgggaccattcagttggagaatctccaggggataagcaaggagcagacattcctcaagaactggacctactttgacctccaggagaagattaaacaacaagcccatcagtacggcatcaaggttgtgactatcgacccctcatacaccagtcagcgctgctccgagtgcggttacatacacaaaaacaatcgtcaatctcagtccacgttcgagtgccagcagtgcaacctcaaagtgcacgccgactacaacgccgccaagaatatctctatctacaacatcgagaaggtcatccagaagcagctcaaactacaggaaaagctcaatagcaaaaagttcactgagcagtacatcgaacagatcgaaaacatcaactag

SEQ ID NO: 3088 - DNA, 1353 bp, Unknown
  Bacillus sp. multi
ctatccaccgtggtgaaagtgatgaagtaccaaatcgtttgccccgtcaacatcgagtggaaagccttcgaaacgtaccttcgaacgctctcataccaagtgcgtaccatcgggaaccggaccattcaaaagctgtgggacttcgataatcagtccttgaaccacttccgcgagaacggcgtttacccctctgcccagcagctctacggttgcacacagaagacaatctcaggctacatctacgaccagctcaaggaggagtaccaagacatcaacaaggccaatatgagtacaaccttgcagaagaccatcaagacatggaactcccgcaagaaagagattcgctctggtgagatgtccattccgtctttccgcaacaacttgcctattgacattcacggcaactcaatccagatcacgaaggaaaagtccggggactacatcgccagcctcagcctgtttagttccaacttcatcaaggaaaacaatctcccgaacgggaagatacaagttaaactgagcacacggaagcagaactccatgaaggtcatcctggaccggatcatcgagaacacttacgctaagggtgcctgcatgttacacaagcacaagaacaagtggtacttatctatcatctacaaacctaccgtgaaggaggagcacaacttcgaggaggacttagtgatgggaatcgacatgggcaagataaacgtactttacttctccttcaacaaggggtggatacgcggtgcaatcagcggcgaggagattgaggctttccgcaaaaaaatcgagcaccggcgtatctcacttctgagacaaggcaagtattgcagcggaaaccgggtggggaaagggcgcgagaagcgcatcaagccaattgacgtcttgaacaacaaggtggccaaattccgcaacgctaccaaccacaagtatgccaactacatcgtccagcagtgcttaaagtacaactgtggcacaatccagttggaaaacttgcaagggatttcgaaggagcagacgttccttaagaattggacgtacttcgacctccaggagaagatcaaacagcaagcgcaccagtacggcattaaggtcgtgaccatcgacccaagctacacaagccagaggtgctcagagtgcggctacatccacaagaataatcgccaaagtcagtcaacattcgagtgtcaacagtgcaacctcaaggtgcacgcggattacaacgccgctaagaacattagcatctacaacatcgagaaggttatccagaagcagctcaaactacaggagaagctcaactccaaaaagttcacggagcagtacatcgaacaaatcgagaacatcaactga

SEQ ID NO: 3089 - DNA, 1353 bp, Unknown
  Bacillus sp. multi
ctctctactgtcgtgaaggttatgaagtaccagatcgtctgccccgtgaacattgaatggaaagcgttcgagacctacctccgtaccctctcctaccaagttcggactatcgggaaccgcaccatccagaagctctgggacttcgacaatcagtcgcttaaccacttccgggagaatggtgtttacccaagcgcccaacagctttacggctgcacgcagaaaactatatcgggctatatctacgaccagctcaaggaggaataccaggacatcaataaggccaatatgtcaacaaccttgcagaaaaccatcaagacttggaacagtcgcaagaaggagatacgctcaggcgagatgtccatcccctccttccgtaacaacctgccaatcgacatccacggaaacagcattcagatcacgaaggagaaatcaggggactacattgcttcgctctcccttttcagcagcaactttatcaaggagaacaacctgccgaatggcaagatccaagttaagctgtccacccggaagcagaactccatgaaggtcatcttggacaggatcatcgagaatacttatgctaaaggtgcgtgcatgttgcacaagcacaagaacaagtggtatttgagcatcatctacaagcctacagtcaaggaggagcacaacttcgaggaggatcttgttatggggattgacatggggaagatcaacgttctctactttagtttcaacaaaggctggattcgaggagcgatctcaggcgaggagatcgaggcgttccgcaaaaagatcgagcacaggcggatcagcctcctgagacaggggaaatattgttccgggaaccgggtcggaaagggccgcgaaaagcgcatcaagcctattgacgtcctcaacaacaaagtagcgaagttccgcaacgccaccaaccacaaatacgctaactacattgtgcagcagtgcctcaagtacaactgcggcactatccagttggagaacctgcaagggataagcaaggagcagaccttcctcaagaactggacatacttcgacctccaggaaaaaatcaagcaacaagcacaccaatacgggatcaaggtggtgaccattgacccttcatacacttctcagaggtgctccgagtgcgggtacatacacaaaaacaatcgccagtctcagagtaccttcgagtgccagcagtgcaacctcaaggtccacgctgactacaacgccgccaagaacatcagcatctacaacattgaaaaggttattcagaagcagttaaagctacaggagaagctgaacagcaagaagtttactgagcagtacatcgagcagatcgagaacatcaactag

SEQ ID NO: 3090 - DNA, 1353 bp, Unknown
  Bacillus sp. multi
ctcagcatcgccgttaaggtcatgaagtaccagatcgtgtgcccagtcaacatcgagtggaagaccttcgagatatacctccgcaccctctcatatcacttccggacaatcggcaatcgcaccatccagaagctgtgggagtacgacaaccagtccctaaaacacttcaaagacaccgggcagtacccctcagctcaacagttgtacggctgcacacagaagacgatcagtggctacatctacgaccagctcaaagaggagtaccaggacatcaacaaggccaatatgtcaactactctacagaaaacaatccggacgtggaactcccgcaaaaaagagatttggagcggcgagatgtccataccgtctttccgcaacaacttgcccatcgacatccacggcaactccatccaaatcatcaaggagaagtccggcgactacatcgcctcagtctccctgtttagcagtaagttcattaaggaaaacgacttgcccaacgggaagatactcgttaagttatccacacgcaagcagaatagtatgaaggttatcctcgacaggatcattgacagcacttacgccaaaggggcctgcatgttgcacaagcacaagaaaaaatggtatctctctatcacctacaagtcgaacatcaaggaggagttgaaattcgacgaagaccttatcatggggattgacatggggaagatcaacgtgctatacttcgccttcaacaagggacttgttcggggcaccatcagcggcgaggagattgaagcgttccgcaagaagatcgagcacaggcgtatttccctcctgcgtcaaggcaagtattgcagtggaaaccgcattggcaagggccgcgagaagcgcatcaagccgatagacgtgctcaacgataaggttgccaagttcagaaacgccactaaccacaaatacgcaaactacattgtccagcagtgcctcaagtacaactgcggcaccatccagttggaagaccttaaggggattagcaaggagcaaacattccttaagaactggacctacttcgacctacaggagaagatcaaaaaccaggcgaaccagtacggggtgaaggttgtcaagatcgacccctcttacacaagccaacgttgctctgagtgcgagtacattcacaagaacaaccggcaagaccaaagtaccttcgagtgtcagcagtgctcgttcaaggtgcacgccgactacaacgccgctaagaatatctctgtgtacaacatcgagaaggtcatccagaagcaattggagttacaggagaaattgaatcagacgaagtacaaggaacagtacatcgagcagatgaagaatatcaactag

SEQ ID NO: 3091 - DNA, 1353 bp, Unknown
  Bacillus sp. multi
ctgagcatcgcagtgaaggtcatgaagtaccagatcgtctgtcctgtcaatatcgagtggaagacgttcgaaatctacttgagaacgctgtcctaccacttcagaaccattgggaatcgaaccatacagaagctctgggagtacgacaaccagtccctcaagcacttcaaggacacgggccaatacccctccgcccagcagctatatggctgcacacagaaaaccatcagcgggtacatatacgaccagctcaaggaggagtatcaggacatcaacaaagccaatatgagtacgactctccaaaaaacgatcagaacctggaactcccgcaagaaggagatttggagcggcgagatgtccatcccatccttccggaacaacttgcccattgatattcatggaaattccatccagatcatcaaggagaagtctggggactacatcgcatcggtgagcctgttcagctcgaagttcattaaggaaaacgacctgccaaacggcaagatactcgtcaaattgagtacaaggaaacaaaactccatgaaggtcattcttgaccgcattatcgacagcacatacgctaagggtgcctgcatgttgcataagcacaagaagaagtggtatctatcaatcacttacaagtccaacatcaaggaggaactaaagttcgacgaagacctcattatggggattgacatggggaagataaacgtgctctactttgctttcaacaagggcttagttcggggtacaatctcgggcgaggagatcgaagccttccgcaaaaaaatcgagcaccgccgaatatcactgctccgccagggcaagtactgttcggggaacaggatagggaaggggcgggagaagcgcatcaagcctatcgacgtgctgaacgacaaagttgccaaattccgcaatgccacaaaccacaagtacgcgaactacatcgtccagcagtgccttaagtacaattgcgggaccattcaattggaagatttgaaggggatcagcaaggagcagacattcctcaagaattggacctacttcgacctccaggaaaaaatcaagaatcaggccaaccagtacggggtgaaggtcgtgaagatcgacccctcctacacatcccagcggtgctctgagtgcgagtacatccacaagaataaccgtcaagaccagagtaccttcgagtgccaacagtgttccttcaaggtccacgcggactacaacgccgctaagaacatctccgtttacaacattgagaaggttattcagaagcaacttgagttacaggagaagctcaaccagaccaagtacaaagagcagtacatcgagcagatgaaaaacatcaactga

SEQ ID NO: 3092 - DNA, 1353 bp, Unknown
  Bacillus sp. multi
ctttccatcgcggtgaaggtcatgaagtaccagatcgtgtgcccagtgaacattgagtggaagaccttcgagatatacctgagaacccttagctaccactttcggactattggaaaccgcaccatccagaagctctgggagtacgacaaccagtctctcaagcactttaaggacacgggacagtacccctccgcccagcagctctacggctgcacccagaaaacgatctccggctatatctacgatcagttgaaggaggagtaccaggacattaacaaggccaatatgtcaactaccctccagaagaccatccgcacttggaactcccgcaagaaagagatatggagcggtgaaatgtctatcccctctttccgaaacaacctgcctattgatatacacggcaactcgatacagatcatcaaggagaagtctggagactacatcgcatctgtctccttgttctcctcaaagttcattaaggagaacgacctacccaacggcaagatcctggtgaagctgtcaacgcgcaagcagaacagtatgaaggtgattctggacaggataatcgacagcacctacgccaaaggcgcttgcatgttacacaagcacaagaagaagtggtatcttagtatcacctacaaaagcaacattaaggaggagttgaaattcgatgaagacctgattatgggaatagacatgggcaagataaacgttctgtacttcgcattcaacaagggccttgtgcggggcactatatccggggaggaaattgaagccttccgcaagaagatcgagcacaggcgtatctccctactgagacagggcaagtattgcagcggcaacaggatcggcaaagggcgtgagaagcgcatcaagccaattgacgttctaaacgacaaggtggccaagttccgaaacgcgactaaccacaagtatgccaactacatcgtccagcagtgcttgaagtacaactgcggcactatacagttggaggacttgaagggtatcagcaaggagcagacattccttaagaactggacgtactttgacctccaggagaagatcaaaaaccaggcgaaccagtacggggtgaaggtcgtcaagatagacccaagctatacgtcccagcggtgctccgagtgcgagtacatacacaagaacaaccgacaggaccagtccacctttgagtgccagcagtgctccttcaaggtgcacgctgactacaacgccgctaagaacatctcggtgtacaacatcgagaaggtcatccagaagcagctcgaattacaggagaagctcaatcagactaagtacaaggagcagtatatcgagcagatgaagaatatcaattga

SEQ ID NO: 3093 - DNA, 1353 bp, Unknown
  Bacillus sp. multi
ctgtcgatagccgttaaggtgatgaagtaccaaatcgtgtgcccggtgaacattgagtggaagaccttcgagatatacctcagaaccctctcctaccacttccggaccattggcaacaggaccatccagaagctctgggaatacgacaaccagtccctcaaacactttaaggataccggacagtacccgtccgcacagcagttgtacgggtgtacccagaagacgatcagcggctacatctatgaccagctcaaagaggagtaccaggacatcaacaaggccaatatgtccacaacactccagaagactatccgcacttggaactcccgcaagaaagagatttggagcggcgaaatgagcattccctccttccgtaacaatttgcccattgacatccacggaaattccatccagatcatcaaggaaaagtccggggactacatcgcatcagtctcgttgttctcctctaagttcatcaaggagaacgacctgccgaacggcaaaatcttggtgaaactatcaaccaggaagcagaactccatgaaggtgatcttggaccgcataatcgacagcacttacgcaaagggtgcctgcatgttacacaagcacaagaaaaaatggtatctgtctatcacctacaagagcaacattaaggaggagttgaaattcgacgaagacctcatcatggggatcgacatgggcaagattaacgtgctttacttcgccttcaacaagggactggtccgtggcaccatatctggggaggagatagaggctttccgcaagaagatagagcacaggcgcatatccctcctacggcaaggcaagtattgctccgggaaccgcattgggaaggggcgggagaagcgcatcaagcctatcgacgtcctgaacgacaaggtggctaagttcagaaatgccactaaccacaagtacgccaattacatcgtccaacagtgcttgaagtacaactgtggcactatccaactggaagatttgaaggggatctcaaaggagcagaccttcctcaagaattggacttacttcgacttacaggagaagatcaaaaaccaggcaaatcagtacggggttaaggtcgtgaagatcgaccccagctacacatcccagcgttgctccgagtgcgagtacatccacaagaacaaccgccaggaccagtccaccttcgagtgccagcagtgctcgttcaaggtccacgccgactacaatgcggctaagaacatctctgtgtacaatatcgagaaggtgatccagaagcagctagaactccaggagaagctcaatcagaccaagtacaaagagcagtacatcgagcagatgaaaaacatcaactga

SEQ ID NO: 3094 - DNA, 1353 bp, Unknown
  Bacillus sp. multi
ttgagtatcgcggtcaaagtcatgaagtaccagatcgtatgcccagtcaacatcgagtggaagacgttcgagatatacctccggacgctctcgtaccacttccgcaccatcggaaaccgcacgatccagaaactctgggagtacgacaaccagtccctcaagcacttcaaggacacgggccagtacccttccgcccaacaattgtacggctgcactcagaaaactatctccggctacatctacgaccagcttaaggaggagtaccaggacatcaacaaagccaatatgagcacgaccttgcaaaaaactatccggacctggaatagccgcaaaaaagagatttggagcggcgaaatgtccattccgtcattccgcaacaacttgcccatcgacatccacggcaactcgatccagatcattaaggagaagtccggtgactacatcgcaagtgtgtccctattctcctcaaagttcattaaggagaacgacctccctaacgggaagatactcgtgaagctatccactcgcaagcagaacagcatgaaggttattctggacaggataatcgactcaacttatgctaaaggggcctgcatgttgcacaagcacaagaagaaatggtacttgagtatcacatacaagtccaatatcaaggaggagttgaagttcgacgaagaccttatcatggggatcgacatggggaagattaacgtattgtactttgccttcaacaagggtcttgtgcgcgggactatctccggggaggaaattgaggctttccgcaagaagatcgagcacaggcgaatcagcctcctccgccaggggaagtactgttccggcaacagaatagggaaggggagggagaagcggatcaagcctatcgacgtcttaaatgacaaggtggccaaattccgaaatgccaccaaccacaagtatgctaactacattgtccagcagtgcctcaagtacaactgcgggaccatccagcttgaagacctcaagggtatttcgaaggagcagaccttcctcaagaactggacctatttcgacctacaggaaaaaatcaagaatcaggcgaaccagtatggcgtgaaggtcgtcaagatcgaccctagctacacctctcagaggtgctcggagtgcgagtacatccacaagaacaacagacaagatcagtcaaccttcgagtgccagcagtgcagcttcaaggttcacgcggactacaacgccgccaagaacataagcgtttacaatatcgaaaaggtgatccaaaagcaacttgaactacaggagaagttgaaccagaccaagtacaaggagcagtacatcgagcagatgaagaacattaactaa

SEQ ID NO: 3095 - DNA, 1353 bp, Unknown
  Bacillus sp. multi
ctgtcgcttgcggtcaaggtgatgaagtaccagatcgtgtgcccggtgaacgtggagtggaaagtgttcgaaacgtaccttcgcacgctcagttaccagagccgcacaatcgggaaccggacgatccagaagatttgggagttcgacaacctgagtctcaagcacttcaaggagactggcgagtacagctcagcacaacagctctacgggtgcacacagaaaaccatcagcgggtacatctacgaccagttgaaggaggagtacaaggacattaacaaagcgaatatgtcaacaactattcagaagacgcttaagaattggaactcacgcaagaaggagatttggagtggcgaaatgagcattccgtcattccgcaacaacctaccaatcgacatccacgggaactctatccagatcatcaaggagaaatccggagactacatcgcgtccgtgagcctgttcagtagcaagttcatcaaggaaaatgacttgccgaacgggaagattctagtgaagctgtccacgcgaaagcagaactccatgaaggtcatcttggaccgcataattgacagcacctacgcgaaaggagcgtgcatgttgcacaagcacaaaaagaagtggtacttgagtatcacatacaagtccaacatcaaggaggagttgaaattcgacgaagaccttatcatggggatcgacatgggcaagatcaacgtgctgtactttgccttcaacaagggcctcgtccggggcgctatcagcggcgaggaaatcgaagccttccgcaagaagatcgagcaccggagaatctcactcctgcgtcagggcaaatactgctctggaaacagaatcgggaaagggagggagaaacgcatcaagccaattgacgtgctcaacgacaaggttgccaagttccgtaatgccactaaccacaagtatgccaactacatcgtacagcagtgcctcaagtacaactgcggtacgattcaattggaagatttgaagggtatctcaaaggagcagacgttcctcaagaattggacctacttcgacctacaggaaaaaatcaagaatcaggcgaaccagtatggggtcaaggtggtcaagatcgaccccagctatacctcccagaggtgctcagagtgcggctacatccacaagaacaacagacaagaccaatccaccttcgaatgccagcagtgctcattcaaggtccacgcagactacaacgcggccaagaacatctccgtgtacaatatcgaaaaggtgatccagaagcagcttgaactacaggagaagctgaaccagacaaagtacaaggagcagtacatcgagcagatgaaaaacatcaactag

SEQ ID NO: 3096 - DNA, 1353 bp, Unknown
  Bacillus sp. multi
ctctccctggcggtgaaggttatgaagtaccaaatcgtctgccccgtgaacgttgagtggaaggttttcgagacgtacttacgcaccctgtcctaccagagccggaccatcggcaacaggaccatccaaaaaatctgggagttcgacaatctaagtcttaagcacttcaaggagactggagaatactccagcgcccagcagctttacggttgcactcagaagacgatctctggctatatctacgaccagctcaaggaggagtacaaagacatcaacaaggcgaatatgagcacgaccatccagaagacactcaagaactggaactcccgcaaaaaagagatttggagcggggagatgtccatccctagtttccgcaacaacctccccatcgacatccacggcaacagtatccagatcatcaaggagaaatctggggactacatcgccagtgtgtccctgttctcaagcaagttcatcaaggagaatgacctgcccaacggcaagatcctggtgaagctcagcacaaggaagcagaactctatgaaggtcatactcgaccgcatcatcgactcaacctacgcaaagggtgcctgcatgttacacaaacacaagaaaaagtggtatctgtctattacctacaagagcaacatcaaggaggaattgaaattcgacgaggatctcataatggggattgacatggggaagatcaacgttctctacttcgctttcaacaagggtctggttcgcggcgcgataagcggtgaggagatcgaggctttccgcaagaaaatcgagcaccggcgtatctcgctcttgcgccagggcaaatactgttcggggaaccgtatcggcaaggggcgtgagaaacgcattaagccaatcgacgtgctgaacgacaaggtggcgaagttccgtaatgcgaccaaccacaagtacgccaactacattgttcagcaatgcttgaagtacaactgcggaaccattcagttggaggacttaaagggtatttcgaaggagcagaccttcctcaagaactggacatacttcgatctacaggagaagatcaaaaaccaggcaaaccagtacggggtgaaggtggtgaagattgacccctcctacacaagtcagaggtgcagcgagtgtggctacatccacaagaacaacagacaggaccagtccactttcgagtgccagcagtgcagcttcaaggtgcacgcagactacaacgccgccaagaacatctcggtgtacaacatcgagaaggtcattcagaagcagcttgaactccaggagaagctgaaccagactaagtacaaggagcagtacatcgaacagatgaagaacattaactga

SEQ ID NO: 3097 - DNA, 1353 bp, Unknown
  Bacillus sp. multi
ctcagcctggccgtgaaggtgatgaagtaccaaatagtatgtcctgtcaatgtggagtggaaggtcttcgagacgtacctccgaaccctcagctaccagtcgcgcaccatcgggaatcgcaccatccagaagatttgggagttcgacaacctctccctcaagcacttcaaggagaccggcgaatactcatccgcgcagcagctctacggttgcacccagaagaccatctctggctacatctatgaccaactcaaagaggagtacaaggacattaacaaagccaatatgagtacaactatccagaagacactcaagaactggaactctcgcaagaaggagatttggagtggggagatgagcatccccagtttccgcaacaacctccctattgacattcacgggaacagcatccagatcatcaaggagaagtctggagactatatcgcttctgtgagcctgttctctagcaagttcatcaaggaaaacgacctaccaaacggcaagatactcgtgaagctatctacccggaaacaaaacagcatgaaggtcatcctggaccggatcatcgacagtacctacgcaaagggcgcgtgcatgttgcacaagcacaagaagaagtggtacttgagtatcacctacaagagcaacatcaaggaggagttgaagttcgacgaagacctcatcatgggaattgatatgggcaagatcaacgtgctatacttcgccttcaacaagggtctggtccgtggggctatctcaggggaggagattgaggcgttccgcaaaaaaatcgagcacaggcgcatctcactcttgcgccaggggaagtactgttcgggaaaccgcatcggcaagggtcgggagaagcgcattaagccaatcgacgtcctaaacgacaaggtggcgaagttccgtaacgcgaccaaccacaagtatgctaactacatcgtgcagcagtgccttaagtacaactgtggcacaattcagctcgaagacctaaagggcatctccaaagagcaaactttcctcaagaactggacgtacttcgacctccaggagaagatcaaaaaccaggccaaccagtatggcgtgaaggtcgtgaagatcgacccgtcctacacatctcagaggtgtagcgagtgcggttacatccacaagaataaccgacaagaccagtccaccttcgagtgccagcagtgctccttcaaagtccatgccgactacaacgctgccaagaacatctctgtgtacaacatcgagaaggtgatccagaagcagttggagttacaggagaaactcaaccagaccaagtacaaagagcagtatatcgaacagatgaaaaacatcaactga

SEQ ID NO: 3098 - DNA, 1353 bp, Unknown
  Bacillus sp. multi
ctttcactagctgtcaaggttatgaagtaccagatcgtgtgccccgtgaacgtggagtggaaggtgttcgagacctaccttcggaccctctcctaccagagccgtaccatcgggaaccgcaccatccagaaaatctgggagttcgacaacttgagcctcaagcacttcaaggagacaggggagtacagcagtgcccagcaactatacggctgcacccagaaaactatctccgggtacatctacgaccagctcaaggaggagtacaaggacatcaacaaggcgaatatgtcaactacgatacagaaaactctcaagaactggaactcccgcaagaaagagatatggagcggggagatgtcaattccctcattccgaaacaacctacccattgatattcacgggaatagtatccagatcatcaaggaaaagtcaggcgattacattgcatcagtctctctgttcagcagcaagttcatcaaggagaacgacttgccaaacggaaagatcctcgtgaagctgtccacccgcaagcagaacagcatgaaggtgatacttgatcgcatcattgactcaacctacgcaaagggagcctgcatgttgcacaagcacaagaagaagtggtacttatccattacctacaagagtaacattaaggaggagttgaaattcgacgaagacctcatcatgggcatcgacatggggaagatcaatgtcctctactttgccttcaacaagggcttggtccgtggcgctatctctggtgaggagatcgaagcgttccgcaagaagatcgagcaccggcgcatctcgctcctcagacaggggaaatattgctccggcaaccggattggaaaagggcgtgaaaagcggatcaagcccattgacgtgcttaacgacaaggtggccaaattccgcaacgccacgaatcacaaatacgcaaactacatcgtgcagcagtgccttaagtacaactgcgggaccatccagttggaggacttgaagggcatctcaaaggagcagaccttccttaagaactggacttactttgacctacaggagaagatcaaaaaccaggcgaaccagtacggcgtgaaggtcgtgaagattgaccccagctacaccagtcagcgctgctccgagtgcgggtacatacacaagaacaaccgacaagaccagtcaacattcgagtgccagcagtgcagtttcaaagttcacgcagactacaatgcggccaagaacattagcgtttacaacatcgagaaggtcatccagaaacagttggagctacaggagaaactcaaccagaccaagtacaaggagcagtacatcgaacagatgaaaaatatcaactag

SEQ ID NO: 3099 - DNA, 1353 bp, Unknown
  Bacillus sp. multi
ctatccctcgcagtgaaggtcatgaagtaccagatcgtgtgcccggtgaacgttgagtggaaggttttcgagacgtacctgcggaccctgagctaccaaagccgaaccatcgggaaccgtacaattcagaagatttgggagttcgacaacctcagccttaagcacttcaaggagaccggggaatactccagcgcccaacagctctacggctgcacgcagaaaacaatcagcggttacatatacgaccaattgaaagaggagtacaaggacattaacaaggccaacatgagtaccaccatccagaaaaccctcaagaactggaactcccgcaagaaagagatttggagcggagagatgagcattcccagtttcagaaacaatctaccaattgacatacacggaaattccattcagatcatcaaggagaaatctggggactacattgccagcgtaagtctgttcagcagcaagttcatcaaggagaatgacctgccaaacgggaagattctcgttaagctatctacgcgcaagcaaaactccatgaaggtcatcctggatcgcattatcgactctacctacgctaaaggggcttgcatgttgcacaagcacaaaaagaaatggtacttgagtatcacatacaagtcgaacatcaaggaggagctaaagttcgacgaggacttgataatgggaatagacatggggaagataaacgtgctctacttcgccttcaacaagggactcgtgcgcggggctatcagtggtgaggagatcgaagcgttccgcaagaagattgagcaccgacggatctcacttctccgacagggaaagtattgctcgggaaaccgcatcgggaaggggcgcgagaagcgcatcaagcctatcgacgtgctgaacgataaggtggccaagttccgcaacgcgacgaaccacaagtatgcgaactacatcgtgcagcagtgccttaagtacaactgcggcactatacaattggaagacttgaagggcatctctaaggagcagacgttccttaagaattggacgtacttcgacctccaggagaagatcaaaaaccaggctaaccagtacggcgtcaaagttgtgaagatcgaccctagctacacatctcagagatgctcagagtgcggttacatccacaagaacaaccgtcaagatcagagcacgtttgagtgccagcagtgctcgtttaaagtccacgccgactacaacgcagccaagaacatcagcgtgtacaacatcgagaaggtgattcagaagcagctagagttacaggagaagttgaaccagaccaagtacaaggaacagtacatcgagcagatgaagaacattaactga

SEQ ID NO: 3100 - DNA, 1353 bp, Unknown
  Bacillus sp. multi
ctctcgattgcagtgaaggtcatgaagtaccagatcgtttgccccgtcaacatcgagtggaagacctttgaaatctacctacgaaccctctcctaccacttccgtacgattggaaatcgcactatccagaagctctgggagtacgataaccagtcccttaagcacttcaaagacactgggcagtacccctccgcccagcagctctacggctgcacccagaaaactatcagcggctacatctacgaccagcttaaggaggaataccaggacattaacaaagcgaacatgagtacaaccctccagaaaacaatccgtacctggaactcccgcaagaaagagatttggagtggagagatgtccatcccgtccttcagaaacaacctgccaattgacatacacgggaactccatccagatcatcaaggagaagtcaggcgactacattgcctccgtgtccctgttctcctctaagttcattaaggagaacgacctgcccgatgggaagattctcgtcaagttgtcaactcgcaagcagaacagtatgaaggtcatattggacaggatcattgactccacgtacgcgaaaggagcctgcatgttgcacaaacacaaaaaaaagtggtacttgagtattacttacaagagcaacatcaaggaggaattgaagttcgacgaagacctgataatgggaatagacatgggcaagattaacgtgctgtacttcgctttcaacaaggggctcgtgcgcggtgccatctccggggaggagatcgaagccttccgcaagaagattgagcaccgccgaatctccctcctcagacaagggaagtactgttccgggaatcggatcggcaagggccgggagaagcggatcaagccaatcgacgttctcaacgacaaagtggctaagttccgtaacgccaccaaccacaagtacgccaactatatcgtgcagcagtgcttaaagtacaactgcggcaccatccagctcgaagacttgaagggaatatccaaagagcagacgttcctcaagaactggacctacttcgacctccaggagaagatcaaaaaccaggccaaccagtacggggtgaaagtcgtcaagatcgacccgtcatacacatctcaacgttgcagtgagtgcgagtacattcacaagaacaaccgtcaggatcaatccactttcgagtgccagcagtgcagcttcaaggttcacgcggactacaacgccgccaagaacatatcagtgtacaatatcgagaaggtcatccagaaacagcttgaactacaggagaaactgaaccagaccaagtacaaggagcagtacattgagcagatgaagaacattaactga

SEQ ID NO: 3101 - DNA, 1353 bp, Unknown
  Bacillus sp. multi
ctctccattgcagtcaaggtcatgaagtaccaaattgtctgcccggtgaacattgagtggaagacgttcgaaatctacttacggacgctcagctaccacttccgcaccattggcaacagaaccatccagaaactctgggaatacgacaaccagtctctcaagcactttaaagatacaggccagtacccctccgcccagcagctttacgggtgcactcaaaaaactatctccggctacatctacgaccagcttaaggaggagtaccaagatattaacaaagcgaatatgtcaaccaccttgcagaaaacaatccggacttggaactcccgcaagaaggagatttggagcggcgagatgtcaatcccgtccttcagaaacaacctgccaatcgacattcatgggaactccattcagatcatcaaggagaaaagcggggactacattgcctctgtcagtctattctccagcaaattcatcaaggagaacgacctgcccgacgggaagattctcgtgaagctatccactcgtaagcagaactcgatgaaggtgatcctggaccgcatcatcgactctacctacgcgaagggtgcctgcatgttacacaagcacaagaagaaatggtatctctccattacttacaaaagcaacatcaaggaggagcttaagttcgacgaggacttgataatgggaatagacatggggaagatcaacgtgctctactttgcgttcaacaaggggcttgtgcgtggggctatttccggtgaggaaatcgaggcgttccgcaagaagatagagcacaggcgtattagcctcctccgacaggggaaatactgctctggcaaccggattggcaaggggcgcgagaagcgtatcaagcccatcgacgtgctgaatgacaaggtggctaagttccgcaacgccaccaatcataagtacgccaactacattgtccagcagtgcctcaagtacaattgcgggaccatccagcttgaagacttgaaagggatctctaaggagcagaccttcctcaagaattggacttacttcgacctccaggaaaaaatcaagaatcaggctaatcagtacggggtgaaggtggtgaagatcgaccccagctacacctcccagcgctgctcagagtgtgagtacatccacaagaataaccgccaggaccagagtaccttcgagtgccagcagtgctccttcaaggttcacgcagactacaacgccgccaagaatatcagcgtgtacaatatcgagaaggttatccagaagcagctcgaactccaggagaagctcaaccagactaagtacaaggaacagtacattgagcagatgaagaatatcaattga

SEQ ID NO: 3102 - DNA, 1353 bp, Unknown
  Bacillus sp. multi
ttgtcgatagcggttaaggtgatgaagtaccaaattgtctgtccagtaaacatcgaatggaagaccttcgagatataccttcgaaccctcagctaccactttcgcaccatcggaaaccgtaccatccagaaactctgggagtatgacaaccagtcccttaagcacttcaaggataccggacagtacccctcggcccaacaactctacggttgtactcaaaaaacaatctccggctacatctatgaccaacttaaggaggagtaccaggacatcaacaaggccaatatgtcaacaacgctccagaaaacaatacggacatggaacagtcgcaagaaggaaatctggagtggcgagatgagcatcccctcctttcgtaacaacctgccaatcgacattcacgggaactctattcaaatcatcaaggagaaatcaggggactacatcgcatcagtgagcctgtttagtagcaagttcatcaaggagaatgacctcccagacgggaagatcctcgtaaagctctctacgaggaagcagaacagcatgaaggttatcctagaccgcataatcgactcaacctacgctaaaggagcgtgcatgttgcacaagcacaagaagaagtggtacttgtctattacctacaagtccaacatcaaggaggagttgaagttcgacgaagacctcatcatgggaattgacatgggcaagatcaacgtgctatacttcgccttcaacaaggggctcgtgcgaggcgcgatctcgggcgaggagattgaagcgttccgcaaaaaaatcgagcaccgccgtatctccttattgcgccaggggaaatattgcagtggaaaccgcattggaaaaggccgcgagaaacgcatcaagccaatcgacgtgctgaacgacaaggttgcaaagttccgaaacgccacgaaccacaagtacgcgaactacatcgtgcagcagtgcctaaagtacaactgcgggacaatccagcttgaggacttgaaggggatctcaaaggagcagaccttcctcaagaactggacctacttcgacctacaggagaagatcaaaaaccaggccaaccagtacggcgtcaaggtggtgaagatcgacccaagctacacgagccaacgttgctccgagtgcgagtacatccacaagaacaaccgacaagaccaatccacctttgagtgtcagcagtgcagcttcaaggtgcacgccgactacaacgcagctaagaacatatcagtgtacaacattgagaaggtcattcagaagcagcttgaactacaggagaagctcaaccagacaaagtacaaggagcagtacatcgaacagatgaagaacattaactga

SEQ ID NO: 3103 - DNA, 1353 bp, Unknown
  Bacillus sp. multi
ctgtccatcgcggtcaaggtgatgaagtaccagatcgtttgccccgtgaacatcgagtggaagaccttcgaaatctacctcagaacattatcttatcacttccggacaatcggcaaccgcaccatacagaaactctgggaatacgacaaccagagcttaaagcacttcaaggacaccggtcaatacccctctgcccagcagctctacgggtgcacgcagaaaaccatctcggggtacatctacgaccaactcaaggaggagtaccaggacattaacaaggccaatatgagcaccactctccagaaaaccattcgcacttggaactcccgcaagaaagagatatggagtggagaaatgtctatcccgtcattccggaacaacttgcctattgacattcacgggaactcaatccagatcatcaaggagaagtctggggactacatcgcctcggtgtccctctttagctccaagttcatcaaggagaacgacttgcctgacgggaagatactggttaaactatccaccaggaagcagaactccatgaaggtgatacttgaccgcataatcgactcgacgtacgcgaaaggtgcgtgcatgttgcataagcacaagaagaagtggtatctgagcattacctacaagtcgaacatcaaggaggagcttaagttcgacgaagacctcataatggggatagacatgggcaagatcaacgtgctttacttcgcgttcaacaagggacttgtgcgaggcgctatcagcggggaggagatcgaggcgttccgcaaaaaaatcgagcatcgccgaatcagcctgttgagacaagggaaatattgctccggaaacaggatagggaagggccgcgagaagcggattaagcccatcgacgtccttaacgacaaagttgcaaagttccgaaacgctaccaaccacaagtatgccaactatatcgtgcagcagtgcctcaagtacaactgcgggacgatacagcttgaggatcttaagggcatatctaaggagcagacgttcctcaagaattggacctacttcgacctacaggaaaaaatcaagaaccaggccaaccagtatggggtcaaggttgtcaagattgacccttcctatacgtcgcagagatgctccgagtgtgagtacatacacaagaacaacagacaagatcagtcaaccttcgagtgccaacagtgctccttcaaggtgcacgctgactacaacgcggccaagaacatctccgtgtacaacatcgagaaggtgattcagaaacaactggagttacaggagaagttgaaccagaccaagtacaaagagcagtacatcgagcagatgaaaaacatcaactga

SEQ ID NO: 3104 - DNA, 1353 bp, Unknown
  Bacillus sp. multi
ctgtcaattgccgtcaaggtgatgaagtatcagatagtctgccccgtgaacatcgagtggaagaccttcgagatatacctccgcaccctttcctaccacttcagaaccatcggcaaccgcaccatacagaagctctgggaatatgacaaccagtccctcaagcacttcaaagacaccgggcagtacccgagcgcccagcagctctacggatgcacacagaaaactatctctggctacatctacgaccaactcaaggaggagtatcaggacatcaacaaggccaatatgtccactaccctacagaagactatccggacatggaactcacgcaagaaagagatttggagcggagagatgtccattcccagcttccgcaacaacctacccatcgacatccacggaaattccatccagatcatcaaggagaagtctggtgactacattgcatcagtctccttattcagttcgaaattcatcaaggagaatgacctcccggatggcaagattctggtgaagctctctacgaggaagcagaactccatgaaggtgattctggaccgaatcatcgactccacgtacgcaaagggtgcgtgcatgttgcacaagcacaaaaagaaatggtacttatccatcacatacaagtccaacatcaaggaggagttgaaattcgacgaagacctgattatggggatcgacatgggcaagatcaacgtactgtacttcgccttcaacaaggggcttgtccgtggagctatctctggggaggagattgaggcgtttcgcaagaagattgagcaccgccgcatcagcctgttgcgacaggggaagtattgctccggcaacaggatcgggaaagggcgtgagaagcggattaagcccattgacgtgctcaacgacaaggttgcaaagttccgtaatgccacaaaccacaagtacgccaactacatcgtgcagcagtgcttgaagtacaactgtggcactattcaattggaagacctcaaagggatcagtaaggaacagacgttcctcaagaattggacatactttgacctacaggagaagatcaaaaaccaggccaaccagtacggagtcaaggtggtgaagatcgaccccagttacaccagccagcgatgcagcgaatgcgagtacatccataagaacaacagacaggaccaatccaccttcgagtgccagcagtgctccttcaaggttcacgcagattacaacgcggctaagaacatatctgtgtacaacatcgagaaggtcatccagaagcagttggaactccaggagaagctgaatcagactaagtacaaggaacagtacatcgaacagatgaaaaatatcaactga

SEQ ID NO: 3105 - DNA, 1332 bp, Unknown
  Bacillus sp. multi
atgaagtaccagatcgtctgcccggtgaacgtggagtggaaggttttcgagacgtacttgcgaaccctctcctaccagtcccggaccattgggaatcggaccatccagaagatttgggagtttgacaacctcagcctgaaacacttcaaggagaccggcgagtaccctagcgcccagcagctctatggttgcactcagaaaacaatcagcggctacatatacgaccaacttaaagaggagtacaaggacattaacaaagccaatatgtcaacaaccatccagaagactctcaagaactggaactcccgcaaaaaggaaatctggcgcggggagatgtccatcccctccttccgttcggacctgcccatcgacatccacggaaatagcattcaactgattaaggagaagggcggcgactacatcgcgtccgtcagcctctttagtagcaaattcatcaaggagaatgatctgccgaacggcaagatcctggtcaagctcagcactaggaagcaaaactcgatgaaggtgatcctcgataggctcatcaactctacctacagtaaaggcgcgtgcatgttccacaagcacaagaaaaagtggtacttgtcaatcacttacaaaagcaacatcaaggaggaattgaaattcgacgaggacttgataatggggatcgacatggggaagattaacgtgctttacttcacgttcaacaaagggctagttcgtggaaccatcagtggggaggagattgaggcttttcgcaaaaagatcgagcacaggcgcatctccctgctcaggcaaggcaagtattgctctgggaaccggatcgggaagggaagggagaagcgtatcaagcctattgacgtgctaaacgacaaggtggccaagttccgaaacgccaccaaccacaagtacgcgaactacatcgtgcagcagtgcctcaagtacaactgtggaactatccagcttgaagacttgaagggaatcagcaaggagcagactttcctcaagaattggacatacttcgatctccaggaaaaaatcaagaatcaggcgaatcagtacggcgtcaaggtggttaagatcgacccctcctatacttcccagcggtgctcggagtgcgggtacatccacaaggacaaccgacaggaccagtccaccttcgaatgcctccagtgctcgttcaaggttcatgcagactacaacgcggctaagaacatatcagtccacaatatcgaaaaggttatccagaagcaactggaactacaggagaaactcaaccttactaagtacaaggagcactacatcgagcagatgaaaaacatcaattga

SEQ ID NO: 3106 - DNA, 1332 bp, Unknown
  Bacillus sp. multi
atgaagtaccagatcgtgtgccccgtgaatgtagaatggaaggtgttcgagacttacctcagaaccctcagctaccagtcgcgtaccattgggaaccgcaccatacagaagatttgggagttcgacaacctgtcccttaagcacttcaaggagacgggagaatacccctcagctcagcagctctacggctgcacccaaaaaacaatctcaggctacatctacgatcagctcaaggaggagtacaaggacattaacaaggcaaacatgagcaccacgatacaaaaaactctcaagaactggaatagtcgcaaaaaggagatttggaggggcgagatgtcgatcccgtccttccgaagtgacctgcccattgacattcacggaaatagcattcagctcatcaaggagaagggcggcgattacatcgcgtctgtctcgttgttcagtagcaaattcatcaaggaaaatgacctcccaaacgggaagatcctagtgaagctctccactcgcaagcaaaacagtatgaaggttattctcgaccgtctcatcaactctacctactcaaagggcgcttgcatgttccacaaacacaagaagaaatggtatctgtccatcacctacaagtcgaacatcaaggaggagttgaagttcgatgaagacctaatcatgggcattgacatggggaagattaacgttctctacttcaccttcaataaggggcttgtcaggggcaccatcagtggggaggagatcgaggcgttccgcaaaaagatcgagcaccggcggatctccctcttgcgccaggggaagtactgctctgggaaccgcatagggaaggggcgtgaaaagcggatcaagcctattgacgtgctaaacgacaaggtggccaaattccgtaacgctacaaatcacaaatacgcgaactacatcgtccagcagtgcttgaagtacaactgcggcaccatccagctcgaagaccttaaagggattagcaaggagcagacattcctcaagaattggacctacttcgacctacaggagaagatcaaaaaccaggcaaaccagtatggggtgaaggtggtgaagattgacccctcctacacctcacaacgctgctccgaatgcgggtacatccacaaagacaaccgccaggaccagtcaactttcgagtgcctacaatgcagcttcaaagtgcacgccgactacaacgcggccaagaacatatcagtgcacaacatcgagaaggttattcagaagcagctcgaactacaggagaaactcaacctgaccaagtacaaggagcactacattgaacagatgaagaacattaactga

SEQ ID NO: 3107 - DNA, 1332 bp, Unknown
  Bacillus sp. multi
atgaagtaccagatcgtgtgtcccgtgaacgtggagtggaaagtgttcgagacctacctcagaacgctttcctaccagtcccgaaccattggaaaccggaccatacaaaaaatctgggagtttgacaacttgtccctcaagcacttcaaggagacgggagagtacccctcagcccagcagctctacgggtgcacgcagaagaccatctctggctacatctacgaccaattgaaggaggagtacaaggatattaacaaagccaacatgagcaccactatccagaagacgctcaagaattggaactcccgcaagaaagagatttggcgcggtgagatgtccatcccgagcttccggtccgacttgcctattgacattcacgggaactccattcagctcatcaaggagaagggaggggactatatcgcttcggtgagcctgttctcatccaaattcatcaaggagaacgatctgcctaacggcaagatcctggtgaagctgtccactcgcaagcagaacagcatgaaggttatcctcgaccgtctcattaactctacctactctaaaggtgcctgcatgttccacaagcacaagaaaaagtggtacttgtccattacatacaagagcaacatcaaggaggagcttaagttcgatgaagacctcataatggggatcgacatggggaagatcaacgtattgtactttacgttcaacaagggtctggtcaggggcaccatctccggggaggagatcgaggcgttccgcaagaaaatcgagcacagacgtatctctctcctccgtcaggggaaatactgctctggaaaccgtattggaaaggggcgggagaagcgcatcaagcctattgacgtgctgaatgataaggtggccaaattccgtaacgccaccaaccacaagtacgctaactacatcgtgcagcagtgcctcaagtacaactgcggcactatccagcttgaagatttgaagggcatcagcaaagagcagacattccttaagaactggacctacttcgacctccaggagaagatcaaaaaccaggcgaaccagtacggggtgaaggtggtgaagattgacccgagctataccagccagcggtgctccgaatgcgggtacattcacaaggataaccgtcaggaccagtccacgttcgagtgcctacaatgctccttcaaggtccacgcggactacaacgccgctaagaacatctctgtgcataacatcgaaaaggtgatccagaaacagctcgaactccaggagaagttgaacttgactaagtacaaggagcactacatcgagcagatgaagaacatcaactga

SEQ ID NO: 3108 - DNA, 1332 bp, Unknown
  Bacillus sp. multi
atgaagtaccaaatcgtatgtccggtgaacgtcgagtggaaggtcttcgaaacttacctgcggactctcagctaccagagtcgaaccatcggaaacaggaccattcagaagatatgggagttcgacaacctcagcctcaagcactttaaggagacgggagagtacccctccgcccagcagctctacggttgcacacagaagacgatctccggctacatctacgaccaactcaaggaggagtacaaggacattaacaaggcgaacatgagtaccacgattcagaaaactctcaagaactggaactctcgcaaaaaggagatttggcgcggcgagatgagcattccgtccttccgcagcgacctgcctattgatatacacgggaactctatccagctcatcaaggagaagggtggcgactacattgcgagtgtttcccttttcagtagtaagttcatcaaggagaacgaccttccgaacggcaagattcttgtgaagctctccacccgaaaacagaacagcatgaaggtgatcttggaccggcttattaactcgacgtacagcaaaggggcgtgcatgttccacaagcacaagaagaaatggtacttgagtatcacctacaagagcaacatcaaggaggagttgaagttcgacgaagaccttatcatggggattgacatggggaagatcaacgtgctctacttcacattcaacaagggcctagtgcgagggactatctctggcgaggaaatcgaagcctttcgcaagaaaatcgagcacaggcgcataagcctcctccgtcaggggaagtactgttctggcaaccgaattggaaaggggagggagaagcgtatcaagcccatcgacgtcctcaacgataaggttgccaagttccgtaacgctactaaccacaagtacgctaactacatcgtacagcagtgcttgaagtacaattgcgggaccattcaattggaggacttgaaaggaatctcgaaggagcagactttcctcaagaattggacctactttgacctccaggagaagatcaaaaaccaggccaatcagtacggcgttaaggtcgtcaagatagacccctcatacacaagtcagaggtgctccgagtgcggctacatccacaaggacaaccgacaagaccaatcgactttcgagtgcctccagtgctcattcaaggtccacgcggactacaacgccgctaagaatatctccgtccataacatcgagaaggtcattcagaagcaacttgagttacaggagaaactcaaccttacgaagtacaaagagcactacatcgagcagatgaagaatatcaactga

SEQ ID NO: 3109 - DNA, 1332 bp, Unknown
  Bacillus sp. multi
atgaagtaccagatcgtgtgccccgtgaacgtggagtggaaggttttcgaaacctacctccggacattgagctaccagtcccgaacaattggaaaccgaaccatccagaagatttgggagttcgacaacctctccctcaaacacttcaaggagaccggcgagtacccctcagcccagcagctctacggctgcacccagaagacaatctcaggctacatctacgaccagctcaaggaggagtacaaggacattaacaaggccaatatgagcaccaccatccaaaaaaccctcaagaactggaatagccgcaagaaggagatttggcgcggcgagatgagcatcccctcctttcgatccgacctcccaatcgacattcacggaaacagcattcagcttattaaggagaagggtggcgactacattgcatctgtcagcttgttctctagcaaattcatcaaggagaacgacttacctaacgggaagatcctggtcaagctctccaccaggaagcagaacagcatgaaggtcatcctggaccgactcatcaacagcacttacagcaagggagcctgcatgttccataagcacaaaaaaaaatggtatcttagtatcacatacaagtcaaacattaaggaggagttgaaattcgacgaggacttgataatgggcatcgacatgggcaagataaacgtcttgtacttcacgttcaacaagggcctcgtgcgagggaccataagcggcgaggagatagaggctttccgcaagaaaatcgagcatcgcagaatatcattgcttagacagggcaaatattgttctggcaaccgcattggcaagggccgtgaaaagcgtattaagccgattgacgttctgaacgacaaggtggccaagttccgcaacgcaacaaatcacaagtacgcaaactacatcgtccaacagtgcttaaagtacaactgtggcacaatccagttggaagacctcaaggggattagcaaggagcagactttcctcaagaattggacgtacttcgacctacaggagaagatcaaaaaccaggccaaccagtacggggtgaaggtggtcaagatagaccccagctacacctcccagaggtgctcagagtgcgggtacatccacaaggacaacagacaagaccagagcaccttcgagtgccttcagtgcagtttcaaagttcacgccgactacaacgcggctaagaacatcagcgttcacaacattgaaaaggtgatccagaagcaacttgaactccaggagaagctcaacctgactaagtacaaggagcactacatcgagcagatgaagaacatcaactga

SEQ ID NO: 3110 - DNA, 1353 bp, Unknown
  Bacillus sp. multi
ctcagcatcgcggtgaaggtgatgaagtaccagatcgtgtgccccgtgaatatcgagtggaagaccttcgagatatacctccgtaccctcagctatcacttccggaccatcgggaaccggaccatccaaaagctctgggagtacgacaaccagtcattgaagcactttaaagacaccggccagtacccctctgctcagcagctctacggctgcacccagaagacaatctcgggctacatctacgaccagttgaaggaggagtaccaggatattaacaaggcgaatatgagtacgacgctccagaaaaccatccgtacttggaactctcgcaagaaggagatttggagtggcgagatgagtattccgtccttccgcaacaacctgccgattgacatccacggcaactcaatccagatcatcaaggagaagtccggagactatatcgcgtcagtgtcactattctcctcgaagttcatcaaggagaacgacttgcccaacgggaagattctggtgaaattgtccactaggaagcagaacagtatgaaggtgatactcgacagaatcatcgactctacctatgctaaaggggcgtgcatgttgcacaagcacaagaaaaagtggtatctatccatcacttacaagagcaacattaaggaggaattgaagttcgacgaggacttaatcatggggattgacatgggaaagatcaacgtgctctacttcgccttcaataagggtcttgtgaggggagctatctctggcgaggagatcgaagcgtttcgcaagaagattgagcataggcgtatttcgctcttaagacaggggaaatattgctccggcaaccgcatcggcaagggtagggagaagcgcatcaagcccatcgacgtgctgaatgacaaggtggccaagttccgcaacgccacaaaccacaagtacgccaactatatcgtccagcagtgtctcaagtacaactgcgggaccattcacttggaggatctaaaggggatcagtaaggaacagactttccttaagaactggacttacttcgacctccaggagaagatcaaaaaccaggccaaccagtacggggtcaaggtcgtgaagatcgacccgtcctacacctctcagcggtgctccgagtgcgggtacatccacaagaacaaccggcaagatcaatcgaccttcgagtgtcagcagtgctccttcaaggtgcacgctgactacaacgcagccaagaacatatcggtgtacaacatcgagaaggtgatccagaagcagcttgaactacaggagaagctgaaccagactaagtacaaggagcagtacatcgagcagatgaagaatatcaactaa

SEQ ID NO: 3111 - DNA, 1353 bp, Unknown
  Bacillus sp. multi
ttgtctatagccgtgaaggttatgaagtaccaaatcgtctgtcccgtcaacatcgagtggaagaccttcgaaatctacttgcgaacactcagctaccactttcgcaccatcgggaaccggaccatccagaaactgtgggagtacgacaaccagtccctcaagcacttcaaggacaccggccagtatccctccgcgcagcagctatacggctgcacccagaaaacaatctcggggtacatctacgaccagctcaaggaggagtaccaggacatcaacaaggcaaacatgagtacgacactccagaaaacaatccgaacctggaacagccgcaagaaagagatttggagcggggagatgagcatcccgtcattccggaacaacctcccaatcgacatccacggaaacagcattcagatcatcaaggagaagtccggggactacattgcatctgtgtccttattctcaagcaaattcatcaaggaaaacgatctgcccaacgggaagatcctcgttaagctctctactcggaagcagaacagcatgaaggtgatcctagacagaatcatcgactcgacctacgcgaaaggagcctgcatgttacacaaacacaagaaaaagtggtacttatcaatcacttacaagtccaacatcaaggaggagttgaaattcgacgaagacctaatcatggggatagacatggggaagattaacgtgctatactttgccttcaacaagggcctagtaagaggggcgatctcgggcgaggaaatcgaggcttttcgcaagaaaattgagcaccggcgtatctcactccttagacagggcaagtattgcagcggcaaccgaattggaaagggccgcgagaagcgcatcaagccgattgacgtgctcaacgacaaggttgccaagttccgtaacgcgaccaaccacaagtacgcaaactacattgtgcagcagtgcctcaagtacaattgtggaactatacacttggaagacttgaaagggattagcaaggaacagacgttcctcaagaattggacgtacttcgatctccaggagaagatcaaaaaccaggcgaaccagtacggggtgaaggtggtcaagattgacccgtcctacaccagtcagagatgctctgagtgcggttacatacacaagaacaatcgtcaggaccagtccacgttcgagtgccagcagtgcagcttcaaggtccatgctgactacaacgcggctaagaacatcagcgtttacaacatcgaaaaggtcatccagaagcagctcgaattacaggagaaactcaaccagactaagtacaaggaacagtacatcgagcagatgaagaatatcaactaa

SEQ ID NO: 3112 - DNA, 1353 bp, Unknown
  Bacillus sp. multi
ctctcaatcgcggtgaaggtgatgaagtaccaaatcgtctgcccggtgaacatcgagtggaagaccttcgagatatacctccggacgctatcgtaccacttccgcaccattggcaatcgaaccatccagaagttgtgggagtacgacaaccagtccttaaagcacttcaaggacaccggccaatacccttctgcccagcagctctacggttgcacccagaagactatctctggctatatctacgaccagctcaaggaggagtaccaggacatcaacaaggccaatatgtcaacaaccttgcagaaaacaatcagaacttggaactcccgcaagaaggagatttggagtggggagatgagcatcccttccttccggaacaacctccctatcgacatccacggcaactccatacagatcatcaaggagaagtccggagactacattgcttccgtgagcctgttctccagcaaattcatcaaggagaatgatctgccaaacggcaagatcctcgttaagctctcaacgaggaagcagaactccatgaaggtgatcttggaccgcatcattgacagtacctacgcaaaaggggcgtgcatgttgcacaagcacaaaaagaagtggtacttgtcaattacctacaagtcaaacatcaaggaggagttgaagttcgacgaagacctgataatgggcatcgacatggggaagattaacgttctctactttgcctttaacaaggggctcgttagaggggcaataagcggcgaggagatcgaagcgtttcgcaaaaaaatcgagcaccgccgtatctccctattgcgacaggggaagtactgttctggcaaccgcatcgggaaggggagggagaagcgtatcaagcccatcgacgttctgaatgacaaggtggccaagttccgtaatgcgaccaaccacaagtacgctaattacattgtgcagcagtgcctcaagtacaactgcgggacgatccatctggaggacttgaagggcatctcgaaggagcagacgttcctcaagaactggacctacttcgacctacaggaaaaaatcaagaatcaggccaaccagtacggcgttaaagtggtcaagattgacccaagttacacgagtcagcgctgctccgagtgcggctacatccacaagaacaaccgacaggaccaaagcacgttcgagtgtcagcagtgcagcttcaaggtccacgccgactacaacgccgccaagaacattagcgtttacaacattgagaaggtcatacagaaacaacttgaactccaggagaagctaaaccagactaagtacaaggaacagtacatcgaacagatgaagaatatcaattga

SEQ ID NO: 3113 - DNA, 1353 bp, Unknown
  Bacillus sp. multi
ctctcaatcgcagtcaaggtgatgaagtaccagatcgtgtgcccggtcaacatcgagtggaagaccttcgagatatacctgaggactctctcctatcacttcagaaccatcggcaacaggaccatacagaagttgtgggagtacgacaaccagtcattgaaacacttcaaggacacggggcaatatccgtcagcccagcaactctacggctgcacccaaaaaacgatcagcggctacatctatgaccagctcaaggaggagtaccaggacatcaacaaggcgaatatgagcacgacattgcagaagacaatccgcacgtggaactctcgcaagaaggaaatctggagcggcgaaatgtcgatcccgtccttccgcaataacctccccatcgacatacacgggaatagtatccagattatcaaggagaaatctggagactacatcgcaagtgtgtcgctgttcagttccaaattcatcaaggagaacgacttgcctaacggcaagatcctcgtaaaactttccacccgcaagcaaaactcgatgaaggtcatcctcgaccgcatcattgacagtacatacgcaaagggtgcgtgcatgttgcacaagcacaaaaagaagtggtatttgagtatcacctacaagagcaacatcaaggaggagttgaaattcgacgaagacttaatcatgggcatcgacatggggaagatcaacgtcctctatttcgccttcaacaaggggctcgtgaggggagcaatctccggggaggagatcgaggcgttccgcaagaagatcgagcacaggcgtatcagcctcctgagacaaggcaaatattgctctggcaaccgaatcgggaaggggcgggagaagcggattaagcccattgacgttctgaacgataaggtggctaagttccgcaatgccaccaaccacaagtacgcgaactacattgtgcagcagtgccttaagtacaactgcgggaccattcacctggaggacttgaagggcatcagtaaagagcagacattcctcaagaactggacatacttcgacctccaggaaaaaatcaagaaccaggctaaccagtacggcgtgaaggtggtgaagatagacccatcctacacatcccagcgatgctccgagtgcgggtacattcacaaaaacaatcgacaagatcagtccaccttcgagtgtcagcagtgctccttcaaggttcacgcagactacaatgccgccaagaatatcagcgtttacaatatcgaaaaggtgatccagaagcaacttgaactccaggaaaagctgaaccagactaagtacaaggagcagtatatcgaacagatgaaaaacatcaactga

SEQ ID NO: 3114 - DNA, 1353 bp, Unknown
  Bacillus sp. multi
ctttcaatagcggtgaaggtgatgaagtaccagatcgtgtgccccgtgaacatcgagtggaagacgttcgagatatacctacggacgctctcctaccacttccggaccatcgggaaccgcacgatccaaaagttgtgggagtacgacaaccagagtctgaaacactttaaggacaccggacagtatccctctgcccagcagctctacggctgcacccagaaaacgatctccggttacatctatgaccagctcaaggaggaataccaggacatcaacaaggccaatatgtcaaccactcttcaaaaaaccatccgcacctggaactcccgcaagaaagagatttggagcggagaaatgtccattccctcattcagaaacaatctacctatcgacatacacggcaactccatccagatcatcaaggagaagtcgggtgactacatcgcttctgtgagcctgttctccagcaagttcattaaggagaacgacctccccaacggcaagatacttgttaagctctcaactcgcaagcagaacagtatgaaggtgattctggacaggataattgactcgacgtacgctaaaggggcgtgcatgttacataagcacaaaaagaaatggtatctctcgataacctacaagagtaacatcaaggaggagttgaagttcgacgaggatcttatcatgggaatcgacatggggaagataaacgtcctgtactttgcgttcaacaaggggctagttcgtggggcaatttccggcgaggagatcgaagccttccgcaagaagattgagcaccgaaggatctcattacttcgtcaggggaagtactgctccggcaacagaatcgggaagggacgggagaagcggatcaagcccattgacgtgctcaacgacaaggttgccaaattccgtaacgcgacgaaccacaagtacgcgaactacatcgtgcagcagtgccttaagtacaactgcggcactatccacttggaggacttgaagggcatcagtaaggagcagactttccttaagaactggacctactttgacctccaggagaagatcaaaaaccaggcaaaccagtacggcgtcaaggttgtgaagatcgacccctcttacaccagtcagcgctgttccgagtgcggctatatccacaagaacaaccgacaggaccaatctaccttcgagtgccagcagtgctcattcaaagtccacgccgactacaacgccgctaagaacataagtgtgtacaatatcgagaaggtcatccagaagcagctagagttacaggagaagctgaatcagacaaagtacaaggagcagtacatcgagcagatgaagaatatcaactga

SEQ ID NO: 3115 - DNA, 1332 bp, Unknown
  Bacillus sp. multi
atgaagtaccagatcgtgtgccccgtgaacatcgagtggaagaccttcgagatataccttcgtaccctgagctaccacttccggactatcgggaaccgcaccatacagaagctctgggagtacgacaaccagtccctcaagcacttcaaggacacgggccagtacccctctgctcagcaattgtacggctgcacccagaagacaatcagcggctatatctacgaccagttgaaggaggagtatcaggacattaacaaggcgaacatgagcactaccttgcagaagaccatcaagacctggaactcccgcaagaaggaaatctggagcggagagatgtctattccctccttccggaacaacctgccaattgacatccacggcaattccatccagattatcaaggaaaagtccggagactatatcgcctcggtcagcttgttctcctccaagttcattaaggagaatgacctgcccaacgggaagattctggtgaaactttcgactaggaagcagaactccatgaaggtgattctcgaccgtatcattgactccacctacgctaaaggagcttgcatgttacacaagcacaaaaagaagtggtatctgagtattacctacaagagcaacatcaaggaggagttgaaattcgacgaagacctcattatgggaattgacatgggcaagattaacgtcctctacttcgccttcaacaagggcctcgtgcgcggagctatctctggcgaggagattgaagcgttccgcaaaaagatcgagcaccggcgcatctccttgctcagacagggcaagtactgttccggaaacagaatagggaaggggcgcaaaaagcggatcaagcccatcgaagttctcaacgacaagatcgccaagttccgtaccgcaacgaaccacaagtacgcgaactacattgtccagcagtgccttaagtacaactgcgggaccatacaattggaagacttacaagggatctctaaggagcagacctttctcaagaattggacctacttcgacctacaggagaagatcaaaaaccaggcgaaccagtacggcatcaaggttgtcaagatagacccttcatatacctctcagcggtgcagcgagtgcgggtatatccataagaacaacaggcaaaaccagagcaccttcgaatgccagcagtgctccttcaaggtgcacgcggactacaacgcggccaagaatatctctgtgtacaatatcgagaaggtgatccagcgccagttgaagttacaggagaagctaaacctcacaaagtacaaggagcagtacattgagcaaatggagaacatcaactga

SEQ ID NO: 3116 - DNA, 1332 bp, Unknown
  Bacillus sp. multi
atgaagtaccagatcgtgtgccccgtcaatatcgaatggaaaaccttcgaaatctacttgagaaccctttcctaccacttccgcaccattgggaaccgtacgatccagaagctatgggagtacgacaaccagagcctcaaacacttcaaggacaccggacagtatccgtcggcgcagcaactctacgggtgcactcagaaaacaatctcaggctacatctatgaccaacttaaggaggagtaccaggacatcaacaaggcgaacatgagcacgaccttgcaaaaaacgattaagacttggaactcccgcaagaaggaaatctggagcggggagatgagtatcccgtcgttccgcaacaatttgccaatcgacatccacggcaactcgatccagattatcaaggagaagtccggtgactacatcgcttcggtttccttgttctcgtcaaagttcattaaggagaacgacctgcccaacgggaaaatcctggtgaagttgtcaacccgcaagcagaactctatgaaggtcatactggacaggatcatcgactccacctacgcgaaaggagcctgcatgttacacaaacacaagaagaagtggtacttgtcgatcacttacaagagcaacattaaggaggagttgaaattcgacgaagaccttatcatggggattgatatggggaagatcaacgtactctacttcgccttcaataagggactggtacgtggggccatcagcggcgaggagatcgaagcgtttcgcaagaagattgagcatcgacggatcagcctcctccgccagggcaagtattgctcagggaacagaatcggcaagggtcgcaaaaagcgcattaagcccatcgaagtgctcaacgacaagatcgctaagttccggactgctactaaccacaagtacgctaactacatcgttcagcagtgcctcaagtacaactgcggcaccattcaattggaggacttacagggaatctctaaggagcagacgttcctcaagaattggacctacttcgacctccaggagaagatcaaaaaccaggccaaccagtacggcatcaaggtggtcaagatcgacccgtcctacacctctcaacggtgctcggagtgcgggtacattcacaagaacaaccgccagaaccagagtaccttcgagtgccagcagtgcagctttaaggtgcacgcggactacaacgcagccaagaatatctcagtgtacaatatcgagaaggttattcagcgtcagctaaaactacaggagaagttgaacctgacaaagtacaaggagcagtatatcgagcagatggagaacatcaactag

SEQ ID NO: 3117 - DNA, 1332 bp, Unknown
  Bacillus sp. multi
atgaagtaccagatcgtctgcccggtgaatatcgagtggaagaccttcgagatatacctacgcaccctaagctaccacttccgtaccatcggcaacaggaccatccagaagctctgggagtacgacaaccagtctttgaagcacttcaaggataccggacagtatccgtccgcccaacaactctacggctgcactcagaaaaccatatccggctatatctatgaccagctcaaggaggaataccaggacatcaacaaggccaatatgtccacaaccttgcagaaaactatcaagacttggaactctcgcaaaaaggagatatggagcggcgagatgagcatcccgagtttccggaacaacctgccaatcgacatccacgggaactcaatccagatcatcaaggagaaatccggtgactacattgccagtgtgagcttgttctcatccaagttcattaaggaaaatgacctccccaacggcaagatcctggtgaagttgagcactaggaagcagaactccatgaaggtgatcctcgacaggatcatcgactcgacttacgctaaaggtgcctgcatgttgcacaagcacaagaaaaaatggtacttgtctattacctacaagtcaaacattaaggaggagttgaaattcgacgaagacctcattatgggaatagacatgggaaagatcaacgtcctatacttcgcattcaacaaggggcttgtgcgaggggcaatctctggggaggaaatcgaggcttttcgcaagaagattgagcacaggaggatcagcttactccgtcagggcaaatattgttccggaaacaggatcgggaaggggcgcaagaaacgtattaagcccatcgaggtgctcaacgacaagatagccaaattccggacggccaccaaccacaagtacgctaactacatcgtccagcagtgcttgaagtacaattgcgggaccatccagctcgaagacctacagggcatctcgaaggagcagaccttcctcaagaattggacgtacttcgacctacaggagaagatcaaaaaccaggcaaaccagtacggtatcaaggtcgtgaagatcgacccctcctacacctctcagcgttgctccgagtgcggctacatccacaagaacaaccggcagaaccagagtaccttcgagtgccagcagtgctcgttcaaggtgcacgcagactacaacgccgccaagaatatctccgtttacaatatcgaaaaggtgattcagcggcaactaaagctccaggagaagctgaacctcacgaagtacaaggagcagtacattgagcagatggagaatatcaattga

SEQ ID NO: 3118 - DNA, 1332 bp, Unknown
  Bacillus sp. multi
atgaagtaccagatagtctgccctgtgaacatcgagtggaaaaccttcgagatataccttagaacgctatcctaccacttccggaccattgggaaccgaacgatccagaagctctgggaatacgacaaccagtcactcaagcactttaaggacaccgggcagtacccatctgcacagcagttgtacggctgcacccaaaaaaccatcagcggttacatctatgaccagcttaaggaggagtaccaggacatcaacaaggccaacatgagtacgaccctacagaaaacgatcaagacctggaatagccgcaaaaaggaaatctggagcggcgaaatgtccatcccgagtttccggaacaacctccccatcgacattcacggaaacagcatccagattatcaaggagaagtccggcgactacatcgcaagcgtctctctgtttagttccaagttcatcaaggagaatgacctacccaacggcaagattctggttaagctaagcacacgcaagcagaacagcatgaaggtgatcctggaccgaatcatcgactccacatacgcaaagggtgcctgcatgttacacaaacacaagaagaaatggtatttgagcattacatacaagagcaacatcaaggaggagttgaagttcgatgaagacctcattatgggaatagacatggggaagattaacgtactctacttcgccttcaacaaggggctggttcgcggggcaatttccggggaggagatcgaggctttccgcaaaaagatagagcaccggcgcatctcactactgagacagggcaaatattgttccgggaaccggattgggaaggggcgcaagaagcgcattaagcccattgaggtgcttaatgacaagatcgccaagttccgtactgcgacaaaccacaagtacgccaactacatcgtgcagcagtgcctcaagtacaattgcggcaccatacagttggaagacttgcaagggatcagtaaagagcagaccttccttaagaactggacctatttcgacctacaggaaaaaatcaagaatcaggcaaaccagtacggtatcaaggtggtgaagatcgacccgtcctatacgtcacagaggtgcagcgagtgcggctacatccacaagaataaccgccagaatcagtccactttcgagtgccagcaatgctcgttcaaggtgcacgccgactacaacgccgccaagaacatatccgtgtacaacattgagaaggtcatccagcgccagttgaagctacaggagaagctgaacctcaccaagtacaaggagcagtacatcgagcagatggagaacatcaattga

SEQ ID NO: 3119 - DNA, 1332 bp, Unknown
  Bacillus sp. multi
atgaagtaccagatcgtctgccctgtcaacattgagtggaagactttcgagatataccttcgcaccctgagctaccacttccgcactatcgggaatcggacgatccaaaagttgtgggagtacgacaaccagagcctcaagcacttcaaggacaccggccagtacccgagcgcccagcagctatacggctgcacccagaaaacgatcagcggctatatctatgaccagcttaaggaggaataccaggacatcaacaaagcgaatatgagcacgaccctccaaaaaaccatcaagacttggaactcccgcaaaaaagagatttggagtggggagatgtccatcccttccttccgcaacaacctccccattgatattcacgggaacagcatccagatcatcaaggagaaaagtggtgactacattgcctccgtgtcgctgttcagctcgaaattcatcaaggagaacgatctgcctaacgggaagatcctagtcaaactcagtaccaggaagcagaactccatgaaggtgatcctggaccgcatcatcgactccacatacgctaagggagcgtgcatgttgcacaagcacaagaagaagtggtatctgtccataacttacaagagcaacatcaaggaggagcttaagttcgacgaggacttgataatgggaatcgacatgggaaagattaacgtgctatactttgccttcaacaagggcctcgtgcgtggggctatatctggcgaggagatcgaggcgtttcgcaaaaagatagagcacaggcgaatcagtctcctccgtcagggcaaatattgttccggcaaccgcattgggaaggggcgcaagaaacgcatcaagcctatagaggtcttaaatgataagatcgctaagttccgtacagccactaaccacaagtacgccaactacatcgtccaacaatgtctcaagtacaactgcgggaccatccagttggaagacttgcaagggatctccaaagagcagactttccttaagaactggacttacttcgacctccaggagaagatcaaaaaccaggcgaaccagtacggcattaaggtggttaagatcgacccctcctatacttcccagaggtgctcggagtgcggttacattcacaagaacaatcgccagaatcagagtacattcgagtgccaacagtgctcgtttaaggtccacgccgactacaacgccgccaagaatatctctgtgtacaatatcgagaaggtgatccagcgccagttgaaactccaggagaaactaaacctgactaagtacaaagagcagtacatcgagcagatggagaacattaactga

SEQ ID NO: 3120 - DNA, 1353 bp, Unknown
  Bacillus sp. multi
ttgtcaatcgcggttaaggtgatgaagtaccagatcgtgtgccccgtgaacatcgagtggaagaccttcgagatatacctgagaaccctaagctatcacttccgcacaatcggaaaccgaacaatccagaagttgtgggaatacgacaaccagtcccttaagcacttcaaagacaccggccagtacccttccgcgcagcagctctacggctgcacccagaagactatctcgggctacatctacgaccagctcaaggaggaataccaggatattaacaaagcgaacatgagcaccaccttgcagaagacgattaagacttggaatagccgcaaaaaggaaatctggagtggcgaaatgagcatcccatcattccgcaataacctgcctattgacatccacgggaactcgatccagatcattaaggagaaatctggggactacattgcaagtgttagtctgttctcctccaagttcatcaaggagaacgacctcccaaacgggaagatcctggtgaaattgagcactaggaagcagaacagcatgaaggtgatccttgaccgcatcattgactccacatacgcaaagggagcgtgcatgttgcacaagcacaaaaagaaatggtatctctcaatcacctacaagagtaacatcaaggaggagcttaagttcgacgaagaccttatcatgggcatcgacatgggaaagataaacgttctctacttcgcattcaacaaggggctggtacgtggagccatcagtggggaggagatcgaggcgttccgcaagaaaatagagcaccggcggatcagcctcctccgccagggcaagtattgttccggcaaccgtatcggcaagggccgcaagaagcggatcaagcccattgaggtgctgaacgacaaaatcgctaagttccgaaccgccacaaatcacaagtacgccaactacatcgtgcagcagtgtctcaagtacaactgcggcacgatccagttggaggacttacaaggaatttcaaaggagcagacattcctcaagaattggacatacttcgacctccaggaaaaaatcaagaatcaggctaaccagtacggcatcaaggtggttaagatcgacccgagttacacatcacaaaggtgttccgagtgcgggtacatccacaagaataaccggcaaaaccagtccaccttcgagtgccagcagtgcagcttcaaggtccacgcagactacaacgcagccaagaatatctctgtgtacaacattgagaaggttatccagaagcagttgaagctccaggagaagctgaaccttactaagtacaaggcccagtacatcgagcagatggagaacattaactag

SEQ ID NO: 3121 - DNA, 1353 bp, Unknown
  Bacillus sp. multi
ctgtctatcgcagtgaaggtgatgaagtaccagatcgtgtgcccagtgaatatcgaatggaagacgttcgagatatacctccgaaccctctcctaccacttccgcaccatcggcaacagaacaatccagaagctgtgggagtacgacaaccagtccctcaagcactttaaggacaccggccagtacccctctgctcagcagctctacggctgcacccagaaaaccatatccggctacatatacgaccaactcaaggaggagtaccaggacattaacaaggccaatatgtccaccaccctccagaagactattaagacatggaactcacgcaagaaagagatatggagtggcgagatgagcatcccgagcttccggaacaacctgcccattgacattcacggaaactccattcagatcatcaaggagaagtcaggcgattacatcgcctcagtatcactgttctcgtccaaattcatcaaggaaaatgatctgcccaacgggaagatcctggtgaaactaagcactcgcaagcagaactccatgaaggtgatcctcgacagaatcatcgactccacctacgctaaaggagcctgcatgttgcataagcacaagaagaagtggtatctgagcataacctacaagtccaatatcaaggaggagttgaagttcgacgaggatctgattatgggcattgacatgggcaagatcaatgtcctctacttcgcattcaacaaggggctggtacgaggtgccatcagcggtgaggagatcgaagcctttcgcaagaagattgagcataggcggatcagcttattgagacaagggaagtactgttcggggaaccgcatcggaaaggggcgcaagaagcggatcaagccaattgaggtgctaaacgacaagatagccaagttcagaacggcaacaaaccacaagtacgctaactatatcgttcagcagtgcctaaagtacaactgcgggaccatccagttggaggacttacagggtatctctaaagagcagacgttcctcaagaattggacttacttcgacctccaggagaagatcaaaaaccaggccaaccagtacggcatcaaggtggtgaagatcgacccatcctacaccagtcagaggtgctccgaatgcgggtacatacacaagaacaaccggcagaaccagagtaccttcgagtgccagcagtgcagcttcaaggtgcacgctgactacaacgcggctaagaatatcagcgtttacaatatcgagaaggtcatccagaagcagctcaagctccaggagaagctcaacctcaccaagtacaaggcccagtacattgagcagatggagaacattaactag

SEQ ID NO: 3122 - DNA, 1353 bp, Unknown
  Bacillus sp. multi
ctcagcattgctgtgaaggtgatgaagtaccagatcgtatgcccggtgaacatcgagtggaagacattcgaaatctacttacgcacactcagttaccacttccgtaccattgggaaccgaaccattcagaagctgtgggagtacgacaaccagtccctcaaacacttcaaggacaccggacagtacccctccgctcagcagctttacgggtgtactcaaaaaactatcagcgggtacatctacgaccagctcaaggaggagtaccaggacatcaacaaggcgaatatgagtacgaccttgcagaaaaccattaagacgtggaactctcgcaagaaggaaatctggagcggcgagatgagcatcccctccttccgcaacaaccttcctatcgacattcacggcaactccattcagatcattaaggagaagtcaggcgactacattgcaagtgtttccctcttcagtagcaagttcatcaaggagaatgacttgccgaacgggaaaatcctggtgaagctctccactcggaagcagaactccatgaaggtgatcctcgaccggataatcgacagcacctacgcaaagggtgcctgcatgttgcacaagcacaagaagaagtggtatcttagtatcacatacaagtccaacatcaaggaggagttgaaattcgacgaggatctgattatggggatcgacatggggaagataaacgtgctgtacttcgcattcaacaaagggctggttcgaggggctatctcaggggaggaaatcgaggctttccgcaagaaaatcgagcacagacggatttcactgttgcgtcaagggaaatactgttctggcaaccgcatcggcaaggggcgcaaaaagcgcatcaagccgattgaagttctcaatgacaagatcgccaagttccggacggccactaaccacaagtacgcaaactacattgttcagcagtgcctcaagtacaactgcggcacgatacaattggaggacttgcaaggaatcagtaaggagcaaacgttcctcaagaattggacgtacttcgacctacaggagaagatcaaaaaccaggcgaaccagtacggcatcaaggtcgtgaagatagacccctcctacaccagccagcgctgctctgagtgcggctacatacacaagaacaaccggcagaaccagtcaaccttcgagtgccagcagtgctccttcaaggtgcacgccgattacaacgctgccaagaatatctcagtgtacaatatcgagaaggtgatccagaagcagctcaaactccaggagaaattgaacttgactaagtacaaggcccagtacatcgagcagatggagaacattaactga

SEQ ID NO: 3123 - DNA, 1353 bp, Unknown
  Bacillus sp. multi
ctgagcatcgctgtcaaggtcatgaagtaccaaatagtgtgcccggtcaatatcgagtggaagaccttcgagatatacctaagaacattgagctaccactttcgcacgattgggaacaggaccatccagaagttgtgggagtacgacaaccagtctctcaagcacttcaaggacaccgggcagtacccctcggcccagcagctctacggatgtactcaaaaaacgatctcaggctacatctatgaccaacttaaggaggagtaccaggacatcaacaaggccaatatgagtacaactctccagaaaaccatcaagacctggaacagccgcaagaaagagatttggagtggggagatgtccatccccagcttcagaaacaatctgccaattgacatccacggaaacagtatccagatcatcaaggagaagtccggcgactacatcgcttccgtgtccctgttctcatccaaattcatcaaggagaacgacttacccaacggaaagatcctggtgaaactgtcaactcgcaagcaaaactctatgaaggtcatacttgaccgcatcattgactctacctacgctaagggtgcctgcatgttacacaaacacaagaagaaatggtacttatccatcacgtacaaaagcaacatcaaggaggagttgaaattcgacgaggacttaatcatgggaatcgacatgggcaagattaacgtgctctacttcgctttcaacaagggactggtgcgtggggcaatcagcggggaggagatcgaggcgtttcgcaaaaagatcgagcacaggcggatctccctgctgaggcaaggcaaatactgctctggcaaccgaattgggaaggggcgcaaaaagcggattaagccgattgaggtcttgaacgacaagatcgccaaattccgcaccgccacgaaccacaagtacgccaactacatcgtgcagcagtgccttaagtacaactgtgggaccatccagttggaagacttacagggaatcagcaaggagcaaaccttcctcaagaactggacttacttcgacttacaggaaaaaatcaagaaccaggccaatcagtacggtatcaaggtggtgaagattgaccccagctacacatcgcagcggtgctccgagtgcggttacatccataagaacaaccgccagaaccagtccaccttcgagtgccagcagtgttcgtttaaggtccacgcagactacaacgcggctaagaacatctcagtgtacaatatcgagaaggtcatccagaagcagctaaagctccaggaaaagctcaacctcacgaagtacaaggcgcagtatatcgagcagatggaaaacatcaactag

SEQ ID NO: 3124 - DNA, 1353 bp, Unknown
  Bacillus sp. multi
ctctccattgcggtcaaagtgatgaagtaccagatcgtgtgccccgtcaacattgagtggaagaccttcgaaatctacctacgcactctgtcttaccactttcggacaatcgggaatcgcacaatccagaaactgtgggaatacgacaatcagtccctcaagcactttaaggacactgggcagtaccccagcgctcagcagctctacggttgcacccagaaaaccatctccgggtatatctacgaccagctcaaagaggagtaccaggacatcaacaaggcgaatatgtccacgacccttcagaagaccatcaagacgtggaactcccgcaagaaggaaatctggagtggggagatgtccattccctctttccgcaacaacctccctattgacatccacgggaactcaattcagatcatcaaggagaagtctggcgactacattgcatccgtgtctctattctcgtcaaagttcatcaaggagaacgacctgcccaacgggaaaatcctggtgaaactgtccaccaggaagcagaatagtatgaaggtcatcctcgacagaatcattgactcaacatacgctaaaggtgcgtgcatgttacacaagcacaaaaagaaatggtatctgtcaattacttacaagtccaacattaaggaggagctgaaattcgacgaagacctcattatgggaatagacatggggaagatcaacgtgctttacttcgccttcaataaggggctggtcagaggtgctatctctggcgaggagatcgaagcctttcgcaaaaagatcgagcacaggaggatctccctgctcagacaaggaaagtattgctccggcaaccgcatcgggaagggtcgcaagaaacgcatcaagcctattgaagtcttgaacgacaagatcgccaagttccgcaccgctaccaaccacaaatacgccaactacatcgtccagcagtgcttgaagtacaactgcggcacgatccagttggaagatttgcaaggaatatccaaagagcagaccttcctcaagaattggacctacttcgacctacaggaaaaaatcaagaaccaggccaaccagtatggcattaaggtggtgaagattgacccgagctacactagccagcgatgctctgagtgcgggtacatccacaagaacaaccgccagaaccagtcaaccttcgagtgccagcagtgcagtttcaaggtgcacgcggactacaacgccgccaagaacatcagcgtgtacaacatcgagaaggttattcagaagcaactcaaactacaggagaagctcaacttgaccaagtacaaggcgcagtatatcgagcagatggaaaacattaactag

SEQ ID NO: 3125 - DNA, 1353 bp, Unknown
  Bacillus sp. multi
ctgtccatcgcagtgaaggtcatgaagtaccagatcgtgtgccctgtgaacatcgagtggaagaccttcgaaatctacttaagaacactctcctaccacttccggaccattgggaatcgcacaatccagaagctgtgggagtacgacaatcagtccctcaagcacttcaaggacaccggtcagtacccgtcagcccaacaactctacggttgcacccaaaaaacgatctctggctatatctacgaccagctcaaggaggagtaccaggatattaacaaggcgaatatgtccacgaccctccagaagaccatcaagacttggaactcacgcaaaaaagagatttggagtggcgagatgtccatcccatccttccgcaacaacctccctatagacatccacggcaactctatccagatcatcaaggagaagtctggcgactatatcgcatcggtgtcccttttcagctctaagttcatcaaggagaacgacctgccgaacggcaagatcctggtcaagctgtcaactcgaaagcagaactctatgaaggtgatcctggaccgtatcatcgactcaacgtatgcaaaaggggcctgcatgttgcacaagcacaagaagaagtggtatctatcaattacctacaagagtaacatcaaggaggagttaaagttcgacgaagacttaatcatgggaatcgacatggggaagattaacgtcctctacttcgcattcaacaaggggctcgtccgtggagcaatctccggtgaggagatcgaggcgttccgcaaaaagatcgagcatcggcggatttccctcctgagacaggggaaatattgttccggcaacagaatcggcaagggccgcaaaaagcgcattaagcccatcgaggttctcaatgacaagatcgccaagttccgtaccgccacgaatcacaagtacgctaactacatcgtccagcaatgcctaaagtacaactgcgggaccatacagcttgaggacttacagggcatcagtaaagagcaaacctttctcaagaactggacctacttcgacctccaggagaagatcaaaaaccaggcaaaccagtacggcatcaaggtcgtcaagattgacccatcctatacctcccagcgttgctctgagtgcggctacattcacaagaacaaccgtcaaaaccagagcaccttcgagtgccagcagtgttccttcaaagtccacgcggactacaacgccgccaagaacatcagtgtgtacaacatcgagaaggtgattcagaggcaacttaaactccaggaaaagttgaacttgacaaagtacaaggagcagtatatcgagcagatggagaacatcaactga

SEQ ID NO: 3126 - DNA, 1353 bp, Unknown
  Bacillus sp. multi
ttgtccatcgccgtcaaggtcatgaagtaccagatcgtatgccccgtgaacatcgaatggaagaccttcgagatatacctgaggactttgagttaccacttccgcacaatcggcaacaggacaatccagaagctatgggagtacgacaaccagtcccttaagcacttcaaggataccgggcagtacccgtcggcacagcagctatacgggtgcacgcagaaaaccatcagcgggtacatctacgaccagctcaaggaggagtatcaggacatcaacaaagccaatatgtccactactctccagaagactatcaagacgtggaactcccgcaaaaaagagatttggagtggtgaaatgtctatcccctccttccgcaacaacctgcccatcgacattcacgggaactctatccagatcattaaggagaagtcaggagactacatcgcctccgtgtccttgttcagcagtaagttcatcaaggagaatgacttgcccaacgggaagatcctcgtgaaattgagcactaggaagcagaactccatgaaggtgatcctcgaccggatcatcgactccacctacgcaaaaggagcctgcatgttgcacaagcacaagaagaaatggtatctatctatcacttacaaaagcaacatcaaggaggagctaaagttcgatgaagacctgattatggggatcgacatgggcaagatcaacgtactgtactttgcgtttaacaagggcttggtcaggggtgcaatatcaggggaggagatcgaagcgttccgcaaaaagatcgagcaccgtcgtatatctctgctgcgtcaggggaaatattgttccgggaaccgcatcgggaagggacgcaaaaaacggatcaagcccatcgaggttctcaacgacaagatcgccaagttcagaaccgcgaccaaccacaaatacgccaactatatcgtgcagcagtgcttgaagtacaattgtgggaccatacagttggaagacctgcaagggatttcgaaggagcaaaccttccttaagaactggacgtactttgacctccaggagaagatcaaaaaccaggccaaccagtacggtattaaggtggtcaagatcgaccccagttacacatctcaaagatgctccgagtgcggctacatccacaagaacaaccgacagaatcagagcactttcgagtgccaacagtgttcattcaaggtgcacgccgattacaatgcggccaagaacatctccgtgtacaacatcgagaaggtgattcagcgacagctcaagctccaggagaagctgaacctcaccaagtacaaggagcagtacatcgaacagatggagaatatcaactga

SEQ ID NO: 3127 - DNA, 1353 bp, Unknown
  Bacillus sp. multi
ctcagcatcgccgtgaaggtgatgaagtaccagatcgtttgtcccgtcaacattgagtggaagaccttcgagatataccttcgcaccctgtcctaccactttcgaaccatcggcaaccgcacgattcagaagctgtgggagtacgacaaccagtcccttaaacactttaaggacaccggccagtaccccagcgcgcagcagctctacggctgtactcagaagacaatcagtggctatatctatgaccagctcaaggaggagtaccaggacatcaacaaggccaatatgtccaccacccttcaaaaaacgattaagacatggaactcccgcaagaaagagatttggagtggggagatgtctatcccgagctttcgaaacaacttgcccattgatatacacggcaactccatccagattatcaaggagaaaagtggggactacatcgcgtctgtctcgttgttctcatcgaagttcatcaaggagaacgacttgcctaacgggaagatcctagtcaagctatcaactcgcaagcagaactccatgaaggtgatcttagaccgcatcatcgactctacctacgcgaaaggggcgtgcatgttacacaagcacaagaagaagtggtacttgagtatcacatacaagagcaacattaaggaggagttgaagttcgacgaagaccttatcatggggattgacatggggaagataaacgtcctctatttcgccttcaacaagggactcgtgcgtggcgcaataagcggtgaggaaatcgaggcttttcgcaagaaaatagagcaccggcggatctccctgctgcgtcaagggaagtattgcagtggcaaccggatcgggaagggccgcaagaagcggattaagcccatcgaagtccttaacgacaagattgctaagttccgtaccgctacgaaccacaagtacgctaactacattgttcagcagtgccttaagtacaactgtggtacgattcagttggaggacttacagggcatatctaaggagcagactttccttaagaactggacctacttcgacctccaggagaagatcaaaaaccaggcgaatcagtacggcattaaggtggtgaagattgacccatcatacaccagccagaggtgctccgagtgcggttacatacacaagaacaaccgacagaaccagagcaccttcgagtgtcagcagtgctccttcaaggtccacgcagactacaacgcggccaagaacatcagcgtgtacaacatcgagaaggttatccaacgtcagttgaagctccaggagaaactgaatctcaccaagtacaaggagcagtacattgaacagatggagaacattaactga

SEQ ID NO: 3128 - DNA, 1353 bp, Unknown
  Bacillus sp. multi
ttgagtatcgcagtcaaggtcatgaagtaccagatagtgtgccccgtcaacatcgagtggaagaccttcgaaatctacctacgaactctcagctaccacttccgcaccatcggaaatcggaccatccagaagctctgggagtacgacaatcagagcctcaagcacttcaaggacaccgggcagtaccccagcgctcagcagctctacggctgtacccagaaaactatctcagggtatatctacgaccagcttaaggaggaataccaggacatcaacaaagcgaacatgagcactaccctccagaagaccatcaagacgtggaactcccgcaaaaaggagatttggagcggggagatgtccattccctcgttccgcaacaatcttccaattgacattcacggcaactccatccagattatcaaggagaagtctggggactacattgcctccgtctccctcttcagctcaaagttcatcaaggagaatgacctcccgaacggcaagatcctcgtcaaactttccactcgcaagcagaacagcatgaaggtgattcttgaccggatcattgactccacttacgctaagggtgcttgcatgttgcacaaacacaaaaaaaaatggtatctatccatcacttacaagtccaacatcaaggaggagcttaagttcgacgaagaccttatcatggggattgatatggggaagatcaacgtactctatttcgcgttcaacaagggcttagtgcgaggtgccatctcaggggaggaaatcgaggcttttcgcaagaagatcgagcacaggcgcataagcctactacgccagggcaagtattgctctgggaaccggattgggaagggtcgcaaaaagcggattaagccaatcgaggtcttgaacgacaagattgccaagttccggactgccacaaaccacaaatacgctaactacatcgttcagcagtgcttgaagtacaactgcgggacgattcagctagaggacttacagggaatcagtaaagagcagacgttccttaagaactggacgtatttcgacctacaggagaagatcaaaaaccaggccaaccagtacgggattaaggtggtcaagatcgacccgtcctacacctcgcagcgatgcagcgagtgcggctacatccacaagaacaaccgccagaatcagtccacgttcgagtgccagcaatgctcattcaaggtgcacgcagactacaacgcagccaagaacatctctgtttacaatatcgagaaggtgatccagagacagctaaagctccaggagaagctaaacctgaccaagtacaaggagcagtatatcgagcagatggagaacatcaactag

SEQ ID NO: 3129 - DNA, 1353 bp, Unknown
  Bacillus sp. multi
ttgtccatcgctgtgaaggttatgaagtaccagatcgtttgccccgtaaacatcgaatggaagaccttcgagatatacctccgaactctcagctaccacttccgtacaattgggaaccgcacgatccagaagctgtgggagtacgataaccagtccctcaaacacttcaaggacaccggccagtacccgtcggcccagcagttgtacggctgcacccagaaaactatcagcggttacatctacgaccagttgaaggaggaataccaggacatcaacaaggccaatatgtcaacaaccctccaaaaaaccattaagacctggaactcccgcaaaaaggaaatctggagcggggagatgtctattccctcctttcggaacaatctgcccattgatattcacgggaacagtatccaaatcatcaaggagaagtcaggggactacatcgcatctgtttccctgtttagctctaagttcattaaggagaacgaccttcccaacgggaagatactggtgaagctcagtacccggaagcagaactccatgaaggtcatcctagaccggattatcgactcgacctacgctaaaggagcctgcatgttgcacaagcacaagaagaagtggtacttgtccataacttacaagtccaacattaaggaggaattgaaattcgacgaggacttaatcatgggcattgatatggggaagataaacgtcctttacttcgccttcaacaaggggctagtgcgcggtgcgatttccggcgaggaaattgaggctttccgcaaaaagatcgagcacagacggatttcactgttacgtcaaggcaaatattgttccgggaaccggattgggaaggggcgcaagaagcgtattaagcccatcgaggttctcaacgacaagatcgccaagttccgcaccgctaccaaccataagtacgccaactatatcgtccagcagtgcctcaagtacaattgcggcaccatccagctcgaagacctacagggtatcagcaaggagcagaccttccttaagaactggacctacttcgacctacaggagaagatcaaaaaccaggccaaccagtacggcatcaaggtggtgaagatcgaccctagctacaccagtcagaggtgcagcgagtgcgggtacattcacaagaacaatcgccagaaccagtccaccttcgaatgccagcagtgctccttcaaggtgcacgcggactacaatgcagctaagaatatctcagtgtacaacattgagaaggttatccagcggcaattgaagctccaggagaagctcaacctaacgaagtacaaggagcagtacatcgaacagatggagaacatcaactga

SEQ ID NO: 3130 - DNA, 1353 bp, Unknown
  Bacillus sp. multi
ttgtcaatcgccgtgaaggtgatgaagtatcagatagtgtgccccgtgaacatcgagtggaagacattcgagatataccttcggaccctttcctaccacttccgaacaatcgggaaccgaactatccagaagctatgggagtacgacaatcagtccctcaagcacttcaaggacaccgggcagtacccctccgcgcaacagctatacggctgtacccaaaaaactatcagcggctacatctacgaccagctcaaggaggaataccaggacattaacaaggccaatatgtccacgacccttcagaaaaccatccgcacctggaactcccgcaaaaaagagatttggagcggcgaaatgagcatcccctccttccgcaacaaccttccaatcgacattcacggcaattccatccagatcatcaaggagaagtcaggagattacatcgcatccgtgtcgttattctccagtaagttcatcaaggagaacgacctgcctaacgggaagatcctggtgaagctgagtacccgaaagcagaactctatgaaggtcatccttgaccgcatcattgactcgacctacgctaaaggagcctgcatgttacacaagcacaagaagaagtggtacttgtcgattacttacaagtcgaacatcaaggaggagctgaaattcgacgaagacttgataatgggaatcgacatggggaagataaacgtcctctatttcgctttcaacaagggcctggtgcgaggagctatctccggggaggagatcgaagcgtttcgcaagaaaatcgagcaccgtcggatttccctccttcgccaggggaagtactgctccggcaaccgcatcggaaaaggaagggagaaacgcatcaagcccatcgacgtgcttaacgacaaggttgccaagttccgcaacgctacaaaccacaagtacgcaaactacattgtgcagcagtgccttaagtacaattgtgggaccattcaattggaagaccttaagggtattagcaaagagcagactttcctcaagaactggacatacttcgacctccaggagaagatcaaaaaccaggccaaccagtatggcgtgaaagtggtgaaaatcgaccccagctatacaagccagcggtgctccgaatgcgagtacatccacaagaacaaccgtcaagaccagtccaccttcgagtgccagcaatgcagcttcaaagtgcacgctgactacaacgccgctaagaacatatccgtttacaacatcgagaaggtcattcagaagcaactagaattacaggagaagctgaatcagactaagtacaaggaacagtacattgagcagatgaaaaacatcaactga

SEQ ID NO: 3131 - DNA, 1353 bp, Unknown
  Bacillus sp. multi
ctgtccatcgccgtgaaggtgatgaagtaccagatcgtgtgccccgtgaacatcgagtggaagaccttcgagatatacctccgaaccctctcctaccacttccgcaccatcggcaaccgtaccatccagaagctatgggagtacgacaaccagtccctcaagcacttcaaggacaccgggcaatacccgtcggcacagcaattgtacggatgcacgcagaagaccatctcgggttacatctatgaccagctcaaggaggagtaccaggacattaacaaagcgaatatgagcacgaccctccagaaaaccattcgtacttggaactcccgcaaaaaagagatatggagcggcgagatgtcgattccctccttccgcaataacttacccattgacatccacgggaacagcatacagatcattaaggagaagtctggggactacattgcgtcggtgtcactattctcatccaaattcatcaaggagaacgacctcccaaatggcaagattctcgtcaagttgtccacccggaagcaaaacagtatgaaggtcatattagaccggattatcgactcaacctacgcaaagggcgcttgcatgttgcacaagcacaagaagaaatggtacttgagtatcacctacaaatcgaacatcaaggaggagttgaagttcgacgaagacctgataatggggatcgacatggggaagatcaacgtgctatacttcgccttcaacaagggcttggtgcggggcgcaatctctggtgaggaaattgaggctttccgcaaaaagattgagcaccgccgcataagcctgctgcgtcaggggaagtactgttcgggcaacaggatagggaaggggcgcgagaagcgcattaagcccatcgacgtcctaaacgacaaggtggcgaagttccgcaacgcgaccaaccacaagtacgccaactacatcgtacagcagtgtctcaagtacaactgcggtacgatacagcttgaggacttgaaggggatctcgaaggagcagacattcctcaagaactggacttacttcgacctccaggagaaaattaagaatcaggccaaccagtacggtgtgaaggtggtcaaaatcgacccatcctatacaagccagcgctgctccgagtgcgagtacatccacaaaaacaaccgacaggaccaatccaccttcgagtgccagcagtgcagcttcaaagtgcacgccgactacaacgctgctaagaatatctctgtttacaatatcgaaaaggttatccagaagcagttggagttacaggagaagctgaatcagacgaagtacaaagagcagtacattgagcagatgaagaatatcaactag

SEQ ID NO: 3132 - DNA, 1353 bp, Unknown
  Bacillus sp. multi
cttagcatcgcggtcaaggtgatgaagtaccagatcgtgtgccctgtgaacattgagtggaagacattcgagatatacttacgcaccctctcctatcacttccggacaatcggcaaccggacaatccagaagctctgggagtacgacaaccagtccctaaagcacttcaaggataccggccagtacccaagcgctcagcaattgtacggttgcacgcagaaaaccatctccggctacatctacgaccagctcaaggaggagtaccaggacattaacaaggccaacatgagcacaacattgcagaaaacgatccgcacatggaactcccgcaagaaggaaatctggagtggcgagatgtctatcccctccttccgtaacaacctccctattgacattcacggaaactccatccagatcatcaaggagaaaagcggagactacattgccagcgtctcactattcagctccaagttcattaaggagaatgacttaccgaacggcaagatactcgtcaagctgagcacgcgcaagcagaactccatgaaggtgatcctcgaccgaatcattgacagtacctacgctaagggtgcctgcatgttacacaagcacaagaaaaaatggtatctatctattacctacaagagtaacatcaaggaggagcttaagttcgacgaagacctgattatggggatcgacatgggaaagattaacgttctgtacttcgcattcaacaaagggctcgtccgtggggcaatctccggtgaggagattgaggctttccgcaagaaaatcgagcacagacgtatctcactcttgcgacaagggaagtactgttctgggaatcgcatcgggaagggtcgtgagaagcgtattaagcccatcgacgtgctcaacgacaaagttgcgaaattccgcaacgcaacgaaccacaagtacgccaattacatcgttcagcagtgccttaagtacaactgcgggaccatccaactggaagacctcaaggggatcagcaaggagcagaccttcctcaagaactggacctacttcgatctacaggaaaaaatcaagaatcaggctaaccagtacggcgtgaaggtggtgaagatagacccctcctacactagccaacgatgctcagagtgcgagtacatccacaagaacaaccgccaggaccagagcactttcgagtgccagcaatgctcgttcaaggtgcacgccgactacaatgctgctaagaatatcagcgtgtacaacatcgagaaggtcattcagaaacaacttgaactacaggagaaactcaaccagacaaagtacaaggaacagtacatcgagcagatgaagaatatcaactaa

SEQ ID NO: 3133 - DNA, 1353 bp, Unknown
  Bacillus sp. multi
ctgtcgattgcagttaaggtgatgaagtaccaaatcgtgtgcccggtgaacattgagtggaagaccttcgaaatctacttgcgaactttatcctatcacttccgtacgattgggaaccgcactatccagaagctctgggagtacgacaaccagagcctgaaacactttaaagacaccggacagtacccctcggctcagcagctctacggttgcacccagaaaaccatctccggttacatctacgaccaacttaaagaggaataccaggacattaacaaagccaatatgagtacgaccctccagaaaaccataagaacttggaactctcgcaagaaggagatttggagtggcgagatgtcgattccgtcattccgcaacaacctccctattgacatccacgggaacagcatccagatcatcaaggagaagtccggggattacattgcaagtgtgagcttattcagttcgaaattcatcaaggagaatgacctgcccaacggcaagattctcgtgaagctctccacccggaagcagaactccatgaaggtgatcctagaccggatcatcgactccacctacgctaaaggggcgtgcatgttacacaagcacaaaaagaagtggtatctgtcaattacttacaagagcaacatcaaggaggagctgaaattcgatgaagacctcatcatggggatagacatgggcaagatcaacgtgctctacttcgcattcaacaagggactggtccgtggggctatatcaggggaggaaattgaggctttccgcaagaaaatcgagcaccgccggatctccctccttcgacagggcaagtattgcagtggcaatcggatcgggaaggggcgcgagaagcggattaagcctatagacgttctgaacgacaaggtggcaaagttccgtaacgcgaccaatcacaagtacgcgaattacatcgtgcagcagtgccttaagtacaattgcgggaccattcaacttgaagatttgaaagggatcagtaaggagcagaccttcctcaagaactggacatacttcgacctacaggaaaaaatcaagaaccaggcgaaccagtacggcgttaaggtggtgaagatagacccatcctacacttctcagcggtgctccgaatgcgagtacatccacaagaacaacaggcaagatcagtccaccttcgagtgccagcagtgctccttcaaggtccacgccgactacaacgcagctaagaacatcagcgtgtacaatatcgagaaggtcatccaaaagcagttggagctacaggagaaactcaaccagaccaagtacaaggaacagtacatcgagcagatgaagaacatcaactag

SEQ ID NO: 3134 - DNA, 1353 bp, Unknown
  Bacillus sp. multi
ctttccatcgccgtgaaagtcatgaagtaccaaattgtctgtccggtcaatatcgagtggaaaacgttcgaaatctacctaagaactttatcataccacttccgcaccatcgggaaccgcactatccagaagctgtgggagtacgacaatcagtcgttgaaacacttcaaggacacagggcagtacccatctgcccagcagctctacggttgcactcagaaaactatctccggctacatctacgaccagctcaaggaggagtaccaggacatcaacaaggccaatatgagcactacactacagaaaacaatccggacctggaacagtcgcaaaaaggagatttggagtggagagatgagcatcccctccttccggaacaacctgccaatagacatccacggcaacagcatccagatcatcaaggagaagtctggagactacattgcctccgttagcctattctctagtaagttcatcaaggagaacgacctgcccaacgggaagatcctcgtgaagctgagtacgcgcaagcagaactccatgaaggtgattcttgacaggataatcgactcgacctacgctaaaggtgcctgcatgttgcacaagcacaagaaaaaatggtacttgagcatcacttacaaatccaacatcaaggaggagttgaagttcgacgaagacctgattatgggaatcgacatgggaaagatcaacgtactgtacttcgcattcaataagggacttgtgcgcggggccatctccggcgaggagattgaggcttttcgcaaaaagatcgagcatcgtcgcatctcactcctccgacaggggaaatattgctccggcaaccgaattggaaaagggagggagaagcgcattaagccaattgacgttcttaacgataaggttgcgaaattccgtaacgcgacaaaccacaagtacgccaactacattgtgcaacaatgcctcaagtacaactgcgggaccatacagcttgaggatcttaagggtatctcaaaggagcagactttccttaagaactggacatacttcgacctccaggagaagatcaaaaaccaggcgaaccagtacggggtgaaggtcgtgaagatagacccatcatacacctcgcagaggtgctccgagtgcgagtacattcacaagaacaaccgtcaggatcagtccaccttcgagtgccagcagtgctctttcaaggttcacgcagactacaacgccgctaagaacatcagtgtgtacaacatcgagaaggttatccagaagcagttggagttacaggagaagctgaaccagaccaagtacaaggagcagtacattgagcagatgaagaacatcaactga

SEQ ID NO: 3135 - DNA, 1353 bp, Unknown
  Bacillus sp. multi
ctgtcgaaggtggttaaggtgatgaagtaccagatagtctgtccgctgaatatcgaatggaaagtcttcgagatataccttcgcacactgtcctaccacttccgtaccatagggaaccggacgattcagaagctctgggaatacgataatcagagtctcaaacacttcaaggataccggccagtacccctcggtgcagcagctctacggttgtacgcagaagactgtcagtggctatatctacgaccagctcaaggaggagtaccaggacatcaataaggccaatatgtcaactaccctccagaagactattaagacatggaactctcgcaaaaaagagatatggagtggcgagatgtccattccctcattccgcaacaacttgcctatcgacgtccacgggaactccgtccaagtgacgaaggagaagtccggcgactatatcgcatccgtgagcctgttctcatcgaagttcatcaaggagaacgacttgccaaacgggaagattctcgtcaagctgtccacgaggaagcagaactcgatgaaggtgatccttgacaagatcatcgactctacttacgctaagggtgcttgcatgttgcacaaacataagaacaagtggtatttgagcatcacgtacaaggccaccaaaaaggaggggcacaagttcgacgaggacttgataatggggatcgacatgggaaagatcaacgcattgtactttgcctacaacaaagggctggtgcggggagtgatctcaggcgaggaaatcgaagcctttcgcaagaaggttgagtaccggagaatctcactcctccgtcaggggaagtattgctcagaaaacaggatcgggaaggggcgcaagaagcgtatcaagcctatagaggtgctaaatgacaagatagcgaagttcagaaacgccactaaccacaagtacgccaactacatcgtgcagcagtgcctcaagtacaactgcggcaccattcagcttgaggacttgaaggggatctcaaaggagcagacattcctcaagaactggacctacttcgacctacaggaaaaaatcaagaaccaggccaaccagtacggagtgaaggtggttaagattgacccgagctacacgagccagcggtgcagcgagtgcgggtacattcacaagaacaaccgtcaagaccagtccaccttcgagtgtcaacaatgcagtttcaaggcccacgccgactacaacgctgccaagaacatctctatctacaacattgagaaggttatccagaagcagcttgaattacaggagaaactgaacctcacaaagtacaaagagcagtacattgagcagatggagaacatcaactga

SEQ ID NO: 3136 - DNA, 1353 bp, Unknown
  Bacillus sp. multi
ctcagcaaggtggtcaaggtgatgaagtaccagatcgtgtgtcctctgaacatcgagtggaaggtgttcgaaatctacctcaggacactctcgtaccactttagaacaattgggaaccggaccatccagaagctgtgggagtacgacaaccagagtctcaagcacttcaaggacaccggccagtacccttccgtgcagcagctctacggatgcacacagaagacggtcagtggctacatctacgatcagctcaaggaggaataccaggacatcaacaaggcaaacatgagcacaaccctccagaaaaccatcaagacctggaactcccgcaagaaagagatatggagtggcgaaatgtccatcccatcctttcggaacaacctgccgattgacgtgcacgggaactccgtccaagtcactaaggagaaatccggggactacattgcgagcgtctcattgttctccagcaagttcattaaggagaacgacttgcccaacggaaagatactcgtcaagttgagcacacggaagcaaaacagcatgaaggtcatcctcgataagataatcgacagcacctacgcaaagggtgcctgcatgttacacaagcacaagaacaagtggtatctcagtatcacctacaaggctaccaagaaggaggggcataagttcgacgaagacctgattatggggatcgacatgggcaagatcaacgccctttacttcgcctacaataagggtctggtgcggggtgttatctccggcgaggagattgaggcgtttcgcaagaaggttgaatatcggcgaatatccctcctacgtcagggaaagtattgctcggagaacaggatcgggaaggggcgcaaaaaacgcattaagcctattgaagtgctcaacgacaagatagcgaaattcagaaacgccactaaccacaagtacgccaactacatcgtgcagcagtgcttaaagtacaactgcggcaccatccagcttgaggacttgaaggggataagcaaggaacaaaccttcctcaagaactggacgtacttcgacctacaggaaaaaatcaagaaccaggcaaatcagtacggagtgaaggtggtgaagattgacccctcttacacaagccagcgttgctccgagtgcggctatatccacaagaacaacagacaggaccagagcaccttcgagtgtcagcagtgctcattcaaggctcacgctgactacaacgcggccaagaacatcagtatctacaatatcgagaaggtgatccagaagcagttagaactacaggagaagctaaaccttaccaagtacaaggagcagtacatcgagcagatggagaacatcaattga

SEQ ID NO: 3137 - DNA, 1353 bp, Unknown
  Bacillus sp. multi
ttgagcaaggtggtgaaggtcatgaagtaccagatcgtatgccctctcaatatcgagtggaaagtcttcgagatatacctccgcaccttgtcgtaccacttccgaaccatcggcaaccgcaccatccagaaactctgggaatatgataatcagtcattgaaacacttcaaggataccggccagtacccgagcgtgcagcagttgtacggctgcacccagaagacagtgagcggctatatctacgaccagcttaaggaggagtatcaggacatcaacaaggccaatatgtcaaccacccttcagaagaccattaagacatggaactcccgcaaaaaagagatttggagtggcgagatgagcatcccgagtttccgaaacaacctgcctatcgacgtgcacgggaactccgtgcaagtaacgaaggagaagtctggcgactacatcgcgtccgtctccctgtttagttccaaattcatcaaggagaacgacctcccgaacggaaagattcttgtcaagctctccacgcggaagcagaactccatgaaggtcatattggacaagatcatcgacagcacttatgccaaaggtgcgtgcatgttgcacaagcacaagaacaagtggtatctatctattacctacaaggccaccaaaaaggaaggtcacaagttcgacgaagacctgataatgggcatcgacatgggcaagataaacgccttgtactttgcctacaataaggggctcgtgcggggtgtcatctctggcgaggagattgaagccttccgcaaaaaagtcgagtaccgtcggatttccctcctgcgtcagggcaagtactgtagtgagaaccgcatcgggaaggggcgcaaaaagcggatcaagcccatcgaagttctgaatgacaagatagcgaaattccggaacgctaccaaccacaagtacgccaattacatcgtccagcagtgcttgaagtacaactgcgggactattcagcttgaagatttgaaaggaatctctaaggaacagacattcctcaagaactggacctacttcgacctccaggagaagatcaaaaaccaggccaaccagtacggcgttaaggttgttaagattgacccctcctacaccagccagcggtgctccgaatgcggctacatccacaagaacaacaggcaagaccaatccaccttcgaatgccagcagtgttccttcaaggcacacgcggactacaatgcggccaagaacatctcaatctacaacatcgaaaaggttatccagaagcagcttgaactccaggagaaattgaacctgaccaagtacaaggagcagtatatcgagcagatggagaacattaactag

SEQ ID NO: 3138 - DNA, 1353 bp, Unknown
  Bacillus sp. multi
ctttctaaggtggtgaaggtgatgaagtaccagatagtgtgccctctcaacattgagtggaaggtgttcgagatatacctgcgaactctctcctaccactttagaaccattggcaaccgaaccatccagaagctctgggagtacgacaaccagtctctcaagcacttcaaggacaccgggcagtacccctccgtgcagcagctttatggctgtacgcagaagaccgtgagtggctacatctatgaccagttgaaagaggagtaccaggacatcaacaaagcgaatatgagtaccacgcttcagaaaaccattaagacatggaacagccgcaagaaagagatttggagtggtgaaatgtctattcctagtttccgcaacaacctccccatcgacgtgcacggaaacagcgtacaagttacgaaggaaaagtccggggactacatcgcctcagtctccctgttcagtagcaaattcatcaaggagaacgaccttcccaacggcaagatccttgtgaagctcagcacgcgaaagcagaacagcatgaaggtgatcctcgacaagataattgactcgacatacgcgaagggagcttgcatgttgcataagcacaagaacaagtggtacttatctatcacatacaaggccaccaagaaagagggacacaagttcgacgaggacttaatcatgggcatcgacatggggaagattaacgcactctacttcgcctacaacaaggggttggtgcggggtgtgatctccggcgaggagatagaggctttccgcaagaaggtggagtaccgccgtatcagcctgctccgccaggggaagtactgctcggagaaccgtattgggaaagggcgcaaaaagcggattaagccgattgaggttctcaacgacaagatcgccaaattccgaaatgccacgaatcataagtacgctaactacatcgtacagcagtgcctcaagtacaactgcgggacgatccagttggaagacttgaagggaatcagtaaagagcagaccttccttaagaactggacctacttcgacctacaggagaagatcaaaaaccaggcgaaccagtacggtgtcaaagtagtgaagatcgaccccagctacacgagtcagcggtgctccgagtgcggctacattcacaagaacaaccgacaagaccaatccactttcgagtgccagcagtgctcattcaaagctcacgcggactacaacgcagctaagaacatcagcatatacaacatcgagaaggtgatccagaagcagcttgagttacaggagaagctcaacctgaccaagtacaaagagcagtacatcgaacaaatggagaatatcaattga

SEQ ID NO: 3139 - DNA, 1353 bp, Unknown
  Bacillus sp. multi
ctgtcgaaggttgtgaaggtgatgaagtaccagatagtctgtcccctaaacatcgaatggaaggtgttcgagatatacttgcgaacactctcctatcactttagaacaatcgggaaccggacgatccagaagctctgggagtacgacaaccagtcccttaagcacttcaaggacacgggccagtacccgtccgtccagcagctatacggttgtactcagaagaccgtgagtggctatatctacgaccagttgaaggaggagtaccaggacatcaacaaagccaacatgagcaccactctccagaaaaccatcaagacgtggaacagtcgcaaaaaggaaatctggagcggcgagatgtctatcccttcgttccgcaacaacctcccaatcgacgtccacggaaattccgtacaagtgacgaaggagaaatccggcgactacatcgcgtcagtgtcccttttcagtagcaaattcatcaaggagaacgatctgccaaacggcaagatccttgtgaagctcagcacccggaaacagaactcgatgaaggtgattctggacaagatcattgacagtacctacgcaaaaggagcgtgcatgttgcacaagcacaagaacaaatggtatctatccatcacctacaaggccaccaaaaaggaaggccataagttcgacgaggatctcatcatgggaatagacatggggaagatcaacgcactctatttcgcctacaacaaggggctagtgcgtggcgtcattagcggtgaggaaatcgaggctttccgcaaaaaggttgagtaccgccggatctctctattgagacaggggaaatactgctctgagaaccgtatcgggaaggggcgcaaaaagcgcatcaagccgattgaggttctcaacgacaagattgccaaattccgcaacgccacgaaccataagtacgccaattacattgtgcagcagtgcctcaagtacaactgcggcacgatccagttggaagacctcaaggggattagcaaggaacaaacattcctcaagaactggacgtacttcgacctccaggagaagatcaaaaaccaggctaaccagtatggcgtaaaggtcgtgaagattgacccaagttacacgagccagcggtgctccgaatgcggctatatccacaagaacaacaggcaagaccagtcaactttcgagtgccagcagtgctcgttcaaggcccacgccgactacaacgccgccaagaatatctctatctacaatatcgaaaaggttattcagaaacagctagaattacaggagaaactcaacttgacgaagtacaaggagcagtacatcgagcaaatggagaacattaactga

SEQ ID NO: 3140 - DNA, 1353 bp, Unknown
  Bacillus sp. multi
ttgtcgatagctgtgaaggtcatgaagtaccaaatagtgtgtccagtcaacatcgagtggaagaccttcgagatataccttagaaccctctcgtaccacttccgcaccatcggaaacaggacgatccagaagctctgggagtacgacaaccagagcctcaagcacttcaaggacacgggccagtacccttcggcccagcaactctacggctgcacccagaagactatcagtggctatatctatgaccagctaaaggaggagtaccaggatattaacaaagccaatatgtccaccaccctccagaaaactatcaagacatggaactcccgcaagaaagagatttggagcggtgagatgtccattccctccttccgtaacaacctgcccatcgacattcacggaaactccatccagatcatcaaggagaagtcgggtgactatatcgccagtgtgtcactgttctcctcgaagttcattaaggagaacgacctccccaacggcaagatcctagtaaagctctcaacgcgcaaacagaacagcatgaaggtgatcctggaccgaatcatcgacagcacttacgctaaaggggcgtgcatgttacataagcacaaaaagaagtggtatttgagcatcacatacaaaagcaacatcaaggaggaactaaagttcgacgaagaccttatcatggggatcgacatgggaaagatcaacgtcctatacttcgccttcaacaagggccttgtgcgtggcgctatctctggcgaggagattgaagccttccgcaaaaagatcgagcatcgccgcatatctctcctcagacagggcaagtactgctctgggaacagaattggccagggccgcaaaaagcggattaagcctattgaagtgcttaacgacaagatcgccaaattccgcactgccaccaaccacaagtacgccaactacatcgtccagcagtgcttgaagtacaactgcgggaccattcagcttgaagacctacagggaatctctaaggaacaaaccttcctcaagaactggacttacttcgacctacaggagaagatcaaaaaccaggccaaccagtacgggatcaaggttgttaagatcgacccaagctacacctcccagagatgcagcgagtgcggctacatccacaagaacaacagacaaaatcagagcactttcgagtgccagcagtgctctttcaaagttcacgcggactacaacgccgccaagaatatcagcgtttacaatatcgagaaggtcatccagcgccaactaaaactacaggagaagctgaatctgaccaagtacaaggagcagtacatcgagcagatggagaacatcaactag

SEQ ID NO: 3141 - DNA, 1353 bp, Unknown
  Bacillus sp. multi
ctctccatcgccgtgaaggtcatgaagtaccagatcgtctgtccggtgaatatcgaatggaaaaccttcgaaatctacctacgcacactcagctaccacttccgcaccatcgggaacaggaccatccagaagctctgggagtacgataatcagagccttaagcactttaaggacacaggccagtatccctcagcgcagcagctctacggttgtactcagaaaactatctcgggctacatctacgaccagctcaaggaggagtaccaggacatcaacaaggcgaatatgtccacaaccttacagaaaaccatcaagacgtggaacagtcgcaagaaggagatatggagcggagagatgagcattccgtctttccgaaacaaccttccaattgatatacacggaaactccatccagatcatcaaggagaagtccggtgactacatcgcgtccgtttcactgtttagctctaagttcatcaaggaaaacgacttgccgaacgggaaaatccttgtcaagctatccaccaggaagcaaaacagtatgaaggtgattcttgaccgcatcatcgactcgacttacgctaaaggtgcgtgcatgttgcacaagcacaagaagaaatggtacttgtcgattacctacaagtccaacattaaggaggagttgaagttcgacgaggatctgataatggggatcgacatgggcaagatcaacgtcctctacttcgccttcaacaaggggcttgtcagaggtgccatatcaggcgaggaaatcgaggcgtttcgcaagaagatagagcaccgccgcatctcattgctccgacaggggaaatactgctccggaaaccggatcggccagggtcgcaagaaacgtatcaagcccattgaggtgctgaacgacaagatagcgaagttccgtaccgcaacaaaccacaagtacgctaattacatcgtgcagcagtgcctaaagtacaactgcggaacgatacagcttgaagacttacaagggataagtaaggagcagacgttccttaagaactggacatacttcgacctccaggagaagatcaaaaaccaggccaaccagtacggtattaaggtcgtgaagatcgacccgtcctatacctcccagagatgctccgagtgcgggtacatccacaaaaacaaccgccagaatcagtccaccttcgagtgccagcagtgctcgtttaaagtgcacgcggactacaacgcagccaagaacatctccgtgtacaacatcgagaaggtcattcagcggcagctcaagctccaggagaagttgaacttgaccaagtacaaggaacagtatatcgagcagatggagaacatcaactga

SEQ ID NO: 3142 - DNA, 1353 bp, Unknown
  Bacillus sp. multi
ttgtccatagccgtgaaagtcatgaagtaccagatcgtgtgcccggtgaacatcgagtggaagactttcgaaatctatctccggacactcagctaccactttcgcaccattggcaaccggactattcagaagctgtgggagtacgacaaccagtcgttgaaacacttcaaagacactgggcagtacccctctgcccagcaactatacggctgcacgcaaaaaaccatcagcgggtacatctacgaccagctcaaggaggagtaccaggacattaacaaggcgaatatgagcaccacacttcagaagacaatcaagacgtggaactctcgcaaaaaggagatatggagtggcgagatgagcatcccgagcttccgcaacaacctccccattgacatacacgggaacagtattcagattatcaaggagaagtctggggactacatcgcaagcgtttcgctattcagtagcaagttcatcaaggagaacgacttgccgaacggcaagatcctcgtgaagttatcaactcggaagcagaactccatgaaggtgatccttgaccggataatcgacagcacttacgctaagggcgcgtgcatgttgcacaagcacaagaagaagtggtatctgagtatcacctacaagtccaacatcaaggaggagttgaaattcgacgaagacctcataatgggaatagacatgggaaagatcaacgtactttacttcgcattcaacaagggtctggtgcggggagcgatctccggggaggaaattgaggcgttccgcaaaaaaatcgagcaccgacgtatatccttgctgcgtcagggcaaatactgctctggcaaccgcatcgggcaaggtcgcaaaaaacgcatcaagccaatcgaagtgctaaacgacaagatagcgaaattccgcactgctacgaaccacaaatacgccaactacattgtgcagcagtgcctcaagtacaactgcgggacgatccagttggaggacttacagggtatcagtaaggagcagaccttccttaagaactggacgtactttgacctccaggagaagatcaaaaaccaggccaaccagtacggcattaaggttgtcaagatcgacccgtcatacacatcacagcgctgctcggaatgcgggtacatccacaagaacaacaggcaaaaccagtcaactttcgagtgccagcagtgctcgttcaaggttcacgctgactacaacgcggccaagaatatcagcgtttacaacattgagaaggtcatccagaggcagttgaagctccaggagaagctaaacctgaccaagtacaaggagcagtacatcgaacagatggaaaacatcaactga

SEQ ID NO: 3143 - DNA, 1353 bp, Unknown
  Bacillus sp. multi
ttgtcaattgccgtgaaagtgatgaagtaccagatcgtgtgtcccgtcaacatcgagtggaagaccttcgaaatctacctccggaccctctcataccacttccggacaattgggaacaggactattcagaaactatgggagtacgacaaccagtccctcaagcacttcaaggacaccgggcagtacccgtccgcccagcagctctacggctgcacacagaaaaccatatccggctatatctacgaccagctcaaggaggagtaccaggacatcaacaaagcaaacatgagcacgactctccagaagactattaagacttggaactctcgcaagaaggaaatctggagtggggagatgtcgatacccagtttccggaacaaccttccgatagacatacacgggaacagcattcagatcatcaaggaaaagtccggcgactacatcgcctctgtcagcctgttctcctctaagttcatcaaggagaacgacctccctaacggcaagatacttgtgaagctgagcacccggaagcagaactcgatgaaggtgattcttgaccgtatcatcgacagcacctacgcgaagggtgcgtgcatgttacacaagcacaagaaaaagtggtatctcagcattacctacaaaagcaacattaaggaggagttgaaattcgacgaggacttgataatgggcatcgacatgggcaagatcaacgtactatacttcgccttcaataagggactcgtccgaggggcaatcagcggggaggagatcgaggcgttccgcaagaagattgagcacaggcgaatcagcctgctgcgtcaggggaaatattgttctggcaaccgcatcggacaagggcgcaaaaaacggattaagcctatagaggtgctcaacgataagattgccaaattccgtactgctactaatcacaagtacgctaactacatcgtgcagcaatgcctcaagtacaactgtgggaccatacaactggaagatttgcaagggatcagtaaagagcaaactttcctcaagaattggacgtacttcgacctacaggagaagatcaaaaaccaggccaaccagtacgggattaaggtcgtgaagatcgacccctcttacacatcccagaggtgcagcgagtgcgggtacatccacaagaacaaccgccaaaatcagagcaccttcgaatgccagcagtgctcgttcaaggtgcacgcggactacaacgccgccaagaatatctccgtgtacaatatcgaaaaggtcattcagagacagctaaagctacaggagaaactaaaccttacaaagtacaaggagcagtacattgagcagatggagaacatcaactag

SEQ ID NO: 3144 - DNA, 1353 bp, Unknown
  Bacillus sp. multi
ctttccatcgctgtaaaggtgatgaagtatcagatagtgtgtccagtgaatatcgagtggaagaccttcgaaatctacttgcgaactctatcctatcacttccgaaccatcggcaacaggaccatccagaagctgtgggagtacgacaaccagtccctcaagcactttaaggataccggacaatacccgtccgcccagcagctctatggctgcacccagaaaaccatctccggctacatctatgaccagctcaaagaggagtatcaggacattaacaaggccaatatgagcaccacactccaaaaaaccattaagacttggaactcccgcaagaaggaaatctggagcggcgagatgtccatccccagctttcgtaacaatttgccaatcgacatccacggcaactcgatccagatcatcaaggagaagtccggtgattacatcgccagcgtgtccctgttctctagtaagttcatcaaggagaatgacctgccaaacgggaagattctcgtgaaactctctacgaggaagcagaactccatgaaggtgatcctcgacaggatcatcgactcgacgtacgcgaaaggagcgtgcatgttgcacaaacacaaaaagaaatggtatctcagcatcacgtacaagtcgaacatcaaggaggaactcaaattcgacgaagacctaatcatgggaatcgacatgggcaagatcaatgtcctgtacttcgccttcaacaagggccttgtcaggggcgcgatctccggggaggaaatcgaggctttccgcaagaagattgagcaccgccgtatcagcctgttgcgtcagggcaaatattgctctgggaacagaatcggtcaggggcgcaaaaagcgcatcaagcccattgaggtcttgaacgataagattgcgaagttcagaactgcgactaatcacaagtatgcgaactacattgttcagcagtgcttgaagtacaattgcggcacaattcaattggaagacctacagggaatatctaaggaacagacattccttaagaattggacctacttcgacctccaggaaaaaatcaagaaccaggctaaccagtatgggattaaggtggtgaagatcgacccatcctatacgagccagcggtgcagcgagtgcggctacatccacaagaacaaccggcagaatcagagtacattcgagtgccagcagtgctcgttcaaggtgcacgccgactacaacgctgccaagaacatctccgtttacaatatcgagaaggtgatccagaggcagctcaagctccaggagaagttgaacttgacaaagtacaaggaacagtacatcgagcagatggagaatatcaattga

SEQ ID NO: 3145 - DNA, 1353 bp, Unknown
  Bacillus sp. multi
ctcagtattgcagtcaaggtcatgaagtaccagatcgtgtgccccgtgaatatcgagtggaagaccttcgaaatctacctccgaacgctctcctaccacttccgcaccattgggaacaggaccatccagaaactctgggagtacgacaaccagagcctcaagcacttcaaggataccggccagtaccccagtgctcagcagttgtacggctgcacccagaaaactatttcgggctacatctacgaccagctcaaagaggagtatcaggacattaacaaggccaatatgagcacgaccttacagaagactatccggacctggaactcccgcaagaaagagatttggagcggcgaaatgagcatcccttccttccgcaacaacttgcctatcgacatacacggcaacagcatccagatcatcaaggaaaagtcaggcaactatatcgcctcggtcagcttgttctcctccaagttcatcaaggagaacgacttgcccaacgggaagatcctcgtcaagctcagcacgcggaagcagaactccatgaaggtcattctcgaccgcatcattgacagcacctacgcaaaaggagcgtgcatgttacacaaacacaagaagaaatggtacttgagtatcacctacaagagcaacatcaaggaggaactgaaattcgacgaagaccttatcatggggatcgacatgggcaagatcaacgtcctctacttcgcattcaacaagggactcgtgcggggtgcgatcagtggcgaggagattgaggcttttcgcaaaaagatcgagcaccgtcgtatcagcctgctccgccagggcaaatattgttctggaaaccgcatcggaaaggggcgtgagaaaaggatcaagccgattgatgtgctgaacgacaaggttgccaaattccgcaacgctacgaaccataagtacgccaactatatcgtccagcagtgcctcaagtacaattgcggcactattcagttggaagacttgaagggaatctctaaggagcagacgttcctcaagaactggacttacttcgacctccaggagaagatcaaaaaccaggccaaccagtacggtgtaaaagtcgtgaagattgacccgtcctacacctcccagaggtgcagtgagtgcgagtacatccacaagaacaaccgccaggaccaatccacctttgagtgtcagcagtgcagctttaaagtgcacgcagactacaacgctgccaagaacatctctgtgtacaacatcgagaaggtgatccagaagcagttggaattacaggagaaactcaatcagactaagtacaaggagcagtacatcgaacagatgaagaatatcaactaa

SEQ ID NO: 3146 - DNA, 1353 bp, Unknown
  Bacillus sp. multi
ctgtctatcgctgtcaaagtgatgaagtaccagatcgtctgcccagtaaacattgagtggaagaccttcgagatatacctgcggactctctcgtaccacttccgcaccatcggaaatcgcaccatacagaagctgtgggagtacgacaaccagagtctcaagcacttcaaggataccggccagtatccatccgcgcagcaactttacggctgcacgcagaaaaccatcagcggctacatctacgaccagctcaaggaggagtaccaggacatcaataaggcgaacatgagtacgaccctccagaaaaccatccgtacctggaactcccgcaagaaagagatttggagtggcgagatgagtatcccctcattccggaacaacctccccattgacattcacggcaactccatccagatcatcaaggagaagtcaggcaactacatcgcaagcgtctcactctttagcagcaagttcatcaaggagaacgacttgcccaacggaaagatcctggttaaactttctacccgcaagcagaacagcatgaaggtgatcctagaccggataatcgacagtacctacgctaagggagcttgcatgttgcacaaacacaagaagaaatggtatttgagtatcacctacaagtcgaacattaaggaggagttgaaattcgacgaagacctcattatggggattgacatggggaagattaacgtactatacttcgcattcaacaaggggctcgttagaggagctatctccggcgaggaaatcgaggcttttcgcaagaagatagagcaccggcgcatctcgcttctgcgccaggggaaatactgttccgggaacagaattgggaagggccgggagaagcgcatcaagcccattgacgtgctcaacgacaaggtggccaaattcagaaatgcgaccaatcacaagtacgctaactacattgtgcagcagtgtctcaagtacaactgcggcacgattcaacttgaggatctcaaagggatctcaaaggagcagacattccttaagaactggacctacttcgatctacaggaaaaaatcaagaatcaggccaaccagtacggggttaaagtggtgaagattgacccaagctacacttcccagcgttgttcagaatgtgagtacatccacaagaacaaccgtcaggatcagtccacgttcgagtgccagcagtgctcgttcaaggtgcacgctgactacaacgcagctaagaacatctccgtttacaacatcgagaaggttatccagaagcaattggaattacaggagaagctgaaccagacaaagtacaaagagcagtacatcgagcagatgaagaatatcaactga

SEQ ID NO: 3147 - DNA, 1353 bp, Unknown
  Bacillus sp. multi
ctgtccatcgctgtgaaggtgatgaagtaccagatcgtgtgcccggtcaacatcgagtggaagacattcgaaatctacctcagaacgctgtcataccacttccgtaccatcggcaaccgcacaatccagaagctctgggagtacgacaaccagtctctcaagcacttcaaggacacggggcaatatccctctgcccagcagctttatgggtgcactcagaagactatctccgggtacatctacgaccagctcaaggaggagtatcaggacatcaacaaggccaatatgtccactaccttacagaaaaccatccgtacctggaacagccgcaagaaggagatttggagcggcgagatgagtatcccttccttccggaacaacctccccatcgacatccacgggaactccatccagatcattaaggagaagtcaggcaattacattgcaagtgtgagcctgttctcaagtaagttcatcaaggagaatgacctccctaacggcaagattcttgtcaagctgagtacccgtaagcaaaactccatgaaggttattctggacaggatcatcgacagcacatacgcgaaaggggcgtgcatgttgcacaagcacaagaagaaatggtatctgagtatcacttacaagagcaacatcaaggaggagttgaagttcgacgaagacctcatcatgggaatcgacatggggaagattaacgtattgtacttcgctttcaacaaggggcttgtccgaggtgccatcagcggcgaggagattgaggctttccgcaaaaaaatcgagcacaggcggatctccttgctcagacagggcaagtattgctcaggcaacagaattggaaaaggaagggagaaacgtatcaagccaattgacgtccttaacgacaaggtggccaagttccgtaacgccaccaaccacaagtacgccaattacatcgtgcagcagtgcctcaagtacaactgcggcaccattcaattggaggacttgaaggggatctcaaaggagcagaccttcctcaagaactggacctacttcgatctacaggagaagatcaaaaaccaggccaaccagtacggggtgaaggtggttaagattgatcccagctacacctcacagaggtgctcggagtgcgagtacattcacaagaacaaccgacaggaccagagcacctttgagtgccagcagtgttccttcaaagttcatgcagactacaacgcagccaagaacatctccgtgtacaacattgaaaaggtgatccagaagcagcttgagttacaggagaagctcaaccagaccaagtacaaggagcagtacatcgagcagatgaagaacattaactga

SEQ ID NO: 3148 - DNA, 1353 bp, Unknown
  Bacillus sp. multi
ctctcaatcgccgtgaaggtgatgaagtaccagatagtgtgcccagtgaacatcgagtggaagacgttcgagatatacctccggactctctcctaccacttccgcaccattggcaaccgcacaatccagaagctctgggagtacgacaaccagtccctcaagcacttcaaggacaccggccagtacccttctgctcagcaactctacggctgcactcagaaaactatctccggctacatatacgaccaattgaaagaggagtaccaggacatcaacaaggccaacatgagtacaaccctccaaaaaacaatccgaacgtggaacagccgcaagaaggaaatctggagcggcgaaatgtcaatcccttcattccgcaacaacctccctatcgacatccacgggaactccatccaaatcatcaaggagaagtcggggaactatatcgcctcagtctcgctcttcagttcaaagttcatcaaggagaacgacctcccaaacgggaagatcctagtgaaattgtcaactcgtaagcaaaactccatgaaggttatcctcgaccggataatcgacagcacttacgcgaagggagcctgcatgttgcacaaacacaagaagaagtggtatctgtcaataacctacaaatcgaacatcaaggaggagttgaaattcgacgaggatctcataatggggattgacatggggaagatcaacgtcctctactttgcattcaataagggcttggtcaggggtgcaatttccggggaggagatcgaggcttttcgcaagaagatagagcacagaaggatctccctcctccgacaggggaagtactgtagcgggaaccgcatcggcaaaggccgcgagaagcgtattaagcccattgacgtgctcaacgacaaggtggcaaagttcagaaacgcaacgaatcacaagtacgcgaactacattgtgcagcagtgcctcaagtacaattgtgggactatacaacttgaagacttgaaggggattagcaaggaacagacattccttaagaactggacgtacttcgacctccaggagaagatcaaaaaccaggcgaaccagtacggggtgaaagtcgtcaagatagaccctagttacacgagccagcgttgctccgagtgcgagtacatacacaagaacaaccgccaggatcagtccaccttcgagtgtcagcagtgctcattcaaagtgcacgcagactacaacgcggccaagaacatctcagtgtacaatatcgagaaggtcatccagaagcaattggaattacaggagaagctgaaccagactaagtacaaggagcagtacatcgagcagatgaaaaatatcaactga

SEQ ID NO: 3149 - DNA, 1353 bp, Unknown
  Bacillus sp. multi
cttagcatcgcggtgaaggtgatgaagtaccagatcgtgtgtcctgtcaacatcgagtggaagaccttcgagatatacctccgaactctttcctatcacttccggacaatcgggaatcgaaccatccagaagctgtgggagtacgacaaccagagcctcaagcacttcaaggacaccggccagtacccatctgctcaacagttgtacggctgcacgcagaagactatctctggctacatctacgaccaattgaaggaggagtaccaggacatcaacaaggcgaatatgagtaccaccttgcaaaaaactatccgcacctggaactcgcgcaaaaaggaaatctggagcggggaaatgagcatcccctcgttccgtaacaacctccccatcgacatccacggcaatagcatccagatcatcaaggaaaagtccggaaactacatcgccagcgtgagtctattctcatccaaattcattaaggagaatgacctccccaacggcaaaatcctggtgaagctgtccacccgtaaacaaaacagcatgaaggtgattctggacaggataatcgactcaacctacgctaagggtgcctgcatgttgcacaagcacaagaagaagtggtacttgtcgattacttacaagagcaacattaaggaggagcttaagttcgacgaagacctcattatggggatagacatggggaagatcaacgtcctctacttcgctttcaacaaggggttggtgaggggagccataagcggtgaggagatagaggctttccgcaagaagatagagcacagacgtatcagcctgctcaggcaagggaagtactgctccggaaaccgtattgggaaggggcgtgagaagcgtatcaagcctatagacgttctgaacgacaaagttgccaaattccgtaacgccactaaccacaagtacgccaactacatcgtccagcagtgcttaaagtacaactgcgggactatccaactagaggatctaaaggggataagtaaggagcagacctttctcaagaactggacctactttgacctccaggagaagatcaaaaaccaggcaaaccagtacggcgtcaaggtcgtgaagatagacccctcctacaccagccagcgctgctctgagtgcgagtacatacacaagaacaaccgccaagaccagtcaaccttcgagtgccagcagtgctccttcaaggtgcacgctgactacaacgccgccaagaacatctccgtgtacaacatcgaaaaggtgattcagaagcagctcgaactccaggagaagctcaaccagacgaagtacaaggagcagtacatcgagcagatgaaaaatatcaattga

SEQ ID NO: 3150 - DNA, 1332 bp, Unknown
  Bacillus sp. multi
atgaagtaccagatcgtgtgccccgtgaacatcgagtggaagaccttcgaaatctacctacgcaccctatcctaccacttcagaaccatcggaaatcggacaatccagaagctgtgggagtacgacaaccagtcgctcaagcacttcaaggacaccgggcagtacccgtccgcccagcagctctacggttgtactcagaagactatctccggttacatctacgaccaattgaaggaggagtaccaggacatcaacaaggcaaacatgagcacgaccctccagaagactattaagacatggaactcccgcaagaaagagatttggagtggcgagatgagcatccccagcttccgtaacaaccttcctatcgacatccacggaaacagtatccagatcatcaaggagaagtcaggcgactacatcgcctccgtgtcccttttcagcagcaaattcattaaggagaacgaccttccaaacggaaagatcctggtgaagctctccacgcggaaacagaatagcatgaaggtgatcctggaccgcataattgactcaacgtacgcgaagggagcgtgcatgttacacaagcacaagaagaagtggtatttgagtattacttacaagtccaatatcaaggaggagcttaagttcgacgaggatcttatcatgggaattgatatggggaagatcaacgttctctacttcgcattcaacaagggactcgtgcgtggggctatctccggggaggagatcgaggcgttccgcaaaaaaatcgagcacagacgcatctctctgctccgccagggcaaatactgttccggcaatcgtatcggcaagggtcgcaaaaaacgtattaagcccatcgaggttctgaatgacaagatagccaagttcagaactgcgactaatcacaagtacgcaaactacatcgtacagcaatgcctcaaattcaactgcgggaccatacagttggaggatctacagggtatcagcaaggagcagacgttcctcaagaactggacctactttgacctccaggaaaaaatcaagaatcaggcgaatcagtacgggatcaaggtggtcaagatcgacccctcatacaccagtcagcgatgcagtgagtgcggctgcatccacaagaacaaccggcagaaccagtcaacattcgagtgccagcagtgctcattcaaagtccacgccgactacaacgcagctaagaatatctctgtgtacaacatcgagaaggtgattcagaagcaactcaaactacaggagaagctaaatctgaccaagtacaaagagcagtatatcgagcagatggagaacattaactag

SEQ ID NO: 3151 - DNA, 1332 bp, Unknown
  Bacillus sp. multi
atgaagtaccagatcgtttgcccggtcaatatcgagtggaagaccttcgagatatacctcagaactctcagctaccacttccgaacgattggcaaccgaacgatccagaagctctgggagtacgacaaccagtcgctcaaacacttcaaagataccgggcagtacccatccgctcagcagctttacggatgtacgcagaaaaccatctcgggctacatatacgatcagcttaaggaggagtaccaggacattaacaaagccaatatgtccacgaccctccagaaaaccatcaagacttggaactcccgcaaaaaagagatttggagcggagagatgtctatcccgtcgttccgcaacaacctgcctattgacattcacggcaattcaatccagatcattaaggagaagtctggagactatatcgcatccgtgtccttattctccagcaagttcatcaaggagaacgacttgccgaatgggaagatcctggtgaagttgagcactcgcaagcagaactcgatgaaggtgattcttgaccgtatcatcgactccacatacgcaaagggagcgtgcatgttgcacaagcacaaaaagaagtggtacttgtcaatcacctacaagagtaacattaaggaggaattgaagttcgacgaggacttgataatggggatcgacatgggcaagattaacgtgctgtacttcgcattcaacaaggggctcgtgcgaggggcgattagcggggaggagattgaagcgttccgcaagaaaatcgagcacaggcggatctccctgctgagacaagggaagtactgctccgggaaccgcatcgggaaggggcgcaagaagcgtatcaagcccatcgaagtcttgaacgataagatcgccaagttcagaaccgctacgaaccacaagtacgccaactatatcgtccagcagtgcctcaaattcaactgcggcaccatacagttggaagacctacagggaatcagcaaggagcagactttcctcaagaattggacctatttcgatctccaggaaaaaatcaagaaccaggcaaatcagtacgggattaaggtggtgaagattgacccctcctataccagccagaggtgcagcgagtgtgggtgcatccacaagaacaaccgccagaaccagagcaccttcgagtgccaacagtgcagcttcaaggttcacgccgactacaacgctgccaagaacatcagcgtttacaacatcgagaaggtcattcagaagcaattgaaactccaggagaagctcaacctgaccaagtacaaggagcagtacatcgagcagatggagaacatcaactga

SEQ ID NO: 3152 - DNA, 1332 bp, Unknown
  Bacillus sp. multi
atgaagtaccagatcgtgtgtcccgtgaacatcgagtggaagaccttcgagatatacctgaggactctctcataccacttccgaaccattggaaaccggaccattcagaagttgtgggagtacgacaaccagagtcttaagcacttcaaggacaccgggcagtacccctccgcgcaacagctctacggatgcacacagaaaactattagcggctatatctacgaccagctcaaggaggaataccaggacatcaacaaggccaacatgagcacaactttgcagaagactattaagacatggaacagccgcaagaaagagatttggagcggcgagatgagtatcccttcattccgaaacaacctcccaatcgacatacacggcaactctatccaaatcatcaaggagaaatctggggactacatcgcctctgtgtccctcttcagttccaaattcatcaaggagaacgacctgcctaacggcaagatactggtgaagttgtccacccgcaagcaaaactctatgaaggttatcttggacaggatcatcgactctacatacgcgaaaggagcgtgcatgttacacaaacacaaaaagaaatggtacttgtcaatcacatacaagagcaacatcaaggaggagcttaagttcgacgaggatctcattatggggatagacatggggaagatcaacgtcctgtactttgcgttcaataaggggctggtcaggggcgctatcagtggcgaggagatcgaggcgttccgcaaaaagatcgagcaccggcgaatctctctccttcgtcagggcaagtactgttcggggaacaggatcgggaaggggcgcaaaaaacggattaagcctattgaagtcctaaatgataagatcgccaagttccgcacagcgacaaatcacaagtacgccaactacattgtgcaacaatgcctcaaattcaactgcgggacgattcaacttgaggacttacaggggataagcaaggagcagacattcctcaagaattggacctacttcgacctacaggagaagatcaaaaaccaggccaaccagtacggcatcaaggtggtgaagatagaccccagctacactagccagaggtgctcggagtgcgggtgcatccacaagaacaacaggcagaaccagagcacgttcgagtgccagcagtgcagcttcaaagtgcacgcggactacaatgccgccaagaacatctccgtgtacaacatcgagaaggtgatccagaagcaattgaagctccaggagaaactcaacttgactaagtacaaggagcagtacattgagcagatggagaacattaactga

SEQ ID NO: 3153 - DNA, 1332 bp, Unknown
  Bacillus sp. multi
atgaagtaccaaatcgtgtgccctgtaaacatcgaatggaagacgttcgagatatacctccgaaccctgagctaccacttccgtaccatcggcaaccgtacgatccagaagctctgggagtacgacaaccagtcccttaagcacttcaaggataccggccagtaccccagtgcacagcaactctacggatgcacccagaagacgatcagcggctacatctacgaccagcttaaagaggaataccaggacatcaacaaggcgaacatgagtacgaccttgcaaaaaactatcaagacctggaactcacgcaagaaagagatatggagtggggagatgagtatcccctccttccgaaacaacctgcctattgacatccacgggaacagcatccagatcatcaaggagaagtcaggcgactacattgcctccgtttcactattctcctccaagttcatcaaggagaacgaccttccgaacggaaagatccttgtgaagctctccactcgcaagcagaactccatgaaggtgattcttgaccgcatcatcgactcaacctacgcgaaaggtgcttgcatgttgcataagcacaaaaagaaatggtatttgagcataacctacaagagtaacattaaggaggagttgaagttcgacgaggacttgataatgggaatagacatggggaagatcaatgttctgtacttcgcgtttaacaagggcctggtgcggggagccatatcgggtgaggagatcgaggcttttcgcaagaagatagagcaccgccggataagcctattgcgtcaggggaagtattgttccgggaaccgaatcggaaaggggcgcaagaaacgcatcaagcctatcgaagtcctcaacgacaagatcgccaaattccgtacagcgacgaatcacaagtacgccaactacatcgtccaacagtgcttgaagttcaattgcggaaccatccagcttgaagatttgcaagggataagtaaggagcagacgttcctcaagaattggacctacttcgacctacaggaaaaaatcaagaaccaggctaaccagtacggcattaaggtggttaagatcgacccgagctacacctcccagcgctgctcagagtgtgggtgcatacacaagaacaaccgtcaaaaccagagtaccttcgagtgtcagcagtgcagcttcaaggtgcacgccgactacaacgccgctaagaacatctctgtgtacaacatcgagaaggtcatacagaaacaacttaagctccaggagaaactaaacctcaccaagtacaaggagcagtacattgagcaaatggagaacatcaactga

SEQ ID NO: 3154 - DNA, 1332 bp, Unknown
  Bacillus sp. multi
atgaagtaccagatcgtgtgcccggtgaacatcgaatggaagacattcgaaatctacctgcgaacgctgtcgtaccacttccgtaccatcggcaaccgcaccatacaaaagctctgggagtacgacaaccagtcgctcaagcacttcaaggacaccggtcagtacccgtctgcccagcagctttacggctgcacccagaaaacaatctccggctacatctatgaccagcttaaggaggaataccaggacatcaacaaagccaatatgagcaccaccttgcagaagactattaagacatggaactcccgcaagaaagagatatggagcggtgaaatgtccatcccttcgtttcggaacaacctccccattgacattcatggaaactctatccagatcatcaaggagaagtcaggggactacattgcaagcgtgagccttttcagtagcaaattcatcaaggagaacgacctccccaacggcaagatccttgtgaaactcagtaccaggaagcagaacagtatgaaggtgatcctcgaccgtatcatcgacagcacctacgcgaaaggggcctgcatgttgcacaaacacaagaagaaatggtatctgtccatcacgtacaagtccaacatcaaggaggagttgaaattcgatgaagaccttatcatgggcatcgacatgggcaagataaacgtcttgtacttcgcattcaacaagggcctggtgcgcggggccatcagtggcgaggagatcgaggcgtttcgcaaaaagatcgagcacaggaggatctctctcctgcgacagggcaagtactgttccggaaaccgaattgggaagggacgcaaaaaacgcatcaagcccatcgaggtgttgaacgacaagatcgccaagttccgcactgctaccaaccacaagtacgcgaattacatcgttcagcagtgcttgaagttcaactgcggcactattcaacttgaggacttgcaaggaatcagtaaagagcagacgttccttaagaactggacctacttcgacctacaggaaaaaatcaagaatcaggccaaccagtacgggatcaaggtggtcaagatcgaccccagctacacttcgcagaggtgcagtgagtgcggctgcattcacaagaacaacagacagaaccagtcaacgttcgagtgccagcagtgctccttcaaggtgcacgccgactacaacgccgctaagaacatctcggtttacaatatcgaaaaggtgatccagaagcagttaaaactccaggagaagttaaacctgactaagtacaaggagcagtacattgagcagatggagaacattaactag

SEQ ID NO: 3155 - DNA, 1353 bp, Unknown
  Bacillus sp. multi
ctgtcaatagccgtaaaggtcatgaagtaccaaatcgtgtgccccgtcaacatcgagtggaagaccttcgaaatctaccttagaaccctatcctaccactttcgcaccatcggcaaccgaacaattcaaaagctctgggagtacgataaccagtccctcaagcacttcaaggataccggccagtacccatccgcccagcagctttacgggtgcacacaaaaaacgatcagcgggtacatatacgaccagctcaaggaggagtaccaagacatcaacaaagccaatatgtccacgacccttcaaaaaacaattcggacctggaacagccgcaagaaggaaatctggagtggggaaatgagcataccgagtttccgtaacaaccttcctatcgacattcacggcaactccatacagatcattaaggagaaatctggcgactacatcgccagcgtttcgctgttcagttccaagttcatcaaggagaacgacctgcccaacgggaagatcctcgtgaaacttagcacgcggaagcagaacagcatgaaggtgatcctcgaccgcatcatcgacagcacctacgctaagggagcctgcatgttgcacaagcacaagaagaagtggtatctgagcatcacctacaaaagcaacatcaaggaggagttgaaattcgacgaagacctgataatgggcattgacatgggaaagatcaatgtcctctatttcgcgttcaacaagggcctcgtccgtggcaccataagcggtgaggagattgaggctttccgcaaaaaaatcgagcacaggcggatctcactcctcagacaaggcaagtattgctccggcaaccgcatcggcaaggggcgcgaaaagcggatcaagcctattgacgttctgaatgacaaggtggccaaattccgcaatgccactaaccacaagtacgcgaactacatcgtgcagcagtgcttgaagtacaattgcggcaccattcagttggaagaccttaagggcatctctaaagagcagaccttcctcaagaattggacttacttcgacttacaggagaagatcaaaaaccaggctaaccagtatggggtcaaggtggtcaagattgacccctcttacacctccaagcgctgttccgaatgtgagtacatccacaagaacaaccgccaggaccagagtacgttcgagtgccaacagtgctcgttcaaggtgcacgctgattacaatgccgccaagaacatctcggtgtacaacatcgagaaggtgatccagaagcagcttgagttacaggagaaacttaaccagacaaagtacaaggagcagtacatcgagcagatgaagaatatcaactga

SEQ ID NO: 3156 - DNA, 1353 bp, Unknown
  Bacillus sp. multi
ctgtcaattgcggtgaaggtgatgaagtaccaaatagtgtgcccggtgaacatcgagtggaagacgttcgagatatacctcaggacgctctcgtaccacttccgcaccatcggcaaccgtaccatccaaaagctctgggagtacgacaaccagtcactcaagcacttcaaggatacgggtcagtacccctcggcccagcagctctatggttgcacgcaaaaaacaatctccggctacatctacgaccaattgaaggaggagtaccaggacattaacaaggcgaatatgtccacaacgcttcaaaaaaccatccgtacttggaactcccgcaagaaagagatatggagcggggagatgtccattccatcgttccgaaacaacctacctattgacattcacggcaactccatccagatcatcaaggagaagtccggcgactacattgcttctgtgtctctattctccagcaaattcatcaaggagaacgacctgcccaacggaaagattctcgtcaagctaagcaccaggaagcagaacagcatgaaggttatcctcgacaggataattgactccacatacgcaaaaggtgcctgcatgttgcacaagcacaagaagaagtggtacttgagtatcacctacaaatccaacatcaaggaggagttgaaattcgacgaagaccttatcatggggatcgacatgggcaagataaacgtcttgtacttcgccttcaacaaggggctcgtccgtggcacaatctccggtgaggaaattgaggctttccgcaagaaaatcgagcaccgcagaatatcactcctgcgacaggggaagtattgctccggcaacagaattgggaaagggagggaaaagcgtattaagcctatagacgtactgaacgacaaggtggccaaattccgcaacgccacgaaccacaagtacgcgaactacatcgtgcagcagtgcctaaagtacaactgcgggacaattcaattggaagatttgaaagggatcagtaaggagcagacgttccttaagaactggacatacttcgatctccaggaaaaaatcaagaaccaggccaaccagtatggggtgaaggtggtgaagattgacccttcctacacctccaagcgttgttccgagtgcgagtacatccacaagaacaaccgccaagaccagtccaccttcgagtgtcagcagtgctccttcaaggtgcacgccgactacaacgccgccaagaacatatccgtttacaatatcgagaaggttattcagaagcaacttgaattacaggagaagctgaaccagaccaagtacaaggagcagtacatcgagcagatgaaaaatatcaattga

SEQ ID NO: 3157 - DNA, 1353 bp, Unknown
  Bacillus sp. multi
ctgagcatcgctgtgaaagtgatgaagtaccagatagtgtgtccagtgaacatcgagtggaagaccttcgagatatacctccgcactcttagttatcacttccgcaccatagggaaccgcaccatacagaagctgtgggagtacgacaatcagagtctcaagcacttcaaagatacgggccaatatccctcagctcagcagctctacggctgcacgcaaaaaactatcagtggctacatctacgaccagctaaaggaggagtaccaagacatcaacaaggccaatatgagtaccacattgcagaagaccatccggacctggaactctcgcaaaaaagagatatggagtggcgagatgtctatccccagctttcggaacaacctgcccatcgacatccacggcaatagtattcagatcattaaggagaagtcaggggactacattgccagtgtttcccttttcagctccaagttcatcaaggagaacgacctgccgaacggcaagatactggtgaagttgtccacgaggaagcagaacagcatgaaggtcatactggaccggatcatcgacagcacctacgctaaaggagcctgcatgttgcacaaacacaagaagaagtggtatctgtcaataacttacaagtccaatatcaaggaggagttgaaattcgacgaagacctcatcatgggaatagacatgggcaagattaacgtcctctacttcgctttcaacaagggcctggtgcggggaaccatctcaggggaggagatcgaggctttccgcaaaaagattgagcacaggcggattagcctcctccgccagggcaaatattgctccggcaaccgcatcgggaaggggagggagaagcggatcaagcctattgacgtgctcaacgacaaagtggccaaattccgtaacgcgaccaaccacaagtacgctaattacattgtacagcagtgcctcaagtacaactgcggaacgatacaattggaggacttgaaggggatcagtaaggaacagacgttcctcaagaactggacctacttcgacttacaggagaagatcaaaaaccaggccaatcagtacggcgtgaaggtcgtcaagatcgacccctcctacacctccaaacggtgctcagagtgcgagtacatacacaagaacaaccgacaggaccagagcaccttcgagtgccagcagtgcagtttcaaagtccacgcggactacaacgccgccaagaacattagcgtgtacaacatcgagaaggtcatccagaagcagttggaactccaggagaaactcaaccagaccaagtacaaggagcagtacatcgaacagatgaagaatatcaactag

SEQ ID NO: 3158 - DNA, 1353 bp, Unknown
  Bacillus sp. multi
ctctccattgcagttaaggtcatgaagtaccagatcgtttgcccagtcaacattgagtggaagaccttcgaaatctacctgcggacccttagctaccactttcgtaccatcggcaacaggaccatccagaaactctgggagtacgacaaccagagcttgaagcacttcaaggacaccggtcagtacccgtccgcgcagcaactctacgggtgcacacagaaaaccatctccgggtacatctacgaccaattgaaagaggagtatcaggacatcaacaaggccaatatgtcaaccacgctccagaagacgatacgcacctggaactcgcgcaagaaggaaatctggagtggcgagatgtcgattccatcgttccgcaacaacctcccgattgacatacacggcaacagcatccagattatcaaggagaaatccggcgactacatcgctagtgtctcgcttttcagttctaagttcatcaaggagaacgacctgccgaacgggaagattctcgtcaagctatccaccaggaagcagaacagcatgaaggtcatcctggaccgcatcatcgactcaacctatgcaaaaggggcctgcatgttgcataagcacaagaagaaatggtacttgtccataacatacaagtccaacatcaaggaggagcttaagttcgatgaagacctgataatgggcatcgacatggggaagatcaacgtactttacttcgcattcaacaagggcctcgttagagggaccatctcaggcgaggagattgaagcgttccgcaaaaaaatcgagcacagacgaatctctctcctgagacaggggaagtactgttccggcaatcggattgggaagggacgggagaagcggattaagcccattgatgtgctgaatgacaaggtggccaagttccgcaacgcaacaaaccacaagtacgcgaactacatcgtgcaacagtgcttgaagtacaattgcgggacgatacagttggaagacctgaaagggatctcgaaggagcagaccttcctcaagaattggacgtacttcgacctacaggagaagatcaaaaaccaggccaaccagtacggagtgaaggtcgtcaagatcgacccttcctacacttctaagcgctgctccgagtgcgagtacatccataagaacaaccgtcaagatcaatctacgttcgagtgtcagcagtgttccttcaaggtccacgccgactacaacgcagccaagaacatcagcgtgtacaacatcgaaaaggtcatccagaagcaactggagctacaggagaaactcaatcagacgaagtacaaggaacagtacatcgagcagatgaaaaacatcaactga

SEQ ID NO: 3159 - DNA, 1353 bp, Unknown
  Bacillus sp. multi
ttgtcaattgcagtaaaggttatgaagtaccagatagtgtgtccggtcaacatcgagtggaagacgttcgagatatacctccgcaccttgtcctaccactttcgaactatcgggaaccgaacgatccagaagctctgggagtacgacaaccagtccctcaagcacttcaaggacacagggcagtacccatctgcacagcaactctatggctgcacccagaaaaccatcagcggctatatctatgaccagctcaaggaggagtaccaggacatcaacaaggccaatatgagcacaaccctccagaagactatccgcacctggaactcccgcaagaaggaaatctggagcggggagatgtccattccgagtttcagaaacaacctgccaatcgacatccacggcaactctatccagatcatcaaggagaagtcaggagactacattgcctccgtatcgctctttagcagcaagttcattaaggagaacgacctgcccaatgggaagatccttgtcaagctctccacccggaagcagaactccatgaaggttatcctagatcgcataatcgacagcacctacgcgaaaggcgcgtgcatgttgcacaagcacaaaaagaagtggtatctgtccatcacctacaaaagcaacatcaaggaggagttgaaattcgacgaggatcttatcatgggcatcgacatgggcaagataaacgtcctctacttcgccttcaacaagggtctagtaagagggacaatctctggcgaggagatcgaggcgttccgcaagaagattgagcacaggcggatctcactgctccgtcagggcaagtactgctctggcaacaggatcggcaagggccgcgagaagcgcattaagccaattgacgttctgaacgacaaggtggctaagttccgtaacgccacgaaccacaagtacgccaactacatcgtccagcagtgcttgaagtacaactgcggcaccatccagcttgaggacttaaaagggatctcgaaagagcaaacattcctcaagaactggacctacttcgacctccaggaaaaaatcaagaatcaggcgaatcagtacggggtgaaagtggtgaagatcgacccctcatacaccagcaaacgttgcagcgagtgtgagtacattcacaagaacaaccgtcaggatcagtccacattcgagtgtcagcagtgcagcttcaaagttcacgctgactacaatgctgctaagaatatctcagtttacaacatcgagaaggttattcagaagcagttggaactccaggagaagttaaaccagaccaagtacaaggagcagtacatcgagcagatgaaaaatatcaactga

SEQ ID NO: 3160 - DNA, 1353 bp, Unknown
  Bacillus sp. multi
ctttctattgcagtcaaggtgatgaagtatcagatcgtatgccccgtgaacatcgagtggaagacgttcgagatatacctccgcacgctctcctaccacttccgaaccatcggaaaccggaccatccagaagttgtgggaatacgacaaccagagcctcaagcacttcaaggacaccggtcaatacccctccgcccaacagctctacggctgcacgcagaagactatcagcggctacatctatgaccagttgaaggaggagtaccaggacatcaataaggccaacatgagcactacccttcagaagactatccgcacgtggaactctcgcaagaaagagatttggagcggagaaatgagcatcccatcgttccgcaacaacctgcccatcgacatacacggcaactctattcagatcattaaggagaagtctggagactacatcgcaagtgtgtcgctgtttagtagcaagttcatcaaggaaaacgacctggccaatgggaagattctagtgaaactgtccacccgcaagcagaactctatgaaggtgatcctagaccgcatcatcgacagtacctacgcaaaaggtgcctgcatgttgcacaaacacaaaaagaaatggtacttatccataacctacaaatccaacatcaaggaggagttgaagttcgacgaagacctaatcatgggcatcgacatggggaagatcaacgtactttacttcgctttcaataagggtctagttcgtggagctatctccggtgaggagattgaggcttttcgcaaaaaaatcgagcaccgtcgcattagcctgctccgtcaaggcaaatattgctccgggaaccggatcggcaaggggagggagaagcggatcaagccaattgacgtgctgaacgacaaggtggccaagttccgtaacgccaccaatcacaagtacgccaactacatcgtacagcagtgcctcaagtacaactgcggaacgatccaactagaggatctaaagggcatcagcaaggagcagacattcctcaagaactggacttacttcgatctccaggagaagatcaaaaaccaggccaaccagtacggggtgaaggtggtcaagatagacccgtcctataccagtcagaggtgctccgagtgcgagtacattcacaaaaacaatcgtcaggaccagtccacattcgagtgccagcagtgctctttcaaggtccacgctgactacaacgcggccaagaacatctcggtttacaacatcgagaaggtcatccagaaacaacttgaactccaggagaaactgaaccagactaagtacaaggagcagtacatcgagcagatgaagaacataaactga

SEQ ID NO: 3161 - DNA, 1353 bp, Unknown
  Bacillus sp. multi
ctttctatcgctgtgaaggttatgaagtatcagatagtctgccctgtcaacatcgagtggaagaccttcgagatatacctgcggactctttcgtaccacttccgcaccattggcaaccggacgatccagaagttgtgggagtacgacaaccagtccctcaagcacttcaaggacaccggtcagtacccttccgctcagcagctctacgggtgtacccagaaaactatctcagggtacatatacgaccagctcaaggaggagtaccaggacatcaacaaggcgaacatgagcaccacactacagaagaccatcaggacttggaactcccgcaaaaaagagatatggagtggggagatgtccatcccttcctttcgcaacaaccttcccattgacattcacgggaacagcatccagatcatcaaggaaaagtcaggcgattacattgcttccgtgagcttgttcagtagcaagttcatcaaggagaacgacctcgccaacgggaagattctggtcaagctctccacgcggaagcagaatagcatgaaggtcatcctggacaggatcatcgacagcacttacgcgaagggcgcgtgcatgttgcacaagcacaagaagaagtggtacttgtccataacctacaagagtaacatcaaggaggagttgaaattcgacgaagaccttatcatggggatagacatggggaagattaacgtgctttactttgctttcaacaaggggctcgttcgaggtgccattagcggggaggaaatagaggcgttccgcaaaaagattgagcacagacggatcagcttgcttcgacaggggaagtactgctccggcaatcgcatcgggaagggaagggagaagcggattaagccaatagacgtccttaacgacaaggttgccaaattccgtaacgccactaaccacaagtacgccaactacatcgtgcagcagtgcttgaagtacaactgcgggacaattcagttggaggacttgaagggaatctcgaaggagcagacattcctcaagaactggacctacttcgatctccaggagaagatcaaaaaccaggccaaccagtacggagttaaggtggtcaagatagaccctagctacacctctcagcgatgctcagagtgtgagtacatacacaagaacaaccgtcaggaccagagcaccttcgagtgtcaacagtgctcctttaaggtccacgcagactacaacgccgccaagaatatcagcgtgtacaacatcgaaaaggtgattcagaagcaattggaactccaggagaaactcaaccagactaagtacaaggaacagtacatcgagcagatgaagaacattaactaa

SEQ ID NO: 3162 - DNA, 1353 bp, Unknown
  Bacillus sp. multi
ctgtccatcgccgtgaaggtgatgaagtaccagatcgtgtgccccgtgaacatcgagtggaagacattcgagatatacctcaggacgctctcctaccacttccgtacaatcgggaaccgcaccatccagaaattgtgggagtacgacaaccagtccctcaagcacttcaaggataccggccaatacccctccgcccagcagctttacgggtgtactcaaaaaacgatctccgggtacatatacgaccagctcaaggaggagtaccaggacatcaacaaggcaaacatgagtaccaccctacagaagactatccgcacctggaactcccgcaaaaaggaaatctggagcggtgagatgtcgatcccctctttccgcaacaacctacccattgacatccacgggaactccatccagatcatcaaggagaagtctggagactacattgcctctgtcagtctgttctcgtcgaagttcatcaaggaaaacgatctagcgaacggcaagatcctagtcaaactcagtaccaggaagcagaatagtatgaaggtcatcttagatcggataatcgactctacatacgctaagggcgcgtgcatgttgcacaagcacaagaagaagtggtatcttagtattacatacaagtccaacatcaaggaggagcttaagttcgatgaagacctcataatgggaatcgacatgggcaagattaacgtgctgtacttcgcctttaacaaggggctggtgcgcggcgcgatctccggtgaggagattgaggcgttccgcaagaagattgagcacaggaggatcagcctacttcgacaggggaaatactgctcaggcaaccggattgggaaggggagggagaagcgtatcaagcctattgacgtgctaaatgacaaggttgccaaattccgcaatgccaccaaccacaagtacgcgaactacatcgttcagcagtgtcttaagtacaactgcggcacaattcagttggaagatttgaaagggatctctaaggaacagaccttccttaagaactggacctacttcgatctccaggagaagatcaaaaaccaggctaaccagtacggcgtgaaggtggtgaagattgaccccagctacacctcccaacgctgtagcgagtgcgagtacattcacaagaacaacagacaggatcagtcaacgttcgagtgccagcagtgctcattcaaagtgcacgcagactacaacgcggccaagaacatatccgtgtacaatatcgagaaggtcatccagaagcaactagaactacaggagaaactcaaccagacaaagtacaaggagcagtatatcgaacagatgaagaacattaactga

SEQ ID NO: 3163 - DNA, 1353 bp, Unknown
  Bacillus sp. multi
ctctccatagcagtcaaggtgatgaagtaccagatcgtgtgccctgtcaacattgagtggaagacattcgaaatctacttgaggactcttagttaccacttccgcaccatcggaaatcgcaccatccagaagctctgggagtacgacaaccagtcgctcaagcactttaaagatacggggcagtacccctcggcccagcagttgtacggatgcacccagaaaaccatctctggctacatatacgaccagctcaaggaggagtaccaggacatcaacaaggccaacatgagcaccacgctccagaaaactatccgcacttggaacagccgcaagaaagagatttggagtggcgagatgtccatcccctcattcagaaacaatttgccaattgacattcacggcaacagtattcagatcatcaaggagaaatcaggcgactacatcgcctcagtctcgctgttctcatccaagttcattaaggagaatgacctggccaacggcaagatacttgtgaagttgtccaccaggaagcagaactccatgaaggtcatcctggaccggatcatcgactcgacctacgcaaaaggagcctgcatgttgcacaagcacaagaagaaatggtatctgtcgatcacgtacaaatccaacatcaaggaggaactgaaattcgatgaggacttaatcatgggcatcgacatgggcaagatcaacgtattgtacttcgccttcaacaaggggctggttcgaggcgcgatcagcggtgaggaaatcgaggcttttcgcaaaaagatcgagcaccgccgtatctcactgttaagacaaggaaagtattgttcggggaacaggatcgggaaggggagggagaagcgcatcaagcccattgacgtcctcaacgacaaggtggctaagttccgtaacgcgaccaaccataagtacgcgaattacatcgtccaacagtgccttaagtacaactgcggaaccatacaacttgaggatctcaaggggatttcaaaggaacagacgttcctcaagaactggacctacttcgacctccaggagaagatcaaaaaccaggcaaaccagtatggggtgaaagtcgtgaaaatcgacccctcatacacatctcagaggtgtagcgagtgcgagtacatccacaagaacaaccgtcaagaccagagcactttcgagtgccagcagtgctccttcaaggtgcacgccgactacaacgccgccaagaacatatcagtgtacaatatcgagaaggtgattcaaaagcagcttgagctacaggagaagctcaaccagactaagtacaaggagcagtatatcgagcagatgaagaatatcaactga

SEQ ID NO: 3164 - DNA, 1353 bp, Unknown
  Bacillus sp. multi
ctgtccattgccgtgaaggttatgaagtaccagatcgtgtgcccggtgaatatcgaatggaagaccttcgaaatctacttgcggacgctcagctatcacttccgcaccattggcaaccggacaatccagaagctgtgggagtacgacaaccagtccctcaagcacttcaaggacaccggccaatacccctctgcccagcagctatacggctgcacccaaaaaaccatcagcggctatatctacgaccagctcaaggaggagtaccaggacatcaacaaagcgaatatgtcaaccacattgcagaagacaatacggacgtggaactcccgcaaaaaggaaatctggagcggcgagatgtccatcccgtcctttcgaaacaatctgccaatcgacatccacgggaacagcatccagatcattaaggagaagtccggcgactacatcgcttcagtctcgttgttctcctctaagttcatcaaggagaacgatctggctaacgggaagattctcgtgaaactctccaccaggaagcagaacagcatgaaggtgatcctggaccgaatcatcgactcaacctacgctaaaggtgcctgcatgttgcacaagcacaagaagaaatggtatctatctatcacgtacaaatccaacattaaggaggagctaaagttcgacgaagacttaatcatggggatcgacatggggaagattaacgtgctttacttcgctttcaataagggtctagtgcggggcgctatctcgggcgaggagatcgaagcgttccgcaaaaagatagagcaccggcgtattagcctcctgcgtcaggggaaatattgcagcgggaacagaattggcaaagggagggagaagcgcatcaagccaatagacgtacttaacgacaaggtggcgaagttccgaaacgctacaaaccacaagtatgctaactacatcgtccagcagtgcctcaagtacaactgtggtacgattcagcttgaagaccttaagggtatcagtaaggagcagacgttccttaagaattggacctacttcgacctccaggaaaaaatcaagaatcaggctaatcagtacggggtgaaagtggtgaagattgacccctcatacactagccagcgctgctctgagtgcgagtacattcacaagaacaaccgtcaggaccagtcaaccttcgagtgccagcagtgctcctttaaggttcacgcagactacaatgcagctaagaacatatctgtttacaacatcgagaaggtcatccagaagcagcttgagttacaggagaaactcaaccagacgaagtacaaggagcagtacattgaacagatgaagaatatcaactga

SEQ ID NO: 3165 - DNA, 1359 bp, Unknown
  Bacillus sp. multi
atgtacttgagtaaggtcgtgaaggttatgaagtaccagatcgtctgccctgtcaatatcgaatggaaagccttcgaaatctatctcaggacactctcctaccactttagaacgattggcaacaggaccatccagaagttgtgggagtacgacaaccacagccttaaacactttaaggacaccggccagtatcccagcgctcagcaactttatggctgcacccaaaaaaccatcagcgggtacatctacgaccagctcaaggaggagtaccaggacatcaacaaggccaatatgagtacgacccttcagaaaacgatcaagacctggaactcccgcaagaaagagatttggagcggcgaaatgagcataccctccttccggaacaacctccccattgacatacacggcaactccatccagatcatcaaggagaagtctggcgactacatcgccaacgtttcactgttcagtagcaaattcatcaaggaaaatgacctccccaacgggaagatccttgtcaagctctcgactcgcaaacagaactctatgaaggtgatcttggaccggatcattgactccacctacgcgaaaggggcctgcatgttgcataagcacaagaacaaatggtatttgagtatcacctacaaggctactattaaggaggagcacaagttcgacgaggagttgataatggggatcgacatgggcaagataaacgttctctactttgcttacaacaagggctcagtccggggtgccatcagtggggaggagattgaagccttccgcaagaagacagagtaccgacgcatctctctactgagacaggggaaacactgctccgagaaccgtatcggcaagggacgcaaaaagcggattaagcccatcgacgtcctgaacgacaaggtggcaaagttccgaaacgcgactaaccacaagtacgcgaactacatcgtacagcagtgcttgaagtacaactgtggaaccattcaactcgaagacttacagggaatctctaaggagcaaacgttcctcaagaattggacctacttcgacctccaggagaagatcaaaaaccaggccaaccagtacggggtgaaggtggttaagatcgacccatgctacacctcacagcggtgcagcgaatgcgggtacatccacaagaacaaccgccaagaccagtcaaccttcgagtgccagcagtgcagcttcaaggtgcacgccgactacaacgccgccaagaacatctccgtgtacaacattgagaaggttatcaaaaagcagcttgaattacaggagaagctgaacctgaccaagtacaaagagcagtacattgagcaaatggagaacatcaactag

SEQ ID NO: 3166 - DNA, 1359 bp, Unknown
  Bacillus sp. multi
atgtacctcagcaaagttgttaaggtgatgaagtaccagatcgtgtgccccgtgaacatcgagtggaaggctttcgagatatacctcaggacgctctcgtaccactttcggacgattgggaacaggaccatccagaaactgtgggagtatgacaaccacagcctaaaacacttcaaggacacgggccagtacccctcggcccagcagctctacggatgtacccaaaaaaccatcagtggctatatctacgatcagctcaaggaggagtaccaggacatcaacaaggccaatatgagcaccaccctacagaagactattaagacatggaactctcgcaagaaggagatttggagcggggagatgtccatccccagcttccgtaacaacctgcccattgacattcacgggaactccatccagatcatcaaggagaaatctggagactacattgcaaatgtgagcttgttcagcagcaagttcatcaaggagaacgacctgccgaacgggaagatactcgtgaagctctcaactaggaagcagaactccatgaaggtcatcttagaccggataattgactcaacctacgctaagggtgcgtgcatgttgcacaagcacaagaacaagtggtatctatccatcacttacaaggccactatcaaggaggagcacaaattcgacgaggaacttatcatgggaattgacatggggaagataaacgtgctctacttcgcctacaacaagggaagcgtgaggggagcaatctcaggggaggagatcgaggcgtttcgcaaaaaaactgagtacaggcgaatatccctactccgacaggggaaacactgttctgaaaaccgcatcggaaaagggcgcaagaagcggatcaagcctattgacgtcctcaacgacaaggttgccaaattcagaaatgccaccaaccacaagtacgcgaactacatcgtgcagcaatgcctcaagtacaactgcgggacgatccagctcgaagacttacaggggatttcaaaggagcaaaccttccttaagaactggacctacttcgacttacaggaaaaaatcaagaaccaggccaaccagtacggagtgaaggtggtcaagatcgacccatgttacaccagccagaggtgtagcgagtgcggctacatacacaagaacaaccgacaggaccagtcaacgttcgagtgccagcagtgcagcttcaaggttcacgcggattacaacgccgctaagaatatcagcgtgtacaacatcgaaaaggttatcaagaaacagcttgagctacaggagaagctcaacctgaccaagtacaaggagcagtacatcgagcaaatggagaacattaactag

SEQ ID NO: 3167 - DNA, 1359 bp, Unknown
  Bacillus sp. multi
atgtacctgtcgaaggtcgtgaaggtgatgaagtatcagatcgtgtgtcccgtcaatatcgaatggaaggcgtttgagatatacctgaggacgctcagctaccacttccgcacaattggaaaccgaacgatccaaaagctctgggagtacgataatcactctctcaaacactttaaagatacgggccagtacccctcagcacagcagctctacggctgcacgcaaaaaactatcagcgggtacatctacgaccagctaaaggaggagtaccaggacatcaacaaggccaacatgagtaccacgttgcagaagaccattaagacatggaactctcgcaagaaagagatttggagtggcgagatgtccatcccttcctttcggaacaacctgcccatcgacatccacggaaattcaattcaaatcattaaggagaagtccggcgactacatcgctaacgtctcccttttcagcagcaagttcatcaaggagaacgacttgccgaacgggaagatcctcgtaaagctctcgacccgcaagcagaacagtatgaaggtgatcttggacagaatcattgactccacctacgctaaaggtgcgtgcatgttgcacaaacacaagaacaagtggtacttgtcaataacctacaaagcgaccatcaaggaggagcacaagttcgacgaggagctgattatggggatcgacatgggcaagatcaacgtcctctacttcgcatacaacaagggttctgttagaggcgcaatctcaggggaggagatcgaagcctttcgcaagaagactgagtacagaaggatctccctcctccgtcaggggaaacactgttcggagaatcgtatcggaaaggggcgcaaaaaacgtatcaagcccattgacgtgctgaacgacaaggtggccaagttccgtaacgccaccaaccacaagtacgccaactacatcgtccagcagtgcctcaagtacaactgtgggacaatccagcttgaggacttgcaagggatctctaaggagcagactttcctcaagaactggacttactttgacctccaggagaagatcaaaaaccaggccaaccagtatggtgtcaaggtcgtgaagattgatccctgctacacaagccagcgttgctctgagtgcgggtacatccacaagaacaatagacaggaccaaagcacattcgagtgccagcagtgctccttcaaggtgcacgctgactacaacgccgccaagaatatctcggtgtacaatatcgagaaggttattaagaaacagcttgagctacaggagaagctaaatcttaccaagtacaaggaacagtacatcgagcagatggagaatatcaattga

SEQ ID NO: 3168 - DNA, 1359 bp, Unknown
  Bacillus sp. multi
atgtacttgtcgaaggttgtgaaggtcatgaagtaccaaatcgtctgtccagtgaacatcgaatggaaagcgtttgagatatacctccggacgctcagctaccacttccgcaccattgggaatcgtaccatccagaagctctgggagtacgacaaccacagtctcaagcacttcaaggatacagggcagtacccatccgctcagcagctctacgggtgcacgcagaagactatctcagggtacatctacgatcaactcaaagaggaataccaggacatcaacaaggccaatatgagcactaccctccaaaaaactattaagacatggaactcccgcaaaaaggagatttggagcggggagatgagtatcccgtccttccgcaacaacctcccaatcgacatccacggaaactctatacagatcatcaaggagaagtcgggagactacattgccaacgtctcgctctttagttcgaaattcatcaaggagaacgacctccccaacgggaagattctcgtcaagctctcaactcgaaagcagaacagtatgaaggtcatcctcgaccgcatcatcgactcaacctacgctaagggtgcctgcatgttgcacaagcacaagaataagtggtatctctctatcacatacaaggccaccatcaaggaggagcacaagttcgacgaggagttgataatggggatcgacatgggaaagatcaatgtcctatactttgcatacaacaagggctctgttcggggcgctatttccggcgaggagattgaggcttttcgcaaaaagaccgagtacaggaggatcagcctgctgcgtcaaggcaagcactgtagcgagaacagaattggcaagggccgcaaaaagcggattaagcccattgatgtgttaaatgacaaggttgccaagttccgtaacgccacgaaccacaagtacgctaattacatcgtgcaacagtgcctcaagtacaactgcgggaccatacaacttgaggatctccagggtatctcgaaggagcagacattcctcaagaattggacctacttcgatctccaggagaagatcaaaaaccaggctaaccagtacggggtgaaggttgtcaagatagacccatgctacacctcccagcggtgttccgagtgcgggtacatccacaaaaacaatcgacaagaccagagcaccttcgagtgccagcagtgctcattcaaggtccacgccgactacaacgcagctaagaatatctcggtttacaacatcgagaaggtcattaagaaacagttggagctacaggagaagctaaaccttaccaagtacaaggagcagtacatcgagcaaatggaaaacatcaattga

SEQ ID NO: 3169 - DNA, 1359 bp, Unknown
  Bacillus sp. multi
atgtaccttagtaaggtggtgaaggttatgaagtaccagatagtgtgtccagtgaacatcgagtggaaggcgtttgagatatacctgagaaccctgagctaccacttccgcaccatcggcaaccgcaccattcagaagctatgggagtacgacaaccactccctgaaacacttcaaggacacaggccagtacccctccgctcagcagttgtacggttgcacacaaaaaacaatctccggctacatctacgaccagctcaaggaggaataccaagacatcaacaaggccaatatgtccacaacactacagaagacgattaagacatggaactcccgcaaaaaggagatttggagcggggaaatgtccatccccagcttccgtaacaacctccctattgatattcacggcaacagtatccagatcatcaaggagaagtccggggactacattgctaatgtctcgctcttcagtagcaaattcatcaaggagaacgacctccccaacggaaagatcctggtcaagctctccacgcgaaagcaaaactccatgaaggtgattctcgaccggataatcgactctacctacgcaaagggcgcgtgcatgttacacaagcacaagaacaagtggtacttgtctatcacctacaaggccactattaaggaggagcacaaattcgacgaggagctgataatgggaatcgacatggggaagataaacgtcctgtacttcgcttacaacaaggggagcgtcaggggtgccatcagcggcgaggagatcgaagccttccgcaaaaagactgaatatcggagaatctcccttctcagacaaggaaaacactgctccgaaaaccgtattggaaaggggcgcaagaaacgtatcaagcccatcgacgtcctcaacgataaggttgccaagttccgcaacgccacaaatcataagtacgcaaactacatcgtacagcagtgcctcaagtacaattgtggcaccattcagcttgaagacttgcaagggataagtaaggagcagaccttccttaagaactggacctacttcgacctccaggagaagatcaaaaaccaggccaaccagtacggcgtgaaggtggtgaagattgacccgtgttacacctctcagcgctgctcagagtgcgggtacatacacaaaaacaaccgccaggaccagagcacgttcgagtgccagcagtgctcctttaaggtccacgctgactacaacgctgctaagaacatctccgtgtacaacatcgaaaaggtcattaagaaacagttggagctacaggagaagctcaatcttaccaagtacaaggagcagtatatcgagcagatggagaacatcaactag

SEQ ID NO: 3170 - DNA, 1353 bp, Unknown
  Bacillus sp. multi
ctctccatcgctgtgaaggtgatgaagtaccagatcgtgtgccccgtaaacatcgagtggaagacgttcgaaatctatcttcgaaccctgagctatcacttccgcaccattgggaaccgaacgattcagaagctgtgggaatatgataatcagtccctgaaacacttcaaggacaccgggcaatacccctccgctcagcaattgtacggctgcacccagaaaacaatctccgggtatatctacgaccagttgaaggaggagtaccaggacatcaacaaggccaacatgagtaccacgcttcagaaaactatccgcacttggaactcccgcaaaaaagagatttggagtggcgagatgtcaatcccctccttccggaacaacttgcctatagacatccacggaaactccatccagatcattaaggagaagtcgggtgactacatcgcctcagtgtcccttttcagctccaagttcattaaggagaatgacctccctaatgggaagatcctcgtgaaactttccacaaggaagcagaactccatgaaggttatcttggaccggatcatcgacagcacttacgcgaaaggggcgtgcatgttgcacaagcacaagaagaagtggtatctcagcattacttacaaaagcaacatcaaggaggaactcaaattcgacgaagacctcatcatggggatagacatgggcaagataaacgtcttgtactttgccttcaacaagggcctcgttcgtggtgcaatcagcggcgaggaaatcgaggcgttccgcaaaaaaatcgagcaccggcgtatcagccttctcagacaggggaagtattgctctgggaaccgaatcggcaaggggcgagaaaagcgcattaagcctattgatgtgctcaacgacaacgtggctaagttcagaaacgctaccaatcacaagtacgctaactacatcgtccagcagtgcctcaagtacaactgcgggactattcagcttgaagaccttaaggggatcagtaaggagcagactttccttaagaactggacatacttcgatctccaggagaagatcaaaaaccaggctaaccagtacggtgtgaaggtggtgaagattgacccgagctacacctcccagcgttgcagcgagtgcggctatatccacaagaataaccggcaagaccagagcacgttcgagtgccagcactgctcattcaaggtccacgcggactacaacgccgctaagaacatcagtctgtacaacatcgagaaggttattcagaagcagttggagttacaggaaaagctgaaccagacaaagtacaaagagcagtacatcgaacagatgaagaatatcaactga

SEQ ID NO: 3171 - DNA, 1353 bp, Unknown
  Bacillus sp. multi
ctctctatcgctgtgaaggtgatgaagtaccagatcgtatgccccgtgaacatcgagtggaagactttcgagatatacctgcgaaccctctcctaccacttccgtaccatcggcaaccgcactattcagaagctctgggagtacgataaccagtctttgaagcactttaaggataccgggcaatacccttctgcccagcagctctacggctgcacccagaaaaccatcagcggctacatatacgaccagctcaaggaggagtaccaggacatcaacaaagccaatatgagcacaacgctccaaaaaaccatccgtacctggaacagccgcaagaaagagatttggagtggcgagatgtctattccttccttccgcaacaacttgccaattgatattcacggcaactccatccagatcatcaaggagaagtccggtgactatatcgcaagcgtcagccttttcagcagcaagttcattaaggagaacgacctcccgaacggcaaaatcctcgttaagctgagcacacggaagcagaactccatgaaggtgatccttgaccggataatcgactcaacctacgctaaaggtgcctgcatgttgcataagcacaaaaagaagtggtacttgtctattacctacaagtccaacatcaaggaggagttgaaattcgacgaggacttaatcatggggattgacatgggcaagatcaacgtcctgtactttgcgttcaacaaaggacttgtcaggggcgctatctctggggaggagattgaggcgttccgcaaaaagattgagcacaggcgaatctccctgctccggcaagggaaatactgctctggcaaccgtatcggaaaggggcgggagaagcgcattaagcccatcgacgtgctcaacgacaacgtggcaaagttccgaaatgcaacaaaccacaaatacgcgaactacatcgtacagcagtgcctcaagtacaactgtggtacgatccagctcgaagacttgaagggcatcagcaaggagcagaccttccttaagaattggacctatttcgatctccaggagaagatcaaaaaccaggccaaccagtacggagtgaaggtggtcaaaatcgaccccagctacacctcacagcgttgctctgagtgcggttacatccacaagaacaacagacaagatcagagcacgttcgagtgccagcactgctcattcaaggtgcacgcggactacaacgccgccaagaacatctcgctttacaacatcgaaaaggtcatccagaagcagcttgagttacaggagaagctaaaccagacgaagtacaaggagcagtatatcgaacagatgaagaacatcaactga

SEQ ID NO: 3172 - DNA, 1353 bp, Unknown
  Bacillus sp. multi
ctgtctatagcagtgaaggtgatgaagtaccagatcgtgtgcccagtgaacatcgagtggaagaccttcgaaatctacctccgtaccctctcctaccacttccgcaccatcggaaacaggaccatccagaaactttgggagtatgacaaccagtcactcaagcacttcaaggacacagggcagtatccctcagcacagcagctctacggctgcacccagaagaccatcagcggctacatctacgaccagctcaaggaggagtatcaggacattaacaaggcaaacatgagcacgacgctacagaaaaccatccgcacctggaacagtcgcaaaaaagagatatggagcggggagatgagcatcccgagcttccggaacaaccttccaattgacatacacgggaactcaatccagatcatcaaggagaagtccggggactacatcgcctccgtcagtctattcagctccaagttcatcaaggagaacgacttgccaaacggcaagatactggtgaaactatcaacacggaagcaaaacagtatgaaggtgatcttggaccgcatcatcgactctacctacgctaaaggggcctgcatgttacacaagcacaaaaagaaatggtacttgagtatcacttacaagtccaacattaaggaggaattgaagttcgacgaagacctgataatggggatcgacatgggcaagatcaacgtcctgtactttgccttcaacaaggggctggtgcgaggtgccataagcggcgaggagattgaggcgttccgcaagaagatagagcacaggagaatatccctattaagacaaggaaagtattgctccggcaatcggatcgggaagggtagggagaagcgcatcaagccgattgacgtgctgaatgacaacgtggcgaagttccgcaacgcaactaaccacaagtacgctaactacatcgtccagcagtgcctcaagtacaattgcggcacgatccagttggaggacttaaagggaatctctaaggagcaaacgttccttaagaactggacttacttcgatctacaggagaagatcaaaaaccaggctaaccagtacggggtcaaggttgtgaagattgaccccagctacacgagccagcgatgcagtgaatgcgggtacatccacaagaataaccgccaggaccaatcgaccttcgagtgccagcattgttcgtttaaggttcacgccgactacaacgccgccaagaatatcagcttgtacaacatcgagaaggtcatccagaagcaactggagctacaggagaagctcaatcagaccaagtacaaggaacagtacatcgagcagatgaaaaatatcaactga

SEQ ID NO: 3173 - DNA, 1353 bp, Unknown
  Bacillus sp. multi
ctcagcattgctgtgaaggtcatgaagtaccaaatagtatgtcctgtcaacatcgagtggaagaccttcgagatatacctccggaccctgagttatcactttcgtaccattggcaaccgaactattcagaagctctgggagtacgacaaccagtcgctcaagcacttcaaggatacgggacagtaccccagcgcacagcaactttacgggtgcacgcaaaaaactatctccggttacatctacgaccaactcaaggaggaataccaagacattaacaaagcgaatatgtcaactaccctccagaagacaatccgcacctggaacagccgcaaaaaggagatttggagcggtgagatgagcatcccctcgttcagaaacaacctccccatcgacatccacggcaactcaatccagatcatcaaggagaaatccggggattacatcgcaagcgtgtccttgttcagtagcaagttcatcaaggagaacgacctgccaaatggcaagatcctggtgaagctctcgacccgcaagcagaactctatgaaggtgatcctcgaccgcatcatcgactccacgtacgctaaaggtgcgtgcatgttgcacaagcacaaaaagaagtggtatctgtccataacctacaagtccaatatcaaggaggagttgaaattcgacgaagaccttatcatgggaatcgacatgggaaagatcaacgtgctgtactttgcctttaacaagggattggtcaggggtgcgatctctggcgaggagatcgaggctttccgcaagaaaatcgagcaccgccgcatatcacttctgcgtcaaggcaagtattgctccgggaaccgtatcgggaaggggcgcgagaagcggatcaagcccatcgacgtcttgaacgacaatgtggctaagttccgtaacgcgactaaccacaagtacgccaactacattgtccaacagtgtctcaagtacaattgcgggaccattcaattggaagacttaaagggtatctcgaaagagcaaaccttccttaagaactggacgtacttcgacctacaggagaagatcaaaaaccaggccaatcagtacggggtgaaggtggtcaagatcgacccatcttacacatcccagcgttgcagtgaatgcggctacatccacaagaacaaccgccaggaccagtccaccttcgagtgccagcactgctcgttcaaggtccacgctgactacaacgccgccaagaacattagcctatacaacatcgaaaaggtcatccagaagcagctagaactacaggagaaattgaaccagactaagtacaaagagcagtatatcgagcagatgaagaatatcaactga

SEQ ID NO: 3174 - DNA, 1353 bp, Unknown
  Bacillus sp. multi
ctatccattgctgtgaaggtgatgaagtaccagatcgtgtgccccgtgaacatcgaatggaagactttcgagatataccttcgaactctttcctaccacttccggaccatcgggaaccgcaccatccagaaactctgggagtacgacaaccagtctctaaaacacttcaaagacaccggccagtacccgtcggcacaacagctctacggctgcacgcagaagactatctcgggctacatctacgaccagctcaaggaggagtatcaagacatcaacaaggccaatatgagcacgacattacagaaaacaatccgcacttggaactctcgcaaaaaggaaatctggagcggggagatgagcatcccgtcgttccgaaacaaccttcctatcgacatccacggcaactccatccagatcatcaaggagaagtccggcgactacattgcatccgtcagccttttcagttcgaaattcattaaggaaaatgacttgcccaacgggaaaatcctcgtcaagctctccacccgcaagcagaactctatgaaggtgatcttggacaggatcattgactccacttacgcaaaaggagcgtgcatgttgcacaagcacaagaaaaaatggtatctatccatcacctacaagagcaacatcaaggaggagcttaagttcgacgaagacctgataatggggatcgacatggggaagatcaacgtcctttacttcgctttcaacaaggggttggtgcgcggtgcaatcagtggtgaggaaattgaggcgtttcgcaagaaaatcgagcaccgacggatctccctcctgagacagggcaagtactgctctgggaaccgtatcggcaaggggcgcgagaagcggattaagccaatcgacgttctaaacgacaacgtggcgaaattccgtaatgctactaaccacaagtacgcgaactacatcgtgcaacagtgcttgaagtacaactgcgggaccatacagcttgaggacttgaagggcataagcaaggagcagaccttccttaagaattggacctacttcgacttacaggagaagatcaaaaaccaggccaaccagtacggcgtgaaggttgtcaagatcgacccctcctacacatcccagcgttgctccgaatgcggctacatccataagaacaaccgtcaggaccagagtaccttcgagtgccagcattgttccttcaaggtccacgccgactacaacgccgccaagaacatcagtctgtacaacattgagaaggtgatccagaagcaacttgaactacaggagaagctcaaccagaccaagtacaaagagcagtacatcgagcagatgaaaaacatcaactga

SEQ ID NO: 3175 - DNA, 1359 bp, Unknown
  Bacillus sp. multi
atgtacctcagcaaggttgtcaaggtcatgaagtatcagatagtgtgccccgtcaacatcgagtggaaagccttcgagatatacctcaggacactgagctaccacttccgcacaatcggcaacaagaccatccagaaattgtgggagtatgacaaccactccttaaaacacttcaaggacaccgggcagtaccccagcgcccagcagctttacggctgcacacagaagaccatctccggctatatctacgaccaacttaaggaggagtaccaggacatcaacaaagccaatatgagcacaaccctccaaaaaaccattaagacatggaacagccgcaagaaggagatatggagtggcgagatgagtatcccctccttccgcaacaacttacctattgacatccacggaaactctatccagatcatcaaggagaagtccggcgactacatcgccaatgtgtcactgttctcctcaaagttcatcaaggagaacgacctgcccaacgggaagatccttgtgaaactgagcacgcgcaagcagaactccatgaaggtgatactcgaccgtatcatcgactctacctacgcaaaaggcgcgtgcatgttgcacaagcacaagaacaagtggtatctatctatcacttacaaggcgacgatcaaggaggagcataagttcgacgaggagctgataatggggattgatatgggcaagattaacgtcctttacttcgcctacaacaagggcctcgttcgcggagcgatcagcggcgaggaaatcgaagccttccgcaagaagacagaataccggcgtatatctctgttgcgccaggggaaatattgttctgagaacaggatcgggaaggggcgcaaaaagcgcatcaagcctattgacgtgcttaatgacaaagttgccaagttccgaaatgcgaccaaccataagtacgccaactacatcgtacagcagtgcctcaagtacaactgcgggacgattcaacttgaagacctacaggggattagcaaggagcagacattcctcaagaattggacccacttcgatctacaggaaaaaatcaagaaccaggccaaccagtacggagtaaaggtggtgaagatcgaccctagttacacgagccagaggtgcagcgagtgtggctacatccacaaaaacaaccgtcaggaccagagcactttcgagtgccagcagtgctccttcaaggtgcacgcagactacaatgcggctaagaacatcagcgtttacaacattgagaaggtgatccagaagcagctagaactacaggagaagctaaaccttacaaagtacaaggagcagtatatcgagcagatggagaacattaactga

SEQ ID NO: 3176 - DNA, 1359 bp, Unknown
  Bacillus sp. multi
atgtacctctcaaaggtggtgaaagtgatgaagtaccagatcgtgtgccccgtgaacatcgagtggaaggcgtttgagatataccttcgcaccctcagctaccacttccgcaccatcggcaacaaaacgatacagaagctctgggagtacgacaatcactcgctcaagcacttcaaagacaccggccagtacccatctgcccagcaactctacggttgcactcagaagactatctctggctacatctacgaccaactcaaggaggagtaccaggacatcaacaaggcaaacatgagcacgaccctccagaaaaccatcaagacctggaactcccgcaaaaaggaaatctggagtggtgaaatgtccataccatccttccgcaacaaccttcctattgacattcacggcaattccatccaaatcatcaaggagaaaagcggcgactacatcgccaacgtcagcctgttcagctccaagttcatcaaggagaacgacctgcccaacgggaagattcttgtgaaactgtccactcgcaaacagaactcgatgaaggtgatattggaccgcatcatcgactctacatacgcaaagggagcctgcatgttgcacaagcacaagaacaagtggtatctctcaattacttacaaggcaacgattaaggaggagcacaaattcgacgaggaattgataatgggcattgacatgggcaagattaacgttctatactttgcctacaacaagggattggtgcgaggggccatctctggtgaggaaatcgaggcgttccgcaagaagactgagtaccggagaatcagtctcctgcgccagggcaagtattgttcggagaaccggattggcaagggacgcaaaaagcgtatcaagcctatcgacgtccttaacgacaaagtggccaagttccgaaacgccaccaaccacaagtacgcaaactacatcgtccagcagtgcttgaagtacaactgcggcacaattcaattggaagacttacagggaatatctaaggagcaaacctttctcaagaattggacccacttcgatctacaggagaagatcaaaaaccaggcgaaccagtacggggtcaaggtggtgaagatcgaccccagctacaccagccagcggtgttcagagtgcgggtacattcacaagaacaaccgtcaagatcagtcaactttcgagtgccagcagtgctccttcaaagtgcacgctgactacaatgcggccaagaacatcagcgtttacaatatcgagaaggtgatccagaagcagcttgaactacaggagaagctaaaccttactaagtacaaggagcagtatatcgagcagatggagaacatcaactga

SEQ ID NO: 3177 - DNA, 1359 bp, Unknown
  Bacillus sp. multi
atgtacttgagcaaggtggtgaaggtgatgaagtaccagatcgtttgccccgtgaacatcgagtggaaggcgtttgaaatctatctcagaaccctgagctaccacttccgtaccatcggcaacaagaccatacagaaactttgggagtacgacaaccacagcctcaaacacttcaaggataccggccagtaccccagcgcacagcaactctacggatgtactcagaagactatcagcgggtacatctacgaccagctcaaagaggagtaccaggacatcaataaggcgaatatgtcaacaacgcttcaaaaaactatcaagacgtggaacagtcgcaagaaagagatatggagcggcgaaatgtcgatacccagtttccgtaacaacctgccgattgacatccacggaaattccatccagatcatcaaggagaaaagtggggactacatcgcaaacgtcagcctcttcagcagcaagttcatcaaggagaacgacctccctaacggcaagatccttgtcaagttgagtacccgcaagcagaacagcatgaaggtcatactcgaccgcatcatcgactccacatacgccaaaggagcctgcatgttacacaagcacaagaacaagtggtatctctcgattacttacaaggccacgatcaaggaggagcacaagttcgacgaggaacttatcatgggcatcgacatgggcaagataaacgtactctacttcgcatacaataagggtcttgtgcgtggggctatatccggggaggagattgaggcgtttcgcaagaagaccgagtaccggcgtatctcgctactgagacagggcaagtattgcagcgagaaccgaatcgggaagggtcgcaagaaacggattaagcctatcgacgttctcaacgacaaggtggcaaagttccgcaacgctacaaaccacaagtacgcaaactacattgtccagcagtgccttaagtacaattgcgggaccatccagcttgaagacttacaaggaatatcgaaggagcagactttcctcaagaactggacccacttcgacttacaggaaaaaatcaagaatcaggccaaccagtacggcgtgaaagtcgtgaagattgaccccagctacacctcacaaaggtgcagtgaatgcggctacatccacaagaacaaccgccaagaccagagcactttcgagtgccagcagtgcagtttcaaggttcacgctgactacaacgctgccaagaacatcagcgtttacaacatcgagaaggtgatccagaagcaactggagctacaggagaaactgaaccttaccaagtacaaggagcagtacattgagcaaatggagaacattaactaa

SEQ ID NO: 3178 - DNA, 1359 bp, Unknown
  Bacillus sp. multi
atgtacctttccaaagttgttaaagtcatgaagtaccaaatagtctgcccggtgaacatcgagtggaaggcgttcgagatatacctccgtaccctatcctaccacttccgaacaatcggcaacaagaccatccagaagttgtgggagtacgataaccactctttgaagcacttcaaggacaccggccaatatccctccgctcagcagctctacggatgcacccagaagaccatctcgggctacatctatgaccagcttaaggaggagtaccaagacattaacaaggccaatatgtccaccacacttcagaagaccatcaagacttggaactcccgcaagaaagagatatggagtggcgagatgagcataccctccttcagaaacaacctccctattgacattcacggcaactccatccagatcatcaaggagaagtccggggactacatcgccaacgtgagcttgttctccagcaaattcatcaaggagaacgacctgcctaacgggaagatcctggtgaaactatcaaccaggaagcagaacagcatgaaggttatcctggacaggataattgactccacctacgctaaaggtgcgtgcatgttgcacaagcacaagaacaaatggtacttgtctatcacctacaaagccactattaaggaggaacacaagttcgacgaggagctaatcatggggatagacatgggcaagatcaatgtactgtacttcgcctacaacaaggggctggtgcgtggggccataagcggggaggagattgaggctttccgcaagaaaactgagtacaggcgcatcagcctcttgagacagggaaagtattgcagtgagaaccgcattgggaaagggcgcaaaaagcggatcaagccgattgacgtgcttaacgacaaggtggccaagttccgcaacgcaacgaaccacaaatacgccaactacattgtgcagcagtgcctcaagtacaactgcggcaccatacaattggaagatttgcaaggaatcagcaaggagcagaccttcctcaagaactggacacactttgacctccaggaaaaaatcaagaaccaggccaaccagtacggcgtgaaagtggtcaagatcgacccctcctacactagccagcggtgctccgagtgcgggtacatccacaagaacaaccgacaagatcaatccactttcgaatgccagcagtgcagcttcaaggtccacgcggactacaatgccgccaagaacatcagtgtttacaacatcgagaaggtcatccaaaagcaattggagctacaggagaaactcaacctgaccaagtacaaggagcagtatatcgagcagatggagaatatcaattga

SEQ ID NO: 3179 - DNA, 1359 bp, Unknown
  Bacillus sp. multi
atgtacttgtctaaagtggtgaaggtgatgaagtaccagatcgtgtgccctgtgaacatcgagtggaaagccttcgagatataccttcggactctgagctaccacttccgaaccatcggcaataagaccatccaaaagctgtgggagtatgataaccactcgctcaagcacttcaaggacaccggccagtacccctcggcccagcagctttacgggtgcacacagaaaacaatatctggctatatctacgaccagctcaaggaggagtaccaggacattaacaaggccaatatgtcaacaacccttcagaaaacgattaagacatggaactcccgcaagaaggagatttggagtggagagatgtccattccttcctttcggaacaaccttccaatcgacattcacggaaactcgatccagatcatcaaggagaagtcaggggactacatcgcaaacgtcagtctgttctcaagtaagttcattaaggagaacgacctccccaacgggaagattctcgtgaagttgagtacgcgcaagcagaacagcatgaaggtgatcctggacaggatcattgactctacctacgctaaaggtgcttgcatgttgcacaagcacaagaacaagtggtacttgtcaatcacgtacaaagccactattaaggaggaacacaagttcgacgaggagttaatcatgggcattgacatgggcaagataaacgtcctctactttgcttacaacaagggtcttgttcgaggagccatctccggcgaggagatcgaagcgttccgcaaaaaaactgagtatcgacgtatctcgctgctaagacaggggaaatattgttccgagaacagaattgggaaagggcgcaagaagcggatcaagccaattgatgtgcttaacgataaggtggccaagttccgcaacgctacgaaccacaagtacgcgaactacatcgtgcagcagtgcttgaagtacaactgcgggaccattcagcttgaagaccttcaaggaatttcgaaggagcagacattcctcaagaactggactcacttcgacctccaggagaagatcaaaaaccaggcgaaccagtacggggtgaaggttgtcaagatcgacccttcctatacctcacagcggtgttcggagtgcgggtacatccacaagaataaccgtcaggaccagagcaccttcgagtgccagcagtgcagtttcaaagtgcacgccgactacaacgccgccaagaacatctccgtgtacaacatcgagaaggtcatccaaaagcaacttgaattacaggagaagctcaacctgaccaagtacaaggagcagtacattgaacagatggaaaacatcaactag

SEQ ID NO: 3180 - DNA, 1353 bp, Unknown
  Bacillus sp. multi
ctgagtacggtcgtgaaggtgatgaagtaccagatcgtgtgtccgctcaacctcgactggaaaatgttcgaaaagtaccttcgtactctcagctaccaagtccgcaccattgggaacaggaccatccagaagctctgggacttcgacaaccagagccttaaccacttccgcgaaaacggagtttatccgagcgccaagcaactctacggctgcacccagaaaaccatcagcggctacatctacgaccagcttaaggaggagtaccaagacattaacaaggcgaacatgagcaccaccctccaaaaaactatcaagacttggaactcccgcaaaaaggagattcgaagcggcgatatgtctattccatcctttcgcaacaacctgcctattgatattcacggaaactcaatccagatcactaaggagaagtcgggagactacatcgccagcctttcactgttctcatccaacttcattaaggagaacaacctgcccaacggcaagatccaagtgaagctgtccaccaggaagcaaaactcgatgaaggtgatactggacagaatcatcgagaacacctacgccaaaggtgcctgcatcttgcacaagcacaagaacaagtggtatctctccataatctacaagcctatcgtaaaggaggagcacaagttcgaggaagacctcgttatggggattgacatgggcaagatcaatgtactctacttcgcattcaacaagggctggataaggggcgcaatctcaggcgaggagattgaggcgttccgcaagaagatcgagcaccgacgtatctccctactgcgacagggcaagtattgcagcgggaaccgggtcgggaaggggcgcgagaagcgcattaagcctatcaacgtgctaaacaataaggtggccaaattccgcaacgctaccaaccacaaatacgctaactacatcgtgcaacagtgcctcaagtacaactgcgggacgatacaactggagaacttacaaggaatctctaaggaacaaacattccttaagaattggacctactttgacctacaggagaagataaaacaacaagctcaccagtacggtattaaggttgtgaccattgacccgagctacacaagccaacgttgctcagagtgcgggtacatccacaagaacaacaggcagagtcagtccacgttcgagtgccaacgatgcaacctaaaggtgcacgctgactacaacgcagccaagaacatctcaatctacaatatcgagaaggtcatccagaagcagctcaagctccaggagaagttaaacagcaaaaaattcaccgagcagtacatcgaacaaattgagaacattaactga

SEQ ID NO: 3181 - DNA, 1353 bp, Unknown
  Bacillus sp. multi
ctgtccaccgtggtgaaggtcatgaagtaccagatcgtttgcccgctcaacctcgactggaagatgttcgagaagtacctgcgtaccctgagctaccaagttcggacaatcggaaatcgcaccatccagaagttgtgggacttcgacaaccagtccctcaaccacttccgggagaacggcgtttacccctccgctaagcagctctatgggtgcacgcagaaaaccatcagtggctacatctacgatcagctcaaggaggagtaccaggacatcaacaaggccaatatgtcaacaacattgcaaaaaacgattaagacatggaactcacgcaagaaggagattcgatccggagatatgagtatcccttcgttcagaaacaacctgccaatcgacatccacggcaactcaatccagatcactaaggagaaatctggggactacatcgcctcgttgtcgctctttagcagtaacttcatcaaggagaacaacctgccaaacggaaagatacaagtcaagttgagcacccggaagcagaacagcatgaaggtgatcctcgaccgaatcattgaaaacacttacgcgaaaggcgcgtgcatcctgcacaagcacaagaacaagtggtacttgtccatcatctacaagcccattgtgaaggaggagcacaagttcgaggaagacctagtgatgggcattgacatgggaaagataaacgtcctgtacttcgccttcaacaagggttggatacggggcgcaatcagcggggaggagattgaggctttccgcaagaagatcgagcaccgccgcatatcgctcctgaggcaaggcaagtactgttctggaaatcgagtcgggaagggccgcgagaagcgcatcaagccgatcaacgtactgaacaacaaagttgcaaagttccgcaacgccactaaccacaagtacgctaactacatcgtccagcagtgcctcaagtacaactgcggaaccatccagctcgaaaacctccaggggatcagtaaagagcagactttcctcaagaattggacttactttgacctccaggagaagataaaacaacaggctcaccaatacgggatcaaggtcgttacaattgacccctcttacaccagtcaacgctgctcggaatgcggctacattcataagaacaacaggcagtcgcagtccacattcgagtgccagcgatgcaatctcaaagttcatgccgactacaacgcagctaagaacatatctatctacaatatcgagaaggtcattcagaagcaactcaaactccaggagaaactcaactccaaaaagttcactgaacagtacatcgagcaaattgagaacatcaactga

SEQ ID NO: 3182 - DNA, 1353 bp, Unknown
  Bacillus sp. multi
ctcagcacggtggtgaaggtgatgaagtaccaaatagtatgtccgctcaacctcgactggaaaatgttcgagaagtaccttagaacactctcctaccaagtccgcactatcgggaaccggaccatccagaagctatgggacttcgacaaccagtcgttgaaccacttccgagaaaatggggtgtaccccagcgccaagcagctttacggctgcactcaaaaaactatctctggttacatctacgaccaactcaaagaggaataccaggacatcaacaaggccaatatgagcaccacactccagaaaactatcaagacctggaacagccgcaagaaggagattcgcagtggggacatgagtatcccgtccttccgcaacaacttacccattgacatccacggcaactccatacagatcacgaaggagaagtctggggactacatcgcctccctcagtctgttctccagcaacttcatcaaggaaaacaatctgcctaacgggaagatccaagtgaagctcagcacccgtaaacagaactcgatgaaggtcatactggaccgcataattgaaaacacctacgctaaaggtgcctgcattctacacaagcacaagaacaaatggtatttgagcatcatatacaagcccatcgtcaaggaggaacataagttcgaggaggacttggtgatgggcatcgacatggggaagatcaacgttctgtacttcgccttcaacaaggggtggattcgaggggctatatcgggtgaggagattgaggcgttccgcaagaaaatcgagcaccgccgaatatccttgctaagacagggcaagtactgttcgggaaatcgcgtcgggaagggccgcgagaagcgcatcaagccgataaacgtactaaacaacaaggtcgccaagttccgcaacgccacaaaccacaagtatgctaactacatcgtccagcagtgtctcaagtacaactgcgggactattcagttggagaatctgcaaggaatctcgaaggagcagacattcctcaagaactggacctacttcgacctccaggagaagataaaacaacaagctcaccagtacgggattaaggtcgtgaccattgacccatcttacacctctcaacgatgctctgaatgcggctacatccacaagaacaaccgccagagccaaagcacattcgagtgccagcgctgcaatctgaaagttcacgctgactacaacgctgccaagaatatctctatctacaacatcgagaaggtcattcagaagcaactgaaactccaggagaaattgaacagcaaaaagttcaccgagcagtacatcgaacaaattgagaacatcaactga

SEQ ID NO: 3183 - DNA, 1353 bp, Unknown
  Bacillus sp. multi
ttgtccacggtggtgaaggtgatgaagtatcagatcgtgtgtcctcttaaccttgactggaagatgttcgagaagtacctgcggaccctttcctaccaagtcaggaccatcggcaaccggactatccagaagctctgggatttcgacaaccagtctctcaaccacttccgcgaaaatggggtttacccgagcgccaagcaactctacggatgtactcaaaaaaccatcagtggctacatctacgaccagctcaaggaggagtaccaggacatcaacaaggccaacatgagcaccaccctccagaagactatcaagacctggaactcccgcaagaaggagatccggagcggagatatgtctatcccttccttccgaaacaacctccccatcgacatacacgggaactcgatccagattactaaggagaagtctggggactacatcgcttccctgtcgctgttcagtagcaactttatcaaggagaacaatctccccaacgggaagatccaagtgaagctgagtaccaggaagcagaactctatgaaggtgatccttgacaggatcattgagaacacctacgcaaagggcgcttgcattctccacaagcacaagaacaagtggtacttgtccatcatctacaagcccatcgtgaaagaggaacacaagttcgaggaagaccttgttatgggaatagacatggggaagataaacgtgctgtacttcgccttcaacaagggttggatcagaggagctatatcaggggaggaaattgaagcgtttcgcaagaaaatcgagcacagacgcatatccctactgagacaggggaagtattgttctggcaacagggtgggaaaaggtcgtgagaagcggatcaagcccatcaacgtgctcaacaacaaggtggccaagttcagaaacgcgaccaaccacaagtacgcaaactacatcgtgcagcagtgcctcaagtacaactgcggcacaattcaattggagaacctccagggtatcagtaaggaacagaccttcctcaagaactggacgtacttcgatctccaggagaagatcaaacagcaagcccaccagtacgggatcaaggtggtcacaattgacccgagctacaccagtcaaaggtgctccgagtgcggctatatccacaagaacaaccgccaatctcagtccaccttcgagtgccagcgctgcaacttgaaggtgcacgccgactacaacgcggctaagaatatctccatctacaacatcgagaaggttatccagaagcagctcaagttacaggagaagctgaactccaaaaagttcactgagcagtacatcgagcagattgagaacatcaactaa

SEQ ID NO: 3184 - DNA, 1353 bp, Unknown
  Bacillus sp. multi
cttagcacggtggtgaaggtgatgaagtaccagatcgtgtgcccattgaacctggactggaagatgttcgagaagtaccttagaactttaagttatcaagtccgaacaattggcaatcgcaccatacagaagctgtgggacttcgacaaccagtcattgaaccacttccgcgagaacggcgtgtacccctctgcgaagcagctctacggatgtactcagaaaacaatctctggttacatctacgaccaattgaaggaggagtaccaggacattaacaaggcgaatatgagtacaaccctccaaaaaaccattaagacctggaactcccgcaagaaagagattcgctccggagacatgagcatcccctcgtttcggaacaacctccctatcgacatccacggaaacagcatccagatcacgaaggagaagtcaggagactacattgcctcactgagcctgttcagtagcaacttcatcaaggagaacaatcttccgaacggcaagatccaagtcaagttaagcactcgtaagcagaactccatgaaggtgatcctagaccggattatcgaaaacacctatgctaaaggggcctgcatcctgcacaagcacaagaacaagtggtatttgagcatcatatacaagccgatagtcaaggaggaacataagttcgaggaggatcttgtcatgggaatcgacatggggaagatcaacgtgctctactttgctttcaataagggttggattcggggagctatctctggtgaggaaattgaggctttccgcaagaaaatcgagcaccgacgcatctccctcctacgtcagggaaagtattgctccggaaatcgcgtgggaaagggccgtgagaaacgtatcaagccgatcaacgtgcttaacaataaggttgcgaagttccgtaacgcaacaaaccataagtacgcgaactacattgtccagcagtgcctcaagtacaactgcgggacaatccagcttgagaacttacagggaatcagtaaggagcagactttcctcaagaattggacctacttcgacctccaggagaagatcaaacagcaagctcaccagtacggcatcaaggtggtcaccattgacccctcctacaccagccagcgctgctcggagtgcggctacatccacaagaacaaccggcagtcacagagcactttcgagtgccagcggtgcaacctcaaggtgcacgcggactacaacgccgccaagaacatcagcatatacaatatcgaaaaggtcatacagaagcaactcaaactacaggagaaattgaactccaagaagtttaccgagcagtacattgagcagatcgagaacatcaactaa

SEQ ID NO: 3185 - DNA, 990 bp, Unknown
  Bacillus sp. multi
atgtctgtgcttattaagacctatctacacggctaccactctatcctttacaacaagcggaagacctcctacgaggtcggacgcggaaagcctatgtccaatcagcaacttgtcaacctccggattgacttcgccttcaagcagctattcggaacatcgggcaacgaggacatccttatcgcctttctcaacgccatattgcaagacagtcttgagagtcctatagtctcgttgcagttggaagatccccacctccatagggagcatgaggaggacaagctcagcattctcgacatctccgccaccctggacacaggcacaaaggtcaatgttgaaatccagttgaacaataaccacgacatgattaagcgcagcctgtactactggggccgactctatacttcccaacttcaaaagggtatgccgtactcgtcacttcacaagaccattaccatcaatctgctaaacttcgttatgttcccagaatacgaggcttttcacacaacagggattctctggaatcagcagcagcagaagaagctgtcggatgacattgaggtccacatggttgaaatcccaaaactcatgcagcagtggaggaacgagcaagtcaatccctgggaagattcgttcgtccggtggctactactattgccagcgaacgaggatgagcagttgacacaaactttggaggatattgccatgaatcaggatcctatacttcaaaaggctatcaacaagtgggagcgaatgtctcaggacagcagcttccgacaagcgtatgaggccagggagaaggcacttatggacgaggctgccaagttcgcttacgccgagcaaaagggtatcgaaaaggggatcgagaaggggattgagcaaggaaagatccagctcatcaggggaatgcacaagaacggtatgcctatcaaggacatcgctaagttcacaaacctcagcattgaggagatccaggaaattctggaactttga

SEQ ID NO: 3186 - DNA, 990 bp, Unknown
  Bacillus sp. multi
atgtcagtgctcattaagacgtatctgcacggttaccactcaatcttgtacaacaagcgtaagacttcatacgaagtggggcgcggaaagcccatgagcaaccagcaactcgtgaacttgagaatcgacttcgctttcaaacagctcttcggcacctctggaaacgaggacatccttatcgctttcctaaacgccatcctccaagactcgttagagagtcccatcgtgtccctccagcttgaagatccacaccttcaccgcgagcacgaggaggataagttgtctatccttgacatctcggccaccctcgacacaggaacaaaggttaatgtcgagattcagcttaacaacaatcacgacatgattaagcggagcctgtactactggggcagactctacacgagccagcttcagaagggtatgccttactccagtcttcataagacaattacgatcaatctcctcaatttcgtcatgttccccgagtacgaagcctttcacaccaccggtattctgtggaatcagcagcagcagaagaaactcagcgacgacattgaagttcacatggttgagatccccaagctcatgcaacagtggcgtaacgagcaagtgaatccctgggaggactctttcgttcggtggctcctcctgctgcctgccaatgaggacgagcaactcacccagacgctcgaagacatcgccatgaatcaggatccgattctgcaaaaggccattaacaagtgggagcgtatgtctcaagactcttcattccgccaagcgtacgaggcacgagaaaaggccctgatggacgaggcggcgaaattcgcttacgcggagcaaaagggaattgagaagggaattgaaaagggtattgaacaagggaagatccagttgatacggggaatgcacaagaatggtatgccgatcaaggacattgccaagttcacgaacctatctatcgaggaaatccaggagattctcgaattgtga

SEQ ID NO: 3187 - DNA, 990 bp, Unknown
  Bacillus sp. multi
atgtcggtgctcattaagacttacttgcacggctaccatagcatcctctacaacaagaggaagacttcctacgaggttggtcgtggcaaacctatgtcgaaccagcaactcgtcaacctccgaatcgactttgcctttaagcagctctttggcacctccggcaacgaagacattctcattgcattcttgaatgcgatcctccaggacagtcttgagtctcccatcgtttcgctccagcttgaagaccctcatctccatcgtgagcacgaggaagacaagttgtctatcttggacattagcgcgactctcgacaccggtacaaaggtgaatgtggagatccagctcaataacaaccacgacatgattaagcgttcactctactactggggacgcctctacacctcccaactacagaagggtatgccatacagctccttgcacaagaccattactatcaatctactcaatttcgttatgttccccgagtacgaagcgtttcacacgactggaatcctgtggaaccagcaacagcagaagaaactatctgacgacatcgaggttcacatggtcgaaatcccaaagctcatgcagcagtggaggaacgagcaagtcaatccgtgggaagactctttcgttcgctggctgctcctcttaccagccaacgaggacgagcaacttacccaaactcttgaggacattgctatgaaccaagaccccattctccaaaaggcgatcaacaaatgggagcgcatgagtcaggatagctctttccgccaggcttatgaggcccgtgaaaaggccctcatggacgaggccgcgaagttcgcgtatgcggagcaaaagggtatcgagaagggcattgagaaggggatcgaacaagggaagatccagttgatccgagggatgcacaagaacgggatgcccattaaggacattgcaaagttcacgaacttgtctatagaggagatacaggagattcttgagctatag

SEQ ID NO: 3188 - DNA, 990 bp, Unknown
  Bacillus sp. multi
atgtccgtgctgattaagacttacttgcacggttatcactccattctgtacaacaagcgaaagacctcctatgaagttggtcgcggcaagcccatgagcaatcagcagctcgtgaacctccgcatcgactttgcctttaaacaactcttcggcacctctgggaacgaagacatacttatcgcattcctcaacgcaatcctccaggacagcctagagtcacctattgtcagcttgcagctcgaagacccgcacctccatagggaacacgaggaggacaagctgtcaattctcgacattagcgccacgcttgacactgggactaaagtgaatgtggagatccagctcaacaacaaccacgatatgattaagcggagcctctattactggggccgcctctatacttcgcagttgcaaaagggtatgccttactcttcgcttcacaagacaatcactatcaacctcctaaacttcgttatgttcccggaatatgaggcgttccacaccactggcatcttgtggaatcagcagcagcagaagaagctatcagacgacatcgaagtgcacatggtggaaattcctaagttgatgcagcagtggagaaacgagcaagtcaatccctgggaggactcgttcgtgaggtggctactgctgctaccagctaacgaagacgagcagcttacgcagacccttgaggacattgccatgaatcaggatccgatcctccagaaggccattaacaagtgggagcggatgagccaagactcctccttcagacaggcttatgaggcgagggaaaaggcgctcatggacgaggcagctaagttcgcttacgccgaacagaagggcattgaaaagggaatcgagaagggcattgaacaaggaaagattcagctcatacgcgggatgcacaagaacgggatgcccattaaggacattgccaaattcactaacttgagtatcgaggaaatccaggagatactcgaattgtga

SEQ ID NO: 3189 - DNA, 990 bp, Unknown
  Bacillus sp. multi
atgtcagtccttattaagacctacctgcatggataccacagcatcctctacaataagcgcaagacctcctacgaggttggacgcgggaagccaatgtccaaccagcagctagtgaaccttcgtattgacttcgcgttcaaacagcttttcggaacttccggcaacgaggacattcttatcgccttcctaaacgctattctccaggactcacttgagagccccatagtgtctctccagctcgaagatccccatctccatagggagcatgaggaggataagctctcaatccttgacataagcgctactttggacactgggacaaaagtgaatgtggagattcagcttaacaacaaccacgatatgattaagcgctcgttgtactactggggtcggctttacaccagccaactccagaagggtatgccgtactcatccttacacaagacaatcaccattaacctcctgaatttcgtaatgttccccgaatacgaggcttttcacacgactggcatcttgtggaatcagcagcaacagaagaagctcagcgacgatattgaggtgcacatggtcgaaatcccaaaactcatgcagcaatggaggaacgaacaagtgaacccctgggaagactctttcgtgaggtggctgttgcttttaccagctaacgaggacgaacaacttactcagactttggaggatattgccatgaatcaggatccaatactccaaaaggctatcaacaaatgggagcggatgagccaggatagctcgttccgtcaagcctacgaggcgcgggagaaggcgctgatggacgaggccgcgaagttcgcatacgctgaacagaagggcatcgagaagggaattgaaaagggtatcgaacagggcaagatccaactaatccggggtatgcacaagaatgggatgcctattaaggacattgccaagttcaccaacttgtccattgaggagatacaggaaattctggaactctga

SEQ ID NO: 3190 - DNA, 996 bp, Unknown
  Bacillus sp. multi
atgtacggtagcaaacaggctctaatgagtacggacataagggcgtgccttcacatggaccactcattcatgtacaatgagcgtaagacatcctacgaaatgggacgcggaaaacctatgtccaatcagcagttggtgaacttacgaattgacttcgctttcaagcagctcttcggcacatcgggcaacgaagacatcctcattgccttcctcaatgcaatgctgcaagactccctggagtctcccatcgccagcttacaattggaagacccacatctccatcgagaacacgaggaggacaaactatcaatcctggacatctctgctacgctcgacacggggactaaagtcaacgtagagattcaacttaacaacaaccacgacatgattaagaggtcattgtactattggggccgcctctacacttctcagctccagaaggggatgccatactccagtttgcacaaaaccatcactattaacctattgaacttcgtgatattccctgagtatgaggcttttcacactactggcatcttgtggaaccagcaacagcagacaatcctttcgtcggacattgaggtgcacatcgtcgagatccccaaactgatgcaacagtggaggaacgagcaagttaatccctgggaagactcgttcgttcggtggcttctactcctccctgctaacgaggatgagcagctaactcagactctggaagatattgcgatgaaccaagatcccatccttcagaaggccatgaacaagtgggagcggatgagtcaagactcgtcgttccgtcaagcctatgaggctagggagaaggcactaatggatgaagccgcgaaattcgcccatgctaggaacgagggtatccaggaggggaagatacaaatgattaagggtatgcacgagttgggtgttcctatcgagacaatcgctaaggctagtaaactcagcatcgaggaggtccagcatatcctgtcacgcaactcttga

SEQ ID NO: 3191 - DNA, 996 bp, Unknown
  Bacillus sp. multi
atgtacggctccaaacaagccctcatgtcaacggacattcgcgcctgcctacacatggaccactcctttatgtacaatgagcgtaaaacgtcgtacgagatgggacgtggcaagcccatgtccaatcagcaacttgtcaatctccgtatcgacttcgcgttcaagcagctctttggcacctcagggaacgaggatatactgattgcgttccttaacgcgatgctccaagactctttggagtctcccattgcttctctgcaattggaagatccacacttgcaccgagagcacgaggaagacaagctgtccattcttgacatctccgcgacgttggatacggggactaaggtgaacgttgagattcagttgaacaacaatcacgatatgattaagcgttcactgtactattggggaaggctatacacatcgcagcttcaaaagggaatgccatactcttcgctgcataagaccataaccatcaaccttctgaacttcgtgatcttcccagagtacgaggcgtttcacaccaccggtattctgtggaaccagcagcagcaaaccatcctctcgtctgacattgaggtgcacatcgtggagataccaaaactgatgcaacagtggaggaacgaacaagtgaacccctgggaggactctttcgtgcgttggcttctgctcttgcctgcaaacgaggacgaacaactgacacagacactggaggatatagctatgaaccaagacccaattctccagaaggctatgaacaagtgggaacgtatgagtcaggactccagtttcagacaggcgtacgaagctagggaaaaggcacttatggacgaagccgctaagttcgcacatgcccgcaacgaggggatacaggaggggaagattcaaatgattaaggggatgcacgaactcggcgtcccaatcgaaacaatagctaaagctagtaagttgtcaatcgaggaggtgcaacacatattgtccaggaatagctga

SEQ ID NO: 3192 - DNA, 996 bp, Unknown
  Bacillus sp. multi
atgtacggttcgaaacaagccttaatgagcactgacattcgagcctgcctccacatggatcactccttcatgtacaacgagcggaaaaccagttacgagatggggaggggcaagccaatgtccaatcagcagctcgtgaatttgcgtatcgactttgcattcaaacaactctttggaacatctggcaatgaggacatcctcatcgcctttctcaacgccatgctccaagactctctggagagcccaattgcttcgctacaactcgaagaccctcatctccatcgggagcatgaggaagacaaactctctatactcgacatctctgctaccctggacactgggactaaggtgaacgtagagatccaactcaacaacaaccatgatatgattaagcgctccctctactactggggcagactttacacttcgcagttgcagaagggaatgccctacagctcactccacaagaccattactattaacctgttgaacttcgtcatattccccgagtacgaagccttccacacaactggtatcctatggaaccagcaacagcagactatactgagttctgacatcgaagtgcacatcgtcgaaatacctaagctcatgcagcaatggagaaacgagcaagtgaacccgtgggaggactcattcgtgcgttggctcctcctgctcccggcaaacgaggatgaacaattgacccagacccttgaggacattgcgatgaaccaagacccaatcctccaaaaggccatgaacaagtgggagcgaatgtcccaggacagctccttccgccaggcgtatgaggccagggagaaggctctgatggacgaggcagccaagttcgctcacgctaggaatgagggtatccaggagggaaagattcaaatgattaaggggatgcacgaattgggagtccctatagagacgatagctaaggcaagtaaactaagtattgaggaggtgcagcacatcctctcccgaaactcatga

SEQ ID NO: 3193 - DNA, 996 bp, Unknown
  Bacillus sp. multi
atgtacggctctaaacaggccctcatgtccactgacatccgcgcctgccttcacatggaccactcgttcatgtacaacgaacggaaaacttcctacgagatggggcggggcaagccgatgagcaatcagcaacttgtgaatctacgcatcgactttgccttcaagcagctcttcgggactagcgggaacgaagacattctcatcgccttcctcaatgcgatgctccaagacagtcttgagagccctatagcatcgctgcaacttgaagatccacaccttcaccgagagcacgaggaggataaacttagcatcttggacatatctgctacccttgacaccggcactaaagtgaatgtcgagatccaattgaacaacaatcacgacatgattaagcgcagcctctactattggggtaggctctacaccagccaactccaaaaggggatgccttattcctcactgcacaagacaattacgattaacttgctcaatttcgttatcttcccggaatatgaggctttccatacgactggcatactctggaaccagcagcagcaaaccattctgagttcagacattgaggttcacatcgttgagatacccaagctgatgcagcagtggaggaacgagcaagtgaatccctgggaagacagtttcgtaaggtggctcctccttttacccgctaatgaggatgagcaactgacacagacccttgaggatattgctatgaaccaagacccaatcctacaaaaggctatgaacaaatgggagcgtatgtcacaggactcttcgttccgtcaggcgtacgaagcccgtgagaaggcactcatggatgaagcagccaaattcgcacacgcccgcaacgagggaatccaggaggggaagattcagatgattaagggaatgcacgaattgggcgtgcctattgaaactatcgcaaaagcaagtaagttgtccattgaggaggtccagcatatccttagccgcaactcataa

SEQ ID NO: 3194 - DNA, 996 bp, Unknown
  Bacillus sp. multi
atgtacggttctaaacaagccctcatgtccacagacatccgagcgtgcctgcacatggaccacagctttatgtacaatgagcgcaagacttcctacgaaatgggtcgcggaaaacccatgtccaaccagcagttagtgaacctcagaatcgactttgccttcaaacagcttttcggaacttccggcaacgaggacatccttatcgcctttctcaacgctatgctccaggatagccttgaatcaccaattgcatcccttcaactcgaagatccccaccttcaccgcgaacacgaggaagacaaactgtcaatcctggacatcagcgccacgctcgacaccgggacgaaagtgaatgtggagattcagctcaacaacaatcatgacatgattaagaggtcgctctactactggggaagactatacacgagtcagcttcagaagggtatgccctactcaagcctgcacaaaactatcaccatcaacctattgaacttcgtgatattccctgaatatgaagcctttcacacaaccggaatcctgtggaaccagcaacagcagaccatactgtctagtgacattgaggtgcatatcgtggaaataccaaagttgatgcaacagtggcgaaacgagcaagtcaacccctgggaggactcattcgtccgttggctcctgctattgccagctaacgaggatgaacagctcacacagacactggaagatattgctatgaaccaagaccctatcctgcaaaaggctatgaacaaatgggaacgtatgtcacaggactcctccttcagacaggcgtatgaagcgcgggaaaaggccctcatggacgaggcggcgaagttcgcacacgccagaaatgagggtatccaggagggcaagatacaaatgattaaggggatgcacgagcttggcgttccaatcgaaacaatagcgaaagcgagtaaactgtctatcgaggaagttcagcacatcctatcgagaaattcttaa

SEQ ID NO: 3195 - DNA, 996 bp, Bacillus thuringiensis
atgtacggaagtaaacaagcactcatgagcaccgacattcgggcgtgcttgcacatggaccactcctttatgtacaacgagcgtaaaacctcctacgagatgggtcgtggcaagcccatgagcaaccagcagctagttaatctacgcatcgacttcgcgttcaagcagcttttcgggacttccgggaacgaagacattctcatagcgttcttgaatgccatgctacaagattcccttgagtcaccaatagcatcattgcagttggaagatccgcacctccacagggagcatgaggaagacaagctctccattctggacatctccgctacacttgacactggcactaaggtcaacgtggagatccaactgaacaataaccacgatatgattaagcgcagcttgtactactggggccgcctatacacctctcagttgcagaaggggatgccctattcgtctctccataagacaataacgattaacctcttgaatttcgtgatattcccggaatatgaggctttccacacaactggaatcctgtggaaccagcagcaacaaactatcctctcatccgacatcgaagtccatatcgttgagatcccaaagctgatgcaacaatggcgcaacgagcaagtaaacccctgggaagactctttcgttagatggctattgctcctcccggccaacgaggacgagcaactaactcaaacattggaggatatagctatgaaccaagacccaatactccagaaggccatgaacaagtgggagcgaatgagtcaggactcctccttcagacaggcttacgaagcgcgggaaaaggctctcatggatgaggcagccaagttcgcccatgcccgtaacgaggggatacaggaggggaagatacagatgattaaggggatgtacgagctgggtgtcccaatcgaaacaatcgcaaaggcttcaaaactatccattgaggaggtcgaacttatccttaaaggaaactcatga

SEQ ID NO: 3196 - DNA, 996 bp, Bacillus thuringiensis
atgtacgggtccaaacaagcactgatgtccaccgatattcgtgcctgcttacacatggatcacagcttcatgtacaacgaacgcaaaacttcatacgagatgggaaggggcaagccaatgtcaaatcagcagcttgtcaatctgaggatcgacttcgccttcaagcagctcttcggaacctctgggaacgaagacatcctgatcgcgttcctcaacgcaatgctccaggacagccttgaatctcccatcgcctcactccagctcgaagatccgcacctccacagggaacacgaggaagataagttgtccatattggacatatctgctacattggatacaggcactaaagtcaatgtcgagatccaactgaacaacaaccacgacatgattaagcgcagcctctactactggggacgcctatacacttcgcagcttcagaagggaatgccatactcctcacttcacaagacgattaccatcaacctccttaacttcgtgatcttcccggagtacgaagccttccacactacgggaatcttatggaaccagcagcagcagaccattctaagttctgacatcgaggttcatatcgtcgagatacctaagttgatgcaacaatggcgcaacgaacaagtaaatccgtgggaggactctttcgttcgatggctactactcttgcctgctaacgaggacgagcagctcacccagacacttgaagacattgctatgaaccaagaccccattctccaaaaggccatgaacaagtgggagcgtatgtcacaggacagctcattcagacaggcgtatgaagcaagggagaaggccctaatggacgaggctgccaaattcgcccacgcccgcaacgaggggatacaggagggcaagatccagatgattaaggggatgtacgaacttggcgtccccattgagactatcgctaaggccagtaaactttctatcgaggaggttgagctgatcctaaaaggcaactcatag

SEQ ID NO: 3197 - DNA, 996 bp, Bacillus thuringiensis
atgtacggtagcaaacaggcgctcatgtcaacagacattcgcgcgtgtcttcacatggaccacagctttatgtacaacgaacgtaagacaagttacgagatgggacgaggcaagccgatgtccaaccagcagctcgtcaacttaagaatagacttcgcattcaaacaactctttggcacttccggaaacgaggacatcctgatcgcgttccttaacgccatgctacaggactcattggagagcccaatcgcgtctttgcagcttgaagacccacatctccacagggagcacgaggaggacaagttatccatcctcgacataagtgccactttggacactgggactaaagtaaatgtcgagatccagctcaacaacaaccatgatatgattaagcgttcactgtactattggggacgcctttacactagccagttgcaaaagggtatgccgtattcgtccctacataagactatcacgataaacctcctgaacttcgtcatcttccctgagtacgaggcgttccacaccacagggatactgtggaaccagcaacaacagactatcttgtcatccgacattgaggtgcatatcgtggagatccctaagctcatgcagcagtggcgcaacgagcaagtgaatccgtgggaagactcattcgtaagatggcttttacttctgcccgcaaacgaggatgaacagctaacgcagacccttgaagatatagccatgaaccaagatccaatccttcaaaaggctatgaacaagtgggagcggatgtctcaagactcttcctttcgtcaggcgtacgaggccagggaaaaggccctgatggatgaagctgcgaaattcgcccatgcacggaacgagggcatccaggaggggaagatacagatgattaaggggatgtacgagcttggtgtgcctattgagactatcgcaaaggccagcaaactctctatcgaggaagtcgaactgatcctcaaaggaaattcgtaa

SEQ ID NO: 3198 - DNA, 996 bp, Bacillus thuringiensis
atgtacggatcgaaacaagcacttatgtccacagacatacgcgcgtgtttacacatggatcactcctttatgtacaacgagcgcaaaacatcgtacgaaatgggacgcggcaagcctatgtcaaaccagcagctcgtgaaccttcgcatcgacttcgcctttaagcaattgttcggaacctccgggaacgaagacattctgatcgcgttcctcaacgcaatgctgcaagactcccttgaaagccccattgcctctttgcaattggaagatcctcatctacatcgtgaacacgaggaggacaagctgtccatcttagacatatcagcaactctggacacggggacgaaggtgaatgtcgagatccaacttaacaacaaccacgacatgattaagcgctccctctattactggggtcggctctacacatctcagctccaaaagggtatgccgtactctagtttgcacaagacgataactattaacctcttgaatttcgtgatattccctgagtatgaggctttccatacaacgggtatcctctggaatcagcagcagcagaccatcttaagctcggacattgaagtgcacatcgttgaaattccgaaactaatgcagcagtggagaaacgagcaagttaatccctgggaggactcgttcgttcgttggctccttctcctaccagcaaacgaggacgaacagcttacgcaaacattggaggatattgctatgaaccaagaccccattctgcaaaaggctatgaacaaatgggaacgaatgtcacaggactcctcattccgacaggcttacgaagcccgcgaaaaggcactgatggacgaggccgcaaagttcgcccatgctcgcaacgagggcatccaagagggaaagatccagatgattaaggggatgtacgaactgggcgtccccatcgaaactatagccaaagcctctaaactatccatcgaggaagtggaactcatccttaaggggaatagctag

SEQ ID NO: 3199 - DNA, 996 bp, Bacillus thuringiensis
atgtacggctccaaacaagccttgatgtcaaccgacatccgggcgtgcctccacatggaccacagctttatgtacaacgagcgcaaaacttcgtacgagatgggaaggggcaagcccatgtcaaatcagcagctcgtgaaccttcgcatcgacttcgcattcaaacaactctttggcacctccggaaatgaggacatactcattgccttcctcaatgccatgttgcaagactccttagaatcgcccatcgcctcattgcagcttgaagatccccaccttcaccgtgagcatgaggaggataaactcagtatcctagacataagcgccactctcgacactgggacaaaggtgaatgtggagatacagttaaacaacaaccacgatatgattaagcgatccctttactactggggacgactctacacatctcagttacaaaagggaatgccttactcaagtctccacaagacaataaccatcaacctcctgaatttcgttatcttcccagagtacgaggcgtttcacaccaccggcatcttatggaatcagcagcagcagacgatcttgagttcagatattgaagtgcatattgtcgagatacccaaactcatgcaacagtggcgcaacgaacaagtgaatccctgggaggactccttcgttcgctggttgctcctgctcccagcaaacgaggacgaacaacttactcagactcttgaagatattgctatgaaccaagatcctatcctacagaaggctatgaacaaatgggagcgcatgtcccaagacagcagtttccggcaagcgtatgaggccagggaaaaggccctaatggacgaggctgccaaattcgcacacgcaaggaacgagggtatccaggagggcaagattcagatgattaagggtatgtacgagcttggcgtcccgatagagaccattgctaaagcctcaaagctcagtattgaggaggttgaattgatacttaaaggcaacagctaa

SEQ ID NO: 3200 - DNA, 1521 bp, Bacillus megaterium
atgagcaccccattacagcagccccaccagaagtccaagaagaccagccagatgattacaacgaggaagttcaagctcgctatcgtgtccgacaacaggaacgaagcctacagcttcattcgaaacgaaatccgcaatcagaacaaggctctcaacgcagcctacaatcacctttacttcgagcacatcgccacggagaagctcaagcacagtgacgaggaataccagaagcacttgaccaaataccgtgaggtgagcaccaacaaataccaggactacctcaaggtgaaggagaaggtgaacgcctcgaaggatgacgagaagctccagaagcgagtggataaggccagggaagcgtacaacaaggcacaggagaaggtgtacaagatcgaaaaggagtttaacaagaagtcaatggaaacctatcagaaggttgtcggattatccaagcaaactcgaatcggaaagttgctcaaatcgcagtttacacttcactacgatactgaggacagaattacatcgacggtactgtctcacttcaacaacgacatgaagaccggggtgttgcgtggggaccgctcacttcgaacctacaagaatagtcacccgctactggtccgggcacgttctatgaaggtgtacgaggagaacggcgactacttcatcaagtgggttaaggggatcgtgtttaagatagtgatctcggctgggtctaagcagaaggccaacattggtgagttgaagtcagtcctcatcaacattctcaacggccattacaaggtctgtgactctagtatctctctgaacaaagacctaattcttaacttgtctctgaacattcccgtgtctaaggagaacgtcttcgttcctggacgagttgtgggtgtggacttggggctaaagattcccgcttacgttagtcttaacgacacaccctatatcaaaaagggcattggaaacatcgacgacttcctgaacgtcaggacacaacttcaaaatcagcgcaaaaggctccagaaaacccttgagtgcaccagtggcggcaagggaaggagcaaaaagctcaaagggttggaccgcctaaaggcgaaggagaagaatttcgtgaatacctacaatcactttctgagcaagaagattatccaattcgccgttaagaacaatgctggtgtgatccacctggaggaactacagttcgacaagctcaagaacaaaagccttctccggaactggtcctactaccagctacaaacgatgatcgagtacaaggctgagcgcgaggggattgaggttaagtacgtcgatgccagctacacttcgcagacctgctccaaatgcgggcactacgagaagggccagagggtgttgcaagataccttcacatgcaagaacaaagagtgtaaggggtacgcccacaaagtgaacgcagacttcaacgcatctcagaacatcgccaagtccaccgacataatccgctgcacagagatggccaagaacaacgacatcgagaagaacgcctga

SEQ ID NO: 3201 - DNA, 1521 bp, Bacillus megaterium
atgagcacaccgcttcagcaaccccaccagaagtccaaaaaaacctcccagatgataacaaccaggaagttcaaactcgccatcgtctccgacaaccgaaacgaagcctattccttcatccgcaacgagatccggaaccagaacaaagccctcaacgccgcttacaaccacttgtacttcgagcatattgctaccgaaaagctcaaacactctgacgaggagtaccagaagcaccttaccaagtaccgcgaagtgagcacgaacaagtatcaggactacctcaaggtcaaggagaaggtgaatgcaagtaaagacgacgagaagttgcagaagcgagtggacaaagccagggaagcgtacaacaaagctcaggagaaggtgtacaaaatcgagaaggagttcaacaagaagtcaatggagacctaccagaaggtcgttgggctcagcaagcaaacccggatcggaaagctgctcaaatctcagttcacccttcactacgacacagaggaccggatcaccagcaccgtgctgtctcacttcaacaacgatatgaagaccggagtcctaagaggagatcggagtctgagaacgtacaagaatagtcacccacttctggttcgtgcacgttccatgaaggtctatgaggaaaacggggactacttcatcaagtgggtcaagggcatcgttttcaagatcgtgataagcgctggctcaaagcagaaggcaaacattggggagcttaagagtgtacttattaacatcttgaacggccactacaaggtgtgcgacagctccatcagcctcaacaaggacttaattctcaatctgtctttgaacatcccggtgtctaaggagaatgtgttcgtgcctggtagagtagtcggggttgacctggggttaaagatcccagcgtacgtctcactcaacgacacgccctacatcaaaaagggaattgggaacatcgacgacttcctgaacgtgaggactcaactgcaaaaccagaggaagcgactccagaaaacactggagtgcacttccggcgggaaagggcgcagcaaaaagttgaaaggcttggatcgactcaaggctaaggagaagaatttcgtgaacacatacaaccacttcctcagcaagaagataatccaattcgccgtcaagaacaatgcgggtgtcatccacctggaggagttgcagttcgacaagctcaaaaacaagagtctattgcggaactggtcgtactaccagctacagaccatgatcgagtacaaggccgaacgggaggggatagaggttaagtacgtggacgcctcctacacctctcaaacttgcagcaagtgcggacactatgagaaggggcagagagtgctacaggacaccttcacttgcaagaataaggagtgcaagggctacgcccacaaggtcaatgcggacttcaacgcttcgcagaacatcgctaagagcaccgacatcattcgctgtaccgagatggccaagaacaacgatattgagaagaatgcttag

SEQ ID NO: 3202 - DNA, 1521 bp, Bacillus megaterium
atgtccacaccgttgcagcagcctcaccagaagtccaagaagacctcccagatgattaccactcggaagttcaaactcgccatcgtctccgacaaccggaacgaggcttattccttcataaggaacgagatccgtaatcagaacaaagcgctcaacgctgcatacaaccacctctatttcgagcacatcgccaccgagaagctcaagcacagtgacgaggagtaccagaagcaccttacaaagtaccgcgaagtgtccacaaacaagtaccaagactacctcaaagttaaggagaaggtgaacgcttcaaaggacgatgagaaactccaaaagcgggtggacaaggcccgcgaggcgtacaataaggcccaggaaaaggtgtacaagattgagaaggagttcaacaaaaaatctatggaaacctatcagaaggtggtgggtctgagcaagcagacccgcatcggcaagctacttaagtctcagttcacgcttcactatgacaccgaggaccgcattacaagcactgtcttgtcccacttcaacaatgacatgaagactggtgtgcttagaggggatcgaagtctgcggacttacaagaacagtcatcccctacttgtgagggctcgctctatgaaggtttacgaggaaaatggggactacttcattaagtgggttaagggcatagtcttcaagattgttatctccgccgggtcgaagcagaaggcaaacatcggagagcttaagtcagttcttatcaacattctcaacgggcactacaaggtctgcgacagctccatctccctgaacaaggacttgatattgaacttatcacttaacatccccgtaagcaaggagaacgtattcgtccccggaagggtggtcggcgtggatctgggcttgaagattccggcctatgtgtccctgaacgacacgccctacatcaagaaagggatcggcaacattgacgacttcctgaacgttagaacacagttgcagaaccagaggaagcggctccagaaaacattagaatgcacgtccggcgggaagggaaggtccaagaagctaaaaggactcgacaggctcaaggctaaggagaagaactttgtcaacacatacaatcacttcctcagcaagaagattatccagttcgcggtcaagaacaacgctggagttatccacctagaggagttgcagtttgacaagctcaagaacaaatcactcctaaggaactggagctactaccaactacagacaatgattgagtacaaagccgagcgggaagggatagaggtcaagtacgtggacgcctcctatacctctcagacgtgctccaagtgcggccactacgagaaggggcagagagtgctacaagatacttttacgtgcaagaacaaggagtgcaaggggtacgcgcataaggtgaacgctgacttcaatgcttcacagaatatcgccaagagcacagacatcatccgctgcactgagatggccaagaacaatgacatcgaaaaaaatgcttag

SEQ ID NO: 3203 - DNA, 1521 bp, Bacillus megaterium
atgtcaacaccattacaacagccacaccagaagtccaaaaaaacgagccaaatgataacaaccaggaagttcaagctcgccatcgtgtccgacaacaggaacgaggcttattccttcattcgcaacgagatacgcaaccagaacaaggccctcaacgcggcctacaaccatctctacttcgagcatatcgccacggagaagctcaagcactcggacgaggagtaccagaagcacctcacgaagtacagggaggtgagtaccaacaagtaccaggactacctgaaagtcaaggagaaggtgaatgcgagtaaggacgatgagaagctccagaagcgggtggacaaggccagggaggcgtacaataaggctcaggagaaggtgtacaaaatcgagaaggagttcaacaagaaatctatggaaacgtaccagaaggtcgtgggactgagcaaacagacacgcatcggcaagctcttgaagtcccagttcacgcttcactacgatacggaggatcgcatcacctcgacggtactgagccacttcaacaacgacatgaagactggtgtactccgaggggatcgctcacttagaacatacaagaacagccatccactgctggtgcgtgctaggtccatgaaggtttatgaggagaacggcgattacttcattaagtgggtcaagggaatagtattcaagattgttatcagtgctggttccaagcagaaggcaaacattggggaacttaagtctgtgcttatcaacattctgaatgggcactacaaggtgtgcgattctagcatctctctgaacaaggacttgatcctgaatctctccttaaacatccctgtcagtaaggagaatgtgttcgtcccagggcgggttgtcggagtggatctggggctcaagataccagcctatgtttcacttaacgacacgccgtacatcaagaaggggattgggaatatcgacgacttcctgaacgtcagaacccagctccaaaatcagcgaaagcgtctccaaaaaactcttgaatgcacatcaggcggaaaagggcgttccaagaaattgaaggggctcgacaggctgaaagctaaggagaagaatttcgtgaacacatacaaccacttcctctccaagaaaatcattcaattcgctgtcaaaaacaacgctggggtgatccacttggaggagctacaatttgacaagctcaagaacaagtctctcctgaggaactggagctattaccagttgcaaaccatgatcgagtacaaggcagagcgcgagggaatagaggtgaagtatgtggatgcctcatacacctcccagacctgctctaagtgcggccactacgagaagggacagcgcgtgctccaggacaccttcacttgcaaaaacaaagagtgcaaaggctacgctcacaaggtcaacgcagacttcaacgcgagccagaacatcgcaaagtccacggacatcatcagatgcactgagatggctaagaacaacgacatcgagaagaacgcttga

SEQ ID NO: 3204 - DNA, 1521 bp, Bacillus megaterium
atgtcaacgccgcttcagcagccccaccagaagtccaaaaagacatcgcagatgataacaacacggaaattcaagctggccatagtgtcagacaaccgcaacgaagcctactccttcatccgcaacgagattcggaaccagaacaaggccctcaacgccgcatacaaccacctctacttcgagcacattgccactgagaaactcaaacactccgacgaggaataccagaagcacctcacgaagtacagggaagttagcaccaacaagtaccaggactacctcaaagtcaaggagaaggtgaacgcgagcaaggatgatgagaagctccagaagcgcgtggacaaggctcgggaggcgtacaacaaggcacaggaaaaggtttacaagatcgagaaggagttcaacaagaagtcaatggaaacttaccagaaggtcgtggggctgtccaaacagaccagaatcggcaagttgcttaaatcacagttcacgctccattacgacaccgaggaccggataacaagcacggtcctctcccacttcaacaacgacatgaagacgggcgtcctacgaggtgacaggagcttgaggacgtacaagaactcccatccactgctcgtcagggcaaggagtatgaaggtttacgaggaaaacggcgactactttatcaagtgggtgaaggggatcgtgttcaagattgtgatctcagcggggtctaagcaaaaggccaacatcggcgagttgaaatcagtgctgataaacattctgaatggccactacaaggtgtgcgacagttcgatctctctcaacaaagaccttatcctaaacttgtctctgaatatccctgtgtctaaggagaacgttttcgtgccagggagagtggtcggagtggacctcggtctaaagatccccgcgtacgtctcccttaacgatacgccctacattaagaagggaatagggaacattgacgactttctcaacgtcaggactcagctccaaaatcagcgcaaaaggttgcagaaaacactggagtgcacgtccggcgggaaggggaggtccaaaaagctcaagggacttgacaggcttaaggcgaaggaaaaaaacttcgtgaacacttacaaccacttcctttccaagaagataattcagttcgcagtcaagaataatgccggggtcatccacctggaggaattgcagttcgacaaactcaagaacaagtctttacttcggaattggtcttactaccagttgcagacaatgattgagtacaaagcagagcgcgagggtatcgaggtgaagtacgttgatgccagttacacatctcagacctgctccaagtgcggccactacgagaagggccagagagtgttacaggacacttttacttgcaagaacaaagagtgcaaggggtacgctcacaaggtgaacgcggacttcaacgcctcacagaacattgcaaagtccacagacatcataagatgcaccgagatggccaagaataacgacatcgaaaaaaatgcttaa

SEQ ID NO: 3205 - DNA, 1491 bp, Unknown
  Bacillus sp. multi
gtcatcttaacgcgcaaagttaagctggtcatcgtctccgacaacagggacgagggctacaagttgatacggaacgagatccgcgagcagcacaaggccctcaacttggcctacaaccacctctacttcgagcacaacgcgatccaaatcttaaaacagaacgatgaggactacaagcagaagcggaacaagctccaagagcttatcaacaagaaatacgaggagcaccaaaaggctaagaacttggagcgcaaggaggcactccgtgaggcttacaataacaaaaagcaagaactatacaaattcgaacgggagtgtaatgaggaggcacgcaaagcctaccagcaagttgtcggcttcacccagcagacccgcgtgaggaacctgataaaccgggagtacaaccttatgtctgacactaaagatggcatcaccagcaaggtcacccaggactacaagaacgactgcaaggcggggctgctgattggaaagcgatcactccgcaactacaaaaaagacaacccgctgcttgtgcgcggtcgctccctcaaattctacaaggaggatggcgactactttatcaagtggaacaaaggcaccgtcttcaagtgcattctgcacatccgcaagaaaaatgttgctgaattacagtcagtgttggagaacgtgcttctcggagcctacaagatttgcgactcttcaatcgggtttaacaacaaggacatgatactgaacctgagcctaaacattcctgacaaggagacatacgactacatccctggccgggtcgtaggggtggatttgggacttaagatcccagcgtacgtctctctgtccgacaaggtgtacgtccgcaaggggatcggcggaattgacgactttctcagggtcagaactcagatgcaaaagcgtcggaggcaattgcaagagtcactcgcggccgtaaaaggaggcaaaggccgtgagaagaagctcaaagctctggatcacttaaaaggcaaggaggccaatttcgcaaagacatacaaccacttccttagcactcaaatcgtgacgttcgcagtcaagaaccaggcgggacagatcaacatggaattcttggaatttgacaagatgaaaaacaagtcgctcctcagaaactggtcttactaccaactacaaatgatggtggagtacaaagcaaagcgggagggtatcatcatcaagtatgttgatgcctacctcacctcccagacgtgcagcaagtgcgattactacgaggaggggcagcgcgagaaacaggagaaattcatctgcaagagctgcgccttcgaagtgaacgctgactacaacgcttcccaaaacattgctaagagcgcacgctacatcagcgactctactgagcgtgagtaccacaaaaagaaacaagaggacttgaaggaaatcctcggtgagaacgacatcatcaacgagcaattgtccctctttgacaatcatgacgacattgcttga

SEQ ID NO: 3206 - DNA, 1491 bp, Unknown
  Bacillus sp. multi
gttatcctcacccgcaaggtcaagctcgtcatcgtctccgacaaccgggacgaagggtacaagctcatccggaatgagatcagggagcagcacaaggcgctcaatcttgcgtacaaccacctctacttcgagcacaacgcaatccagatacttaaacaaaacgacgaggactacaagcagaagcgtaacaaattgcaagaactcatcaacaagaaatacgaggagcaccagaaggctaagaatctcgaacgcaaggaagccctccgggaggcgtacaacaacaaaaaacaagaactttacaagttcgaacgcgaatgcaacgaggaagctaggaaggcgtaccagcaagtagtgggattcacccagcaaacccgagtgcggaacctcattaacagggagtacaacctcatgagtgacacaaaggacggcatcacgagcaaggttactcaagattacaagaacgattgcaaggctggtctgctcatcggcaagcggtcactcagaaattacaagaaggataacccactccttgtgcggggaagatcactcaaattctacaaggaggacggtgactacttcatcaagtggaacaaagggaccgtgttcaagtgcatccttcacatccgcaagaagaacgtggctgagctgcaaagtgtgttggagaatgtgcttctaggagcctacaagatatgtgactccagtattgggttcaacaataaggacatgatattgaacctcagcttgaacataccggacaaggagacgtatgactacattccagggagggttgtcggtgtcgatctcgggctaaagattccagcctacgtctctctgtctgataaggtttatgtgcgtaagggtatcggtgggatcgacgacttcctgcgcgtgaggacacaaatgcagaaaaggcggcgtcaattgcaagagtccctcgcggccgttaagggcgggaaggggagggagaagaaactcaaggctctggaccacttaaaaggcaaggaggcgaacttcgccaaaacctacaaccactttctctccacccagatcgtgacctttgcggtcaagaaccaggcgggtcagatcaacatggagttcctggagttcgacaagatgaaaaataagtccctgttgcgaaactggagctactaccagcttcaaatgatggtggagtacaaagcgaagcgcgagggcatcatcatcaagtatgtggacgcttacctcacctcccagacctgctcaaagtgtgactactatgaggagggacagcgtgagaaacaggagaaattcatctgcaaatcctgtgctttcgaggtcaacgccgactacaacgctagtcagaatatcgccaagtcggcacggtacatctccgacagtacagagcgtgagtatcacaaaaaaaagcaagaggatcttaaggaaatactcggggaaaacgacattatcaatgagcaactgtcattgttcgacaaccacgacgacattgcctga

SEQ ID NO: 3207 - DNA, 1491 bp, Unknown
  Bacillus sp. multi
gtgatccttacacggaaggtcaagctcgtcatcgtgagtgacaatagggacgaggggtacaaactcatccggaatgagatccgggaacaacacaaggccctcaatctcgcttacaatcatctctacttcgagcacaacgccattcaaatcctcaagcagaacgacgaggactacaagcagaagcgcaacaaattgcaagaattgataaacaagaaatacgaggagcaccagaaggccaagaaccttgagcgcaaggaagccttgcgcgaggcgtacaataacaagaagcaagaattgtacaaattcgagcgtgagtgcaacgaggaggccaggaaggcgtaccaacaagtcgttgggttcacgcagcagacacgagttcgaaacctgattaaccgtgagtacaacttgatgagcgacactaaagatgggattacttctaaagtgacacaggactacaagaacgattgcaaagccgggcttctcatcggcaaacgttctctgcggaactacaagaaagacaacccgctacttgtgcgaggacggagtttgaaattctacaaagaggacggagactactttatcaagtggaacaaaggcacggtgttcaagtgcatattgcacatccgcaaaaagaatgtggccgagcttcagtctgtcctggaaaatgtgctacttggagcctacaagatatgcgattctagcattgggttcaacaacaaggatatgatcttaaacctgagccttaacattcctgacaaggagacctatgactacattcccggacgagtcgttggcgtggatctcggtcttaagatccctgcttacgtctcgctgtcagataaggtttatgtgcgtaaggggattggcggcattgacgactttctcagagtgaggactcagatgcagaagcgcagacgtcagcttcaagagtccctggctgcggtgaaaggtgggaaggggcgcgagaagaaattgaaggcgctggaccacctcaagggcaaagaggcgaacttcgctaaaacctacaaccacttcctcagtacccagatcgtgactttcgccgtcaagaatcaggccgggcagatcaacatggagttcttggagttcgacaagatgaaaaataagagcctgttacggaactggagttactaccagcttcagatgatggtggagtacaaggctaagagggagggaatcattatcaagtacgttgacgcctatttgacatcccagacctgctctaagtgcgactattacgaggagggccagcgtgagaaacaggagaagttcatctgtaaatcgtgcgctttcgaggtcaacgcggactacaatgccagccagaacattgctaagtcggcgcgctatatctcagactcaaccgagcgcgagtaccacaagaaaaagcaggaggacttgaaggaaatactcggagaaaatgacatcatcaacgagcagctttccctatttgacaaccacgacgatattgcttag

SEQ ID NO: 3208 - DNA, 1491 bp, Unknown
  Bacillus sp. multi
gtgatcctgactcgtaaggtgaagctcgtcatcgtctctgacaaccgtgacgaggggtacaagctcattcgtaacgagatcagagagcagcacaaggccctcaacctcgcatacaaccacctgtacttcgagcacaacgccatacagatcctgaaacagaacgacgaggactacaagcagaagcgaaacaaactccaagaactcatcaacaagaaatacgaggagcaccagaaggctaagaatcttgagcgaaaggaagccctcagggaggcttacaataacaaaaagcaagaactttacaaattcgaacgtgagtgcaacgaggaggcgcgcaaggcttatcaacaagtcgtgggtttcacgcagcagacaagagttcgtaatctgataaaccgtgagtacaacctcatgtccgacacaaaggacggtattacgagcaaggtgacccaggactacaagaacgactgtaaggcgggcttactaattggaaaacggtccctccggaactacaaaaaggacaacccgctgcttgtccgaggccggagtctcaagttctacaaggaggacggagactacttcattaagtggaacaaaggaactgtgttcaagtgcatcttgcacatccgcaaaaagaatgtagccgagttgcagagtgtgttggagaatgtccttctgggcgcgtacaagatatgcgactccagcattggattcaacaataaggacatgatcctgaacctttctctcaatatcccagacaaggagacctatgattacataccagggcgagtcgtgggcgttgatctcggtcttaagatccccgcctacgtgagtttgagcgacaaggtgtacgtcaggaagggtatcggaggaatcgacgacttcctaagagtccgaacccagatgcagaaaaggcgaaggcagctacaggagtcgctcgcagccgtcaaaggtggaaaaggccgcgagaagaaattgaaggctttggaccacctcaagggcaaggaggctaacttcgccaagacttacaaccactttctcagcacacagatcgtgacattcgccgttaagaatcaggccggacagatcaacatggagtttctggaatttgacaagatgaagaataagtcactattgagaaattggtcttattaccagcttcagatgatggtcgagtacaaagcaaagcgggagggcatcatcatcaagtacgtggatgcttacttaacctcgcagacatgctcaaagtgcgactattacgaggaggggcagcgtgagaaacaggagaaattcatctgcaagtcatgcgcctttgaggtcaatgcagactacaatgcctcgcagaacatcgcaaagtccgctcgctacatctcggacagcacggaacgcgagtaccacaagaagaaacaagaagacttgaaggaaattctgggagaaaacgacatcatcaacgagcagctatcactcttcgacaatcatgacgacatcgcctga

SEQ ID NO: 3209 - DNA, 1491 bp, Unknown
  Bacillus sp. multi
gtcatcctcacgcgaaaggtcaagctggtcatcgtttcggacaacagagatgagggctacaagttaatccgcaatgagattcgggagcagcacaaggccctcaacctcgcgtacaaccacctctacttcgaacacaacgccatccagatcctcaaacagaacgacgaggactacaagcagaaacggaacaaactccaagaactcatcaacaagaagtacgaggagcaccagaaggccaagaacctggagcggaaggaggccctgagggaggcttacaacaacaagaagcaagaattgtacaagttcgagcgcgaatgcaacgaggaggcgaggaaagcctaccaacaagtcgtgggcttcactcagcagaccagggtccgcaaccttatcaatagagagtacaacttgatgtctgacaccaaagatggcattacctcaaaggtgacccaagactacaagaatgactgtaaggctggcctgctcatcggcaagcgttccctccgtaattacaaaaaagataatcccttactggtccggggccgtagccttaagttctacaaggaggacggcgactacttcatcaagtggaacaaggggaccgtgtttaagtgcattctccacatccgcaaaaagaacgtggctgagctacagtctgtacttgaaaatgtcctcttgggagcatacaagatttgcgacagtagtatcgggtttaacaataaggatatgatcctgaacttgtcgctcaacatacccgacaaggagacttacgactacataccagggagggtagttggcgtggacttggggctaaagataccggcctacgtctctctgtcagacaaggtgtacgtgcggaaagggattggtggtattgacgactttctccgtgtaagaactcagatgcagaaacgtcgaagacaactacaagaatccctcgccgccgttaaaggcgggaaggggagggagaagaaactgaaagccctggaccaccttaaggggaaggaggccaacttcgcaaagacctacaatcacttcctttcgacccaaattgtgacattcgccgtcaagaaccaggctggacagatcaacatggagttccttgagttcgataagatgaagaataagtcactgctcagaaactggagttactatcaattgcaaatgatggtagagtacaaggccaagagggaggggatcatcattaagtacgtcgatgcttacctgacatctcagacttgctctaagtgcgactactacgaggagggacagagggagaaacaggagaaattcatctgcaagtcctgcgccttcgaggtgaacgccgattacaacgcaagtcagaacattgccaagtcagctcgctacatatccgactctaccgaacgggagtaccacaagaagaaacaagaagacttgaaggagattctgggcgagaacgacattatcaatgagcaactgagccttttcgacaaccacgacgatattgcttag

SEQ ID NO: 3210 - DNA, 1491 bp, Unknown
  Bacillus sp. multi
gtgatcctgacccgcaaggtgaagctcgtcatcgtcagtgacaacagggacgagggctacaagctcatcaggaacgaaattcgtgagcagcacaaggccctaaacctcgcctatactcgcctgtacttcgaacataacgctatccagatcctcaagcagaacgatgaagactacaaacagaagcgaaacaaactacagcagctcatcaacaaaaaatacgaggagcaccagaaggccaagaaccttgagaagaaagaggccctccgcgaggcttacaacaagaaaaaacaagaactttacaacttcgagaaggagtacaacgaaaaggctagacaagcctatcaacaagtggtgggctttacccagcaaactagagtgcggaacctcatatcccgtgagtgcaacctcatgtccgacacgaaggacggtatcacctcgaaagtgacacaagattacaagaacgattgcaaggcgggcttgctcgctggaaaacggtccttgaggaactacaagaaggataaccctttgctggtccgagggcgctcccttaagttctacaaggaggacggagactacttcatcaagtggaacaaaggaaccatcttcaagtgcatcctacatatccgcaaaaaaaacgtagcagaacttcagtccgtgctggagaacgtgctcctcgacatctacaaggtgtgcgactcctcaatcgctttcaataaccgcgacatgattcttaacttgactttgaatatccccaataaggagactcaagattacataccgggccgggtcgttggagtggacctgggcctcaagatcccggcttacgtgagtctgagcgacaaggtttacgtcaggaagggaattggcagtattgacgacttcctccgagtgaggacgcagatgcagaagcgccgccgtcggttccaggagtcacttgctgccgtgaagggcggcaaagggcgcgagaagaagctaaaagctctggatcatcttaaagggaaggaggccaacttcgccaagacatacaaccacttcctctcaacacaaatcgtcacgttcgcagtcaagaaccaggcgggacagatcaacatggagttcttagagttcgacaagatgaagaacaagtctctgttgcgaaactggagctactaccaattacagatgatggtcgagtacaaggctaagcgcgaggggatcatcattaagtacgtcgatgcgtacttgacttcacaaacatgctctaagtgtgaccactacgaggagggccaacgtgagacgcaagaacgattcatgtgtaagtcatgcggtttcgaggtcaacgccgactacaatgcttcacagaacattgcaaagtccaccaagcacatcagcgactccgtggagagcgagtactacaagaagaagcaggaggcactcaaggaaatactccgcgagaacgacactatcaacgagcagctttccttacttgataactgcgacgacatcgcatag

SEQ ID NO: 3211 - DNA, 1491 bp, Unknown
  Bacillus sp. multi
gtcatcctgaccaggaaagtgaaactggttattgttagcgataacagggacgaaggatacaagttgatccggaacgagatccgagagcaacacaaggccctcaaccttgcctataccaggctgtacttcgagcataacgcaattcaaatcctcaagcagaacgacgaggactacaaacaaaagcgcaacaagttgcaacaactcatcaacaaaaagtacgaggaacaccagaaggccaagaaccttgagaagaaggaagcgctccgggaagcgtacaacaagaaaaaacaagaattgtacaacttcgagaaggagtacaacgaaaaggcacgccaggcttaccagcaagtagttgggttcacccagcagacacgggtcaggaacctgataagtcgggagtgcaatctcatgagcgacactaaggatgggattactagcaaggtcactcaagactacaagaatgattgcaaggctgggctcctagcgggaaagcggtccctgcgtaactacaaaaaagacaacccgcttctcgtccgagggcgttccttgaagttctacaaggaggacggagactacttcatcaagtggaacaaagggaccatcttcaagtgcatattgcatatccgcaagaagaatgtcgccgagttgcagtcagtcttggaaaacgtgctgcttgacatatacaaggtttgcgatagcagtattgctttcaacaacagagacatgatcctcaaccttactcttaacattccaaacaaggagacccaagactacatacctgggagagtcgtgggagtggacttgggccttaagataccagcctatgtttcgctctctgacaaggtttacgtgcggaaggggatcggcagcattgacgacttcctaagggtcagaacacaaatgcagaagcgacgacgccgcttccaggagtctctagcggcagtgaagggaggcaagggccgggagaagaagctcaaggcacttgaccacctcaagggcaaggaagcaaactttgccaaaacgtacaatcacttcctctccacccaaatcgtaaccttcgctgtcaagaatcaggctggtcagatcaacatggagttcctagagtttgacaagatgaagaataagtctctcctccgaaactggtcttactaccagcttcagatgatggtcgagtacaaggccaaacgggaggggattatcatcaagtacgtggatgcttacctcacgtctcagacttgctcaaagtgcgaccactacgaggagggccagcgggagacccaggaaaggtttatgtgcaagtcctgcgggttcgaagtgaacgccgactacaacgccagtcagaacattgcgaaaagtacgaagcacatctcagactcggtggagtcagagtactataaaaaaaagcaagaggcccttaaggagatcctccgcgagaacgacacgattaacgagcaactgagcctgctggacaattgcgacgacatcgcttga

SEQ ID NO: 3212 - DNA, 1491 bp, Unknown
  Bacillus sp. multi
gtgatcctgacccgaaaggtgaagctcgtcatcgttagtgacaaccgcgatgaggggtacaaactgatccggaacgagatccgggaacagcataaggccctcaacctggcctacacacgactctacttcgaacacaacgccattcagatcctcaagcagaacgacgaggactacaagcagaaacgtaacaagctccagcaactcatcaacaaaaaatacgaggagcaccagaaggctaagaacctggagaagaaggaggcgctacgggaggcgtacaacaagaaaaaacaagagctgtacaactttgaaaaggagtacaacgagaaggcccgccaggcttatcaacaagtggtgggtttcacccagcagacccgagtcaggaatctcatatcacgagaatgcaatcttatgtcggatacaaaggacggaatcacatcgaaggtcacccaagactacaagaacgattgcaaggcgggattacttgccggaaagcggtctttacgcaattacaagaaagataatccactactggtgcgagggagatcactgaaattctacaaggaagacggggactactttatcaagtggaacaagggaaccatcttcaagtgcatcctgcacatccgcaaaaaaaatgtggccgagcttcagtctgtgttggaaaatgtgctcctcgacatctacaaggtctgcgattccagcattgctttcaataaccgtgacatgattctgaacttgactcttaacatccccaacaaggagacacaggactacatcccaggccgcgtcgtgggagtggatcttggattgaaaatccctgcttatgtttcactgtctgataaggtgtacgtgcgaaaagggatcgggagtatcgacgacttcctgcgtgtgagaacccagatgcagaagcgtcgaagacgcttccaagagtccctcgcggcagtcaagggcggaaagggacgcgagaagaaactcaaggcactcgaccatctcaagggcaaggaggcaaacttcgccaaaacatacaaccacttcctctctactcagatcgtgacattcgcagtcaagaaccaggccggtcagatcaacatggagttcctggagttcgacaagatgaaaaacaaatcactgttgagaaactggtcgtactaccagcttcaaatgatggtggagtacaaggcaaagcgcgaggggatcatcatcaagtacgttgacgcttacctgacatcacaaacgtgctccaagtgcgaccactacgaggagggccagcgggagacacaggaacggtttatgtgcaagtcttgcgggttcgaggtcaatgcagactacaatgcttcccagaatatcgctaagagcaccaaacacatcagtgattcagtggagtcggagtactataagaagaaacaagaagcactcaaggaaattctgagggagaacgataccatcaacgagcagttgtcacttctggataactgtgatgacatcgcttaa

SEQ ID NO: 3213 - DNA, 1491 bp, Unknown
  Bacillus sp. multi
gtgatcctaacgcgcaaagtgaagttagtgatcgtatcggacaaccgcgacgagggctacaagttgatccgaaacgagatccgagagcagcacaaggctctcaacctggcatacacccgcttgtacttcgagcacaacgcgatccagatcctcaagcagaacgacgaggactacaagcagaagcgcaataagctacagcagcttattaacaaaaaatacgaggagcaccagaaggccaagaatttggagaagaaggaagcactcagggaagcgtacaacaaaaagaaacaagaactttacaatttcgagaaggagtacaacgaaaaggcgcgtcaggcgtaccaacaagttgtgggtttcacccagcaaactcgcgtaaggaacctcatatccagggagtgcaacctcatgtccgacacaaaggacggtattaccagtaaagtgactcaagactacaagaatgactgcaaggccggactccttgctggcaaacgtagtctgagaaattacaagaaggacaaccccttgcttgtgaggggtcgttcattgaagttctacaaggaggacggggactacttcatcaagtggaacaaggggaccatcttcaagtgcatactccatatccgcaagaagaatgtcgccgaactccagagcgttctggagaatgtgttgctggacatctacaaagtgtgcgactccagtatcgcgttcaacaacagggacatgatcttgaacctcactctcaacattcccaacaaggaaacgcaagactacatccccggtcgtgtggtcggggtggacttgggactaaagatacctgcctacgtctcgctaagcgacaaggtgtacgtgaggaaggggatcgggagtatcgacgacttccttcgggtgcgaactcaaatgcagaagcgtcgtcgtcggttccaagagtcactcgcagccgtcaagggcgggaaggggagggaaaaaaaactcaaagctcttgaccacctcaaggggaaggaggccaacttcgccaagacctacaaccacttccttagtacgcaaattgtgaccttcgccgtcaagaatcaggccggacagattaacatggagtttctggagtttgacaagatgaaaaataagagtctgctgcgtaactggtcatattaccagcttcagatgatggtggagtacaaagccaagagggagggaatcatcatcaagtatgtggatgcctatctcacttcccaaacgtgcagcaagtgcgaccactacgaggaagggcagcgcgagactcaggaacgattcatgtgtaagtcatgcggatttgaagtgaatgccgactacaacgcgagccagaacatcgcaaaatctacaaagcacatctccgacagtgtggagtctgagtactacaagaaaaagcaggaggcactaaaggagatcctgcgggaaaatgacacgattaacgagcagctcagtttgctggacaactgcgacgacattgcttga

SEQ ID NO: 3214 - DNA, 1491 bp, Unknown
  Bacillus sp. multi
gtgatactgacaaggaaggtgaaactcgtgatcgtgtccgacaaccgagacgaggggtacaagctcattcgtaacgagatccgcgagcagcacaaggcgctaaaccttgcttacactcgcctttacttcgagcataatgccatacaaatcttaaagcagaacgacgaagactacaaacagaagcgcaacaaactccagcagctcatcaacaagaagtacgaggagcaccagaaggctaagaacctggagaagaaagaggcgctccgggaggcttacaacaagaaaaaacaagagctgtacaacttcgagaaggagtacaacgagaaggcccgccaggcgtatcaacaagtagtgggttttacccagcaaacccgtgtcaggaatctcatctcacgcgagtgcaacttgatgtctgacacgaaggacggaatcacctctaaggtgacacaagattacaagaacgactgcaaagctgggttgctggccggaaagcggagccttcggaactacaaaaaagacaaccctctgttagtgcgaggccgcagtctgaaattctacaaggaggacggagactactttatcaagtggaacaaggggaccatattcaagtgcatactgcacatccgcaaaaagaacgtggctgagttacagtcggtgcttgaaaatgtgctacttgacatctacaaagtctgtgactcttccattgcattcaataaccgagacatgatactcaacctgacgctgaacatccccaacaaggaaacccaggactacatacctggccgcgtcgtgggagttgatctgggccttaagataccagcttacgttagtctcagcgataaggtgtacgtgaggaaaggaatcgggagcattgacgacttcctgcgtgtgaggacacagatgcagaaacgtaggaggcgctttcaagaatcgctggccgcagtcaaaggtggaaagggaagggaaaaaaagttgaaggcccttgaccaccttaaagggaaggaggccaacttcgccaaaacctacaatcacttcctctctacccaaatcgtcacgttcgccgtcaagaaccaggccggacagataaacatggaattccttgaatttgacaagatgaagaataaatctctcctgagaaactggagctactaccaattgcaaatgatggtcgagtacaaggccaaaagggaggggatcatcattaagtacgttgatgcgtacctcacctcccagacctgctctaagtgcgaccactacgaggagggtcagagggagacacaggaacgcttcatgtgtaaaagctgcgggtttgaggtcaatgccgactacaacgcctctcagaacatcgccaagagtacgaaacacatcagcgactctgttgaatccgagtactacaagaaaaagcaagaggcactcaaggagattctccgtgagaacgacaccatcaacgagcaactctcactgctggataactgcgacgacattgcatga

SEQ ID NO: 3215 - DNA, 1491 bp, Unknown
  Bacillus sp. multi
gttatcctcacccgaaaggtcaagctcgtcatagtctccgacaacagagacgaggggtacaagctcatccgcaatgagatccgagaacagcacaaggcactaaacctggcatacacgcgcctctactttgagcacaacgccatacaaatccttaagcagaacgacgaggactacaagcagaaacgaaacaagctacagcaactcatcaacaaaaagtacgaggagcatcagaaggccaagaaccttgagaagaaagaggctctgcgcgaggcttacaacaagaagaagcaagagctttacaatttcgaaaaggagtacgacgagaaggcccggcaagcgtatcaacaagtcgtcggcttcacacaacagacccgtgtgaggaacctcatctcccgagagtgcaaccttatgagtgacactaaagacggcatcacatccaaagtcactcaagattacaagaatgactgcaaggccgggctcctcgccggaaagcgatctctccgcaactacaagaaggataacccattgctggttcgtgggcgctcactcaagttctacaaagaggacggagactacttcattaagtggaacaagggcactatcttcaagtgcatcctgcacatccgcaagaagaacgtggccgaactccagagtgtgctggagaatgtgctgctggacatctacaaagtctgcgacagttccatcgccttcaacaaccgcgatatgatacttaacttgactttgaacattcccaacaaggagacacaggactacattccggggcgcgtcgttggcgtggacctcggccttaagatcccggcttatgtcagcctgtccgacaaggtttacgtgaggaaggggatcggctccattgacgatttcctgcgtgtgagaacacaaatgcagaagcgccggaggcgcttccaggaatcattagcggcagtgaagggcggcaagggtcgtgagaagaagctaaaggccctggaccacttgaagggcaaggaggctaacttcgctaagacctacaaccacttcctctcaacacaaatcgttactttcgctgtcaagaatcaggcgggccagattaacatggagttccttgaatttgacaagatgaagaacaaaagtctgctccggaactggtcctattaccagttgcaaatgatggtggagtacaaggcgaagcgcgagggtatcatcatcaagtatgttgatgcttacttgacttcacagacctgttccaagtgtgaccattatgaggaaggacagcgtgagacccaggaaagattcatgtgcaagtcatgcgggttcgaagtgaatgcggactacaacgcatcgcagaacattgcaaaatctacgaaacacatcagtgactccgtggagagcgagtactacaagaaaaaacaagaagccctcaaggaaatcctcagggaaaacgacactatcaacgagcagctctcactacttgataactgcgacgacatcgcatga

SEQ ID NO: 3216 - DNA, 1491 bp, Unknown
  Bacillus sp. multi
gttatcctgactcgcaaagtgaagttggtcatcgtgtccgacaaccgcgacgaggggtacaagctcatccgaaacgaaatccgggagcagcacaaggctctaaacctcgcttacactaggctatacttcgaacacaacgctatccagatcctaaagcagaatgacgaggactacaagcagaagcgtaacaagctacagcaattgataaacaaaaaatacgaggagcaccagaaggccaagaaccttgaaaaaaaggaggccctcagggaggcgtacaacaagaaaaagcaagaactctacaacttcgaaaaggagtacgatgagaaggctcggcaagcctaccagcaagtagtcgggttcacacaacagacgagagtccgcaacctcatctcaagggaatgcaaccttatgtccgatacgaaagatggcatcaccagcaaggttacacaggactacaagaacgactgtaaggctggcctcctcgccgggaagcgtagtttgcggaactacaaaaaggacaatcctctgctggtccggggacgtagcctcaagttctacaaggaggacggggactacttcatcaagtggaacaagggcacaatcttcaagtgcatcctgcatatccgcaagaagaacgtggcagagttgcagagcgtcttggaaaatgtgctcctggacatctacaaggtctgcgattctagtattgcattcaacaatagggacatgatactcaacctgactctcaacatacccaacaaggagacgcaagactatatccctggtcgtgtggtgggagtggatctaggactaaagattccggcatacgtcagcttgagcgacaaggtttatgtgcgaaagggaatcgggtcgattgatgactttctccgtgtcaggactcagatgcagaaaaggcgaagacgcttccaggaaagccttgccgctgtgaagggcgggaaaggccgtgagaagaaactcaaagcgctcgaccaccttaaggggaaggaggcgaacttcgccaagacgtacaatcacttcctcagcacgcagatcgtgaccttcgcagtcaagaaccaggccggtcagataaacatggagttcttggagtttgacaagatgaaaaacaaatccctcctccgaaactggtcctactaccagctacagatgatggtcgagtacaaagccaagcgcgaagggattatcattaagtacgtggacgcatatctcacgtcacaaacatgctctaaatgcgatcactacgaggagggtcagcgcgaaacccaggaacgattcatgtgcaaaagctgcggattcgaggtcaacgctgactacaatgcctctcagaacattgccaagagtaccaagcacatctctgacagtgtggagtcggagtactacaagaaaaaacaagaggcccttaaggagattctccgggagaatgacactatcaacgaacagttatcactactcgacaattgtgatgatattgcctga

SEQ ID NO: 3217 - DNA, 1491 bp, Unknown
  Bacillus sp. multi
gtgatcttgaccaggaaggtgaaactcgtgatcgtgtccgacaatagagatgagggttacaaactaatccggaacgagatccgggaacagcacaaggctctgaacctggcctacactcgcctctatttcgagcacaacgccatccaaatccttaaacaaaacgacgaggactacaagcagaaacggaacaagctccagcagctcattaacaagaagtatgaggaacaccagaaggccaagaatctggaaaaaaaggaggcactccgcgaggcgtacaacaaaaagaagcaagaactatacaacttcgagaaggagtacgacgagaaggccaggcaagcgtatcaacaagttgtgggcttcactcagcagacgagggtgcgtaacttaatctctcgggagtgcaacttgatgagcgacacgaaggacggcatcacgtcaaaggtgactcaggactacaagaacgactgcaaggctgggctcttggccgggaaaaggagcttacgcaactacaagaaggacaaccctctgctcgtgcgtggacgctcgttgaagttctacaaggaagatggagactactttatcaagtggaacaagggaactatcttcaagtgcattctacacatccgcaagaagaacgttgccgagttgcagtctgtgctggagaatgtcctactagacatctacaaggtgtgcgacagcagtattgcgttcaacaatagggatatgatattgaacctcacattgaacatcccaaacaaggaaacacaagactacattcccggtcgagttgtgggcgtggatctgggactcaagatacccgcttacgttagtttgagtgacaaggtgtacgtgcggaaagggatcggatcaatcgacgacttcctgagggtacgcacccagatgcagaagcgtaggagacgttttcaagagtcgctggccgccgtcaagggcggcaaaggacgtgagaagaagctcaaggccctagaccacttaaagggcaaggaggcgaactttgctaagacctacaaccacttcctttccacacagatcgttacattcgccgtcaagaatcaggctggtcagatcaacatggagttcctggagttcgacaagatgaaaaataagtcgctgttgcgtaactggtcttattaccagttgcagatgatggtagagtacaaggccaagagggaggggatcattatcaagtatgtggacgcttaccttacctcgcagacttgcagcaaatgcgaccattatgaggaagggcagcgcgagacccaggagcggttcatgtgcaagagctgcggctttgaggtgaacgcggactacaacgcttctcagaacatcgccaagtccaccaaacacatcagtgacagcgtggagtctgagtactacaaaaagaagcaagaggcgctcaaggagatattgcgtgaaaacgacactattaacgagcaactatcattactagacaactgcgacgacatcgcatga

SEQ ID NO: 3218 - DNA, 1491 bp, Unknown
  Bacillus sp. multi
gtgatcctgacgaggaaagttaagctggtgatcgtgtcggacaaccgggacgaaggctacaagctaatccgcaacgagatccgcgagcagcacaaggcgctcaatttggcctatacccgcctttacttcgagcacaacgccatccagatcctcaagcagaatgacgaggactacaaacagaagcgtaacaaattgcagcaactcatcaacaaaaagtacgaggagcatcagaaggccaagaaccttgagaagaaggaggccctgcgcgaagcctacaacaaaaagaagcaagaactctacaacttcgagaaggaatacgacgaaaaggcacgacaggcttatcaacaagtagtgggtttcacacagcagaccagggtgcggaacctcatctcccgtgagtgcaaccttatgtcggacactaaggacggcatcacatccaaagtgacacaggactacaagaacgactgtaaggccggacttctcgctgggaaaaggagcctacggaactacaagaaggataaccctctccttgtccgaggccgcagtctcaaattctacaaggaggatggggactactttatcaagtggaacaaaggcaccatattcaagtgcattctgcacatccgcaaaaaaaatgtggccgaattgcagagcgtgcttgagaatgtgttacttgacatctacaaggtttgcgactcctccatcgcattcaacaatagggatatgatacttaacctgacccttaacatccccaacaaggaaactcaagactacatacctgggcgagtggtcggtgtggatttggggctcaagatacctgcctatgtgagccttagcgacaaggtgtacgtccggaagggtatcgggtcaatagacgacttcctcagagtcaggactcagatgcagaagcgaaggaggaggttccaggagagtctagccgctgtgaagggcggcaaggggcgcgagaagaagctcaaagcactcgaccacctcaagggcaaagaggcaaacttcgccaagacctacaaccacttcctcagcacgcagatagtgactttcgccgtcaagaatcaggctgggcagatcaacatggagttcttggagtttgacaagatgaaaaacaaatcgctgctcaggaattggtcctactatcaactgcaaatgatggtggagtacaaagcaaagagggagggaatcatcatcaagtacgtggacgcttacctcaccagccagacgtgcagcaagtgcgaccattacgaggaaggccagcgcgagacccaggaaagattcatgtgcaagtcctgcggcttcgaggtgaacgccgactacaacgcctcacagaatatcgctaagagcacgaaacacatctcagacagcgtggagagtgaatattacaagaaaaagcaggaggcgctcaaggaaatactgcgtgaaaacgacacgataaacgagcagctctcactcttggataactgcgacgacattgcgtag

SEQ ID NO: 3219 - DNA, 1491 bp, Unknown
  Bacillus sp. multi
gtgatcctaactcgtaaagtgaagctcgtaatcgtgagtgacaacagggacgaggggtacaaactcattcgcaacgagattcgggaacagcacaaggcccttaaccttgcctacacacgcctgtacttcgagcacaacgccatccagattctcaagcagaacgacgaggactacaagcaaaagcgtaacaagctccagcagctcatcaacaagaaatacgaggagcaccagaaggccaagaatcttgagaagaaggaggctctccgcgaagcctacaacaagaagaagcaagaactgtacaacttcgaaaaggaatacgacgagaaggcaagacaggcgtaccaacaagtagttgggtttacgcaacagacaagggtccggaacctgatctcaagggagtgcaacctgatgtctgacacgaaagacggaatcacctctaaggttacacaagactacaagaacgactgtaaggccggactcttggccgggaaacggtccctgcgtaactacaagaaagataacccattgctggtccgaggacgctcattgaaattctacaaggaggatggggattacttcatcaagtggaacaagggcaccatcttcaagtgcatactgcacatccgcaagaagaatgttgcggaacttcagagcgtcttggagaacgtgctgcttgacatctacaaagtctgcgacagctcaatcgcgttcaacaaccgggacatgatcttgaacttgactctgaacatcccaaacaaggagactcaagattacattcccggtcgcgtcgtcggtgttgacctggggctaaagattcccgcgtacgtctcactttccgataaggtttacgtccgtaaggggatcggttccattgacgacttcctccgggtgagaactcaaatgcagaagcggaggcgacgattccaggagagtttagctgccgttaagggtgggaaggggcgcgagaagaaactcaaggcgcttgaccatctcaagggcaaggaggcaaactttgccaagacctacaaccacttcctgtcaacccagatagtgaccttcgcagttaagaaccaggccgggcagatcaatatggagttcttagagtttgacaagatgaagaataagtccctgctgcggaactggagttactatcagttgcagatgatggtggagtacaaagcaaagcgcgagggcatcattatcaagtacgtggatgcctacctcacaagtcagacctgctccaagtgcgaccactacgaggaggggcagcgggagactcaggagcggttcatgtgcaagtcctgcggcttcgaggtcaatgccgactacaacgcttctcaaaacatcgcaaagtccacaaagcacattagcgacagcgtagagtctgaatattataagaagaagcaggaggcactcaaggagatactcagggagaatgacactatcaatgagcagctctccctcttagacaactgcgatgatattgcatga

SEQ ID NO: 3220 - DNA, 1056 bp, Unknown
  Paenibacillus thiaminolyticus (multi)
atggggactgaaaccgacgagcatcatacagtgcaccaccgtcacgacacatcgtaccggttccttctaagctccaagaagctattcgtggaactccttcgcagtttcgttcagaaggaatgggtcgaacgcatcgacgagaccaatgtccaggaaattcctcactcattcgttctccaagacttcaaacgtaaggaggctgacttggtgtaccgtgtaaagttgaatggtcaggatgtagtgttctatttgctcttagagatgcagagtaaagtggactttctcatgccgtacagattgctgctttaccaagttgagatatggcgctacttgatgaaggaccaggaaaaggcaaaagggaagccgaagacttttcgacttccgcccatcgtgcccattgtcctgtacaatggaaagcgaaggtggaccgcatcccgccagtttagacaattgcttgcgaacgagacaatgttcgggtcagaactactcaatttcgagtacgtgctcattgacgtcgctcgctatactgaggaggagctgctggcattgagcaacaccatcggctctgtcttcctgttggaccagaccgctgaccagacagagttactaaatcgtttgggaaagctaatgcacacgatccaacaattgcccgaagacagccaacagcaactcgttgcgtggatggccaacattctgtcacagaaactacccgaaaacgagccacagctcagggagttaattcaaaacgtgaaaggaggcgtgtcagtcatgggacttgagaaaaccctggacgcgattaagagggaaggaagacgcgaggggcgtcgtgagggactcagggaggggctccgcgaggggttaagggagggtatcttggaaggaaaacaagagggcaaacgtgaggggatacttgagggaaagcaagagggcaaaagggaggctaaagaggaggtggtcaagcagatgattgctgaaaaccttgaccctgacctcatcgcacgagttactggctttccactcgacatcataacacaactccgtgagaagtcgcactaa

SEQ ID NO: 3221 - DNA, 1056 bp, Unknown
  Paenibacillus thiaminolyticus (multi)
atgggaaccgaaaccgatgagcaccatacagtccaccaccgccacgacacgagctacagattcctccttagctccaagaagctcttcgttgaacttctgcggtcattcgtacaaaaggaatgggtggagcgaatagacgagacaaatgtacaggagattccgcactcgttcgttctgcaagacttcaaaaggaaggaagctgacttagtgtaccgggtcaagttgaacggacaggatgtcgtattctatctccttctcgaaatgcagtctaaggtggatttccttatgccgtaccggcttctgctttatcaagttgaaatctggagataccttatgaaggatcaggaaaaggcgaaggggaagccgaagacctttagacttcctcccatcgtgccgattgtactttacaacggcaagcgtcgttggactgcatcccgacaattcagacagctacttgcgaacgaaacaatgttcggaagtgagttgcttaacttcgaatatgtgttaattgatgtagccagatacaccgaggaggagttactcgcactgagtaacaccatcgggagcgtgttcctgctagaccagaccgccgaccagacagaactgctcaacaggctaggaaagctcatgcacactattcaacaattgcccgaggacagccaacaacagctcgtagcctggatggccaatatcctgtcacagaaacttccagaaaacgagccacagctccgagaactaatccagaacgtaaagggcggagtctcagttatgggtttggagaaaacattggatgccattaagagggagggccgtagggagggtcggagggagggtctgagggagggactgcgcgaggggttgagggaagggattctggagggaaagcaagagggcaagagggaggggattctggagggcaagcaagaggggaagcgtgaggctaaggaggaagttgtcaaacagatgattgccgaaaacctcgaccctgaccttattgcgagagtaactggcttcccactggacattatcacacaactacgtgagaaatctcactga

SEQ ID NO: 3222 - DNA, 1056 bp, Unknown
  Paenibacillus thiaminolyticus (multi)
atgggcaccgagactgacgagcatcatactgttcaccaccgtcatgacacctcgtacagattcttactatcatccaagaagctgttcgtggaacttctccgctccttcgttcaaaaggaatgggttgagcggatagacgagaccaatgtccaggagattccacactccttcgtattacaggacttcaagcgcaaggaagccgacttggtgtaccgcgtgaagttgaacggtcaagatgtggtattctacctgttacttgagatgcaaagcaaggtggacttcctcatgccctacagactcctactatatcaagtggagatttggcgctacctcatgaaggaccaggaaaaggcgaaggggaaacccaagacgttccggttgccacccattgtacctattgtcctctacaatggaaagaggcgttggacggcttcacgccagttccgtcaactgcttgcaaacgagaccatgttcggaagcgagttactgaacttcgaatacgttctaatcgacgttgcaagatacaccgaggaggaattacttgctttaagtaataccattggctctgtgttcctcctagaccaaaccgcagatcagacagaactcctaaacagactcggaaagctcatgcacaccatccagcagttacccgaagacagccagcaacaactcgttgcgtggatggcaaacatactctctcagaagctgccagaaaacgagccacaattgcgcgagttgatccagaatgttaagggcggcgtcagtgtgatgggcttggagaagactctcgacgctatcaagcgcgagggtaggcgtgaagggagacgggagggactgcgtgagggattgcgagaaggcttgagggagggtatccttgagggcaaacaagagggcaagcgggagggaatacttgagggaaaacaggagggaaaacgagaagctaaggaggaagtcgttaaacagatgattgcggaaaatctggaccctgacttaattgcgagagtgactggatttccgctggacatcatcacacagctcagggagaagtctcattga

SEQ ID NO: 3223 - DNA, 1056 bp, Unknown
  Paenibacillus thiaminolyticus (multi)
atgggaaccgagaccgatgagcaccataccgttcatcacagacacgacacatcttaccgctttctattaagttccaagaaactattcgtggagttgctcagatcattcgtgcagaaggagtgggtcgaacggattgatgagacgaatgtccaggagataccgcattcattcgttctgcaagatttcaagaggaaagaggcggatctcgtttaccgggtgaagttgaacggtcaggatgtggtgttctatctgctcttggaaatgcagtccaaagtggatttcctcatgccttacagactgctactctatcaagtcgagatttggcgctaccttatgaaggatcaggagaaggcgaagggaaagcccaaaactttccgcctgccacctattgttccaattgtgctctacaatggcaaacgacgatggactgcctcacgccagtttagacagttattggcgaacgagacaatgttcggtagcgagctattgaacttcgaatatgtgctcattgacgttgctcgttacactgaggaggagttgctcgcactaagtaataccatagggagcgtcttcctcctcgatcagactgccgatcagacagagcttctcaacaggctggggaagctgatgcacactatccaacagctccccgaggatagtcagcaacagttggtggcttggatggccaatatcttgtcacagaagctgccagaaaatgagcctcagctacgggaactcatacagaatgtcaaaggtggggtttcagtgatgggattggagaagacattagacgccattaagcgcgaagggcgacgggaagggagacgcgaaggtttgcgagaagggctgcgggagggcctacgtgagggaatcctagagggaaaacaagagggcaaacgtgagggcatattggagggcaaacaggaggggaagcgcgaagcaaaggaggaggtggttaagcagatgattgcagaaaaccttgaccctgatctcatcgccagggtgactgggtttccactagacattatcacacaattgcgagaaaagtctcattag

SEQ ID NO: 3224 - DNA, 1056 bp, Unknown
  Paenibacillus thiaminolyticus (multi)
atggggaccgaaactgacgaacaccacaccgtgcatcaccgtcacgacacctcttaccggttcctcctttcctccaagaaattgttcgtggagttactgcggtctttcgttcaaaaggaatgggtggaacgaattgatgagacaaatgtccaggaaattcctcactcgttcgttctccaagacttcaaacggaaggaagccgacctcgtttatcgggttaaactaaatggtcaagacgtcgtgttctacctactcttggaaatgcagtccaaagtggacttccttatgccctacaggctcctgctctaccaagtcgagatttggcgatacctcatgaaggatcaggaaaaggcaaagggaaaacccaagacctttcgcctaccgcctatcgtgcctattgtgctgtacaacgggaagcgccgctggacagcttcacggcagttccgccaattgcttgcaaatgagacaatgttcggatctgaactcttgaatttcgaatatgtgcttatcgacgtagcacgctacaccgaggaggaattgttagcccttagtaacaccattggtagcgtgttcttgctggaccagaccgctgaccagaccgaactacttaaccgacttggcaaactcatgcacaccattcaacaacttcccgaagactcacaacagcaacttgtcgcttggatggccaacattctatctcagaaattaccggaaaacgagccacagctcagagagctgatccagaacgtgaagggaggtgtcagcgtgatggggttggagaagactctggacgctatcaagagggagggccgccgcgagggtcgtcgtgaaggtttgagggaaggactgagggaagggttacgtgaggggattcttgagggcaaacaggagggcaaacgtgagggcatcttggaaggaaaacaagagggcaaacgcgaggctaaggaggaagtggtgaagcagatgattgctgaaaacctcgatccagacctgattgcgagagtaaccggcttccctttggacatcattactcaactccgcgagaagtcacattga

SEQ ID NO: 3225 - DNA, 1044 bp, Unknown
  Paenibacillus thiaminolyticus (multi)
atgggcactgaaacagacgagcatcacaccgtccatcacaggcacgatacctcctacagattcctcctctcgtccaaaaaactcttcgtagagttgcttcgttcattcgttcaaaaggagtgggttgaacgtatcgacgagactaatgtccaggagatacctcactcattcgtcctccaagacttcaaaaggaaggaagccgatctcgtttaccgcgtcaaactgaatggtcaggatgtcgtattctacctgctgttggaaatgcaaagcaaagtggacttcctaatgccctaccggctcttattgtaccaagtggagatatggagataccttatgaaggaccaggagaaggcaaaaggaaagccaaagacattccggttgccgcctatagtccccattgttctatacaatggaaaacgtagatggacagcctcaagacagttccgacagcttctggctaatgagactatgttcgggtctgagctgctcaatttcgaatacgtgctcattgacgttgcgcgatataccgaggaggaattactggccctgtctaataccattggtagcgtattcttgttagaccaaaccgccgaccaaaccgagcttctcaacagactgggcaagctaatgcacacaattcaacaactaccggaagactctcaacagcaacttgtggcatggatggccaacatcctttcccagaagttgccggaaaatgagccacagcttcgtgtcctgatccagaatgttaaaggcggtgtaagcgtaatgggacttgagaagacactggacgccattaagcgtgaggggcgaagggagggacgtagggaaggcttacggcaagggctccaggaggggattcgggaaggaaagcgcgaggggataagggaaggggttctggaggggaaacaggaggggaaacgggaggcgaaagaggaagtggccaagcagatgatctctgagaaccttgatccagaactaattgcgagagtgaccggattcagcctcgacataattgcacagctccgcgaaaagtctaagtga

SEQ ID NO: 3226 - DNA, 1044 bp, Unknown
  Paenibacillus thiaminolyticus (multi)
atgggaacggaaacagacgagcaccacacggtacatcacagacatgacacttcataccggttcctcctgtccagcaagaaactattcgtggaacttttacgttccttcgtgcaaaaggagtgggttgagcgaattgacgagacaaacgtccaggaaataccgcactctttcgtgctccaggactttaagaggaaagaggccgatctagtttaccgcgtcaaactgaacggacaagatgtggtattctacctcctgcttgagatgcagtcgaaggtggacttcctcatgccatatagacttctgctataccaagtggagatttggcgctatcttatgaaggatcaggaaaaggctaaaggaaagcctaaaaccttcagacttcctcctatagtgcccatcgtactctacaatggaaagcgccgatggacagcttctcgccaatttcggcagcttttagccaacgagaccatgttcggctctgagctgttgaactttgaatacgtgcttattgatgttgccagatacactgaggaggagttactcgcgctgtcaaacacaatcggaagcgtgttcttgctcgaccagaccgcagaccagactgagctgctcaataggcttggaaaactgatgcacaccattcagcagttaccagaggactctcagcagcagctagtggcatggatggccaacattctgagccagaaactacctgaaaacgagccgcagcttagagtcctaatccagaatgtaaagggtggggtgtcagtgatgggcctggagaagactttagacgctattaagcgtgaagggaggagggaaggaaggcgtgaggggctccgtcaggggcttcaagagggcatccgcgagggcaaacgcgaagggatcagggagggcgtacttgaaggcaaacaggagggaaagcgggaagctaaggaggaagtcgccaagcaaatgatctccgaaaacctcgacccggagctgatcgcacgggtcacggggttctcgctagacatcatcgctcagctcagggagaaaagcaaatga

SEQ ID NO: 3227 - DNA, 1044 bp, Unknown
  Paenibacillus thiaminolyticus (multi)
atggggaccgagaccgacgagcatcataccgttcatcaccgccacgatacctcatatcgtttcctgttgagcagcaaaaagctgttcgttgaacttttacgttcgtttgtccaaaaggaatgggtcgagcgcattgacgagaccaacgtccaggagatccctcactctttcgtgctgcaagacttcaagcgcaaggaagccgacctcgtgtaccgtgttaagctaaacggtcaggatgtcgtgttctacctcctcttggaaatgcagagcaaagtcgatttcctaatgccatacaggctgttgctatatcaagttgagatttggcgctatcttatgaaggaccaggaaaaggccaaaggcaagcctaagacattcagattgcctccaatcgtgcccatagtcctctacaatggaaagcgacgttggacggcttccaggcagtttcgtcagctacttgccaatgagactatgttcggtagtgaactcttaaacttcgaatatgtcctgattgacgttgcacgatacacagaggaggagcttctcgccctatccaacactattggatcagtattcttactcgatcagactgctgaccagacagaattgctcaatcgcctgggcaagctgatgcacacaattcaacaattgccggaggactcacagcagcagctcgtggcctggatggccaacattctctctcagaaactacccgaaaacgagccacagctcagggtgcttatccagaacgtgaaaggtggtgtaagcgtcatggggctggagaagaccctcgacgcgatcaagagggaggggaggcgcgagggacgtcgggagggactcagacaagggctacaggagggaatccgtgaaggaaagcgcgagggcatcagggagggagtgttggagggaaaacaggagggcaagagggaagctaaggaggaggtcgctaaacaaatgatctccgaaaacctcgacccagaacttattgctagagtgaccggcttttcgctcgacatcatcgcacaattacgtgagaagtccaagtga

SEQ ID NO: 3228 - DNA, 1044 bp, Unknown
  Paenibacillus thiaminolyticus (multi)
atgggaaccgagaccgacgagcaccacacggtgcaccacagacacgatacctcttaccgtttcctgttatcgtccaagaagctgttcgtcgaactgttgcgttccttcgtacagaaggagtgggtcgaacgaatagacgagactaacgtccaggaaatccctcactcattcgtactgcaagactttaagcggaaggaagccgacctcgtttacagggtgaaattgaacggtcaagatgtcgtgttctacctactcttggaaatgcagtctaaagtggacttcctcatgccctaccgcttgctgctttatcaagttgagatatggcgctacttgatgaaggaccaggagaaggctaagggaaagcctaagactttccgcctaccaccaattgtaccaatcgtattgtacaacggcaagaggagatggaccgcttcacgtcaatttcgacaattgctggcgaacgagacaatgttcgggtctgagttactgaacttcgaatatgtcctaatagacgtcgctcgctataccgaggaggaacttttagcactttcaaacaccattggaagcgtcttcctcttggaccagacggcggaccaaaccgaactccttaaccggctcgggaaactaatgcacaccatacaacaactaccagaggactctcagcagcagttggtggcttggatggccaacatactttcacagaagctccctgagaacgaaccacaacttcgtgttctaattcagaacgtcaaaggaggagtctccgttatgggccttgagaaaaccttagatgctattaagcgtgaaggacgaagggagggacggcgggaggggctgcgacaaggacttcaagagggcatacgagaaggcaagcgggagggtatcagggagggagtgttggaagggaaacaagagggaaaacgggaggctaaggaggaagttgctaagcaaatgatctctgaaaatcttgatcccgaacttatcgctcgcgtaactgggttctcccttgacataatcgcccagctcagggagaaatccaagtga

SEQ ID NO: 3229 - DNA, 1044 bp, Unknown
  Paenibacillus thiaminolyticus (multi)
atgggaacagagaccgatgaacaccacacagtgcaccaccgtcacgatacaagctaccgctttctactcagtagcaagaaactgttcgtggagctgcttcgttccttcgtgcagaaggagtgggtcgagcgtattgatgagaccaatgtccaggaaattcctcactcattcgtcctacaagacttcaaacgcaaggaggctgacttagtgtaccgcgttaaactgaacggacaggacgtggtattctacctgctgctggagatgcagtcaaaggtggactttctcatgccgtatcgtctcctactctatcaagttgagatatggcgttacttgatgaaggaccaggagaaggctaaaggaaagccaaagacattccgactgccacctattgtacctatcgtactctacaatggaaaacgtcggtggacagcatcgcgccagttccgtcagctactggctaatgagacaatgttcggaagtgaactactgaacttcgaatatgtgctgattgacgttgcaagatacactgaggaggaactgcttgctttgagtaataccatcggctccgttttcctacttgaccagactgccgaccagaccgagttgctcaacaggctagggaaactcatgcacacaatccagcagctacccgaagattctcagcagcagctagttgcctggatggcgaacattctcagccagaaattaccggaaaatgagccccagttgcgtgtcctaatccagaacgtgaaaggtggcgtttccgtcatggggcttgagaaaactttggacgcgatcaagcgggaagggcgacgtgaagggaggcgcgaagggttgagacaggggttacaggagggcatcagggagggaaagagggagggaatcagggagggagttctggaggggaagcaagaggggaaacgggaagctaaggaggaagtggccaaacagatgataagtgagaaccttgaccccgagcttatcgccagggttactggcttcagcttggacatcatcgctcagctcagggagaagtctaaatga

SEQ ID NO: 3230 - DNA, 1020 bp, Unknown
  Paenibacillus sp. multi
atgggcactgagacagacgaacaccatacagtccaccaccgtcacgacacatcctaccgattcctcctgtccagcaagaaattgttcgtcgaattactccgcagtttcgtgcaaaaggaatgggtggagcgcattgacgagacaaacgtacaggaaatccctcacagtttcgtgttacaggacttcaagcggaaggaggcggacttagtttaccgggtcaagttgaacggccaagatatagtgttctacctcctcctggagatgcaaagcaaggttgacttcctcatgccttaccgattgctcctctaccaagtcgagatatggcgctacctcatgaaggatcaggaaaaggcaaagggaaaacctaaaacctttcgtctgccaccaattgtacctatcgtactttacaatgggaagcggagatggactgcatcacgtcagttcagacagttactagcaaacgagaccatgttcggtagcgagcttctcaactttgagtacgttctcattgacgttgctcgttacactgaggaggaacttctggcgttgagcaacaccattggctcagtcttcctcttggaccaaacggctgaccaaacagaactcttgaacaggcttggccagctcatgcacaccatacagcaacttccagaggacagccaacagcagttgatcgcttggatggccaacattctatctcagaagctgcccgaaaacgaaccacagcttcgtgagcttattcaaaacgtgaagggcggcgtgtcagtgatgggtcttgagaagaccctcgacgcgatcaagagggaaggacgtagggaggggagacgcgagggcttacgggaagggatacgagaagggaagcaagagggaatacgggaggggaaacaggagggcaaacgggaagcgaaagaggaagttgttaaacacatgataagcgagaacttggacccggaactaattgcccgagttactggattctcattagacattatcgcccagttaagggagaagacaaagtga

SEQ ID NO: 3231 - DNA, 1020 bp, Unknown
  Paenibacillus sp. multi
atggggaccgaaaccgacgagcaccacacggtccatcacaggcacgacacttcctaccgctttctcctttccagcaagaagctcttcgtcgaattgctgcggagcttcgtgcaaaaggaatgggtcgaacggatcgacgagacaaacgtacaggaaataccacacagcttcgtcctccaggacttcaaaaggaaggaagccgatctagtgtaccgagttaagttgaacggacaggacatcgtgttctatctcctcctggagatgcagagcaaggtggacttccttatgccatacaggctgcttctctatcaagttgagatttggcggtacttgatgaaggaccaggaaaaggcaaagggaaaacctaaaaccttcagactgccacctatcgtgcccatcgtcctatacaacgggaaacgccgatggacagctagtcgtcagttcagacaacttctagctaatgagaccatgttcggaagtgaacttctaaacttcgaatacgtgctaatcgacgtcgcacgctatactgaggaggagctactcgccttaagcaacactatcggctccgttttcctcctggaccagacggccgaccaaactgaactactcaatcgacttggacagctaatgcacacgatccagcagctccccgaagacagtcagcaacagctcattgcttggatggcaaacattctatcgcagaagctacccgaaaacgaaccccagctcagggagcttattcagaacgtgaaaggaggggtgtcagtgatgggtctggagaaaacccttgacgctattaagcgtgaaggaaggagggagggacgccgcgaaggcttgcgcgagggaatccgcgagggaaaacaagagggaatcagggaggggaaacaggagggaaagcgggaggctaaagaggaagtcgtgaaacacatgatctccgagaaccttgacccggaactgattgccagagttacagggttcagccttgacatcatcgcccagttaagggagaagactaagtga

SEQ ID NO: 3232 - DNA, 1020 bp, Unknown
  Paenibacillus sp. multi
atgggaactgagacagatgaacatcacaccgtccatcaccggcacgacacatcttacagattcttattgtcctccaaaaagctcttcgtggagctgctccgctcattcgtacagaaggaatgggttgaacgaatagacgagacaaatgtccaggagataccccactctttcgtactccaagacttcaagcggaaggaagccgacctagtttaccgcgtgaagttaaatggacaggacatcgtattctacctactccttgaaatgcaatctaaggtggactttctgatgccatatagactactgctttaccaagttgagatttggcgatacctcatgaaggaccaggaaaaggcgaaggggaagcccaaaaccttccgccttccgcccattgtccctatagtgctgtacaacggcaagcgccgctggacagcttccagacagtttcgacagctcctagccaacgagacaatgttcgggtcagaattgctcaactttgagtatgttctcatcgacgttgcaagatacactgaggaggaattgcttgcactctcgaacaccatcggctctgtcttcctcttagaccagacagccgaccaaaccgaattgctgaaccgcttgggccaactgatgcacaccattcaacagctaccagaggactcacagcagcaattgatcgcctggatggccaacatactgtcccagaagctgccggagaacgagccccaactacgggaattgatccagaatgttaagggcggtgtgagtgttatgggattggagaaaacgctggacgccattaagcgcgaagggaggagggaaggtcgtagggaaggactacgtgagggcatccgggaagggaaacaggaggggatacgtgaagggaagcaagagggaaagagggaggctaaggaggaagtggttaaacacatgatctctgaaaatcttgatccagaacttatcgccagagtgactggcttctcactggacatcatcgcacagctccgcgagaagactaaatga

SEQ ID NO: 3233 - DNA, 1020 bp, Unknown
  Paenibacillus sp. multi
atggggactgagacagacgaacatcacacggttcatcacagacatgacacatcgtaccggttcttgctatccagcaaaaagctcttcgtcgagctgctgaggtctttcgtccaaaaggaatgggtggaacgtatcgacgagactaatgtacaggaaatacctcactctttcgttctccaagacttcaagcgcaaagaggccgatctagtttaccgcgtgaaactcaacggtcaggacatcgtgttctatctcctcctggaaatgcagagtaaagtggacttcctgatgccgtacagactgttgctctaccaagttgagatatggcgttatctgatgaaggatcaggaaaaggccaaaggcaagccaaagacctttcgcttgcctcctatcgttcctattgtcctttacaacgggaaaaggaggtggacagcttcacgtcagttcagacagcttttagcaaatgagactatgttcggatcagagttgctcaatttcgagtatgtgctcattgacgtcgcgcgatatacagaggaggaattacttgccctttcgaacactatcggatcggtattcttgcttgaccagactgcggaccaaactgagctgctcaaccggctcggacagctaatgcacactatccaacagttacccgaggatagtcagcaacagttgatcgcctggatggcaaacatcttgagtcagaagttgcccgagaacgaaccccagctcagagagcttatccaaaacgtgaaaggcggtgtctctgttatgggtttggagaaaacgctcgacgcgattaagagggagggtcgccgcgaaggtcgccgtgaagggttgcgtgaagggattcgggagggcaaacaggagggcataagggagggcaaacaggagggaaaacgcgaagctaaggaggaggttgtgaaacacatgataagcgaaaacctcgatccggaactcatcgccagagttactggcttttccctagacatcattgcacagttacgcgagaagacaaagtga

SEQ ID NO: 3234 - DNA, 1020 bp, Unknown
  Paenibacillus sp. multi
atgggaactgagactgacgagcaccacacagttcaccacagacacgacacctcgtaccgtttcctgctctcctccaagaaactcttcgtagagttgcttagatcattcgtccaaaaggaatgggtggaacgtatcgacgagactaatgtccaggaaattccgcactcattcgtcctccaagactttaagcgaaaggaggccgacttagtttatcgagtgaaactcaacggccaggacatcgtattctatctccttttagagatgcagagcaaggtggacttcctaatgccctacaggctgctcctttaccaagttgagatttggcgctaccttatgaaggatcaggagaaggctaagggaaagccgaagactttccgtttgccgcctattgtaccaatcgtcttgtacaacgggaagcgccgttggactgccagcagacagttccgccagcttttagcaaacgagactatgttcggcagtgagttgttaaacttcgagtacgtgctgattgacgttgctcgttacaccgaggaggaattgctcgcgcttagtaacaccatcgggtcggtcttccttctggaccagactgcggaccagactgaactcctgaacagactgggccaattgatgcacacgattcaacagcttcctgaggactcacagcagcagctcattgcatggatggcgaacatcctctcacaaaagttgccagaaaacgagccccagttgagggaacttatccaaaacgtgaaaggtggtgtgagcgtaatgggattggagaagacccttgatgccattaagcgggaaggccgtagggaagggaggcgggaaggtttacgtgagggcattcgggagggaaaacaggaggggatacgggagggaaaacaggagggcaaacgagaagcaaaggaggaggtcgtcaaacacatgataagcgagaacttggacccggaacttattgcacgggtcacaggcttcagtcttgacattatcgctcagttacgtgaaaaaactaagtga

SEQ ID NO: 3235 - DNA, 1056 bp, Unknown
  Paenibacillus lentimorbus (multi)
atgggcacggagaccgacgagcaccatacagtgcatcaccgtcatgacacctcctaccgctttctcctgtccagcaagaagctcttcgttgaattgttacgctatttcgttcaaaaggagtgggtcgaacgcattgacgagactaacgtccaggagatccctcattcgttcgtactgcaagacttcaaacgcaaggaggcagacctagtatatcgggtgaaactgaatggtcaagatgtcgtattctacctgttgctggaaatgcaatctaaagtggactttctcatgccctaccggcttctcctctatcaagttgagatttggagataccttatgaaggatcaagaacaagcgaaaggcaaacccaagaccttcagacttccaccaattgttcctatcgtgctctacaacggcaagaggcgatggaccgctaaccggcagttcagacaacttctcgcaaacgagacaatgttcgggtcagagctactgaacttcgagtatgtcctgattgatgtggcgagatataccgaggaggagctattagctctttcgaacacaattggctcagtcttcctacttgaccagaccgcagaccaggcggagttacttaatcggcttgggaaactgatgcacacaattcagcagttgccggaagactctcaacaacagcttgtcgcgtggatggccaacatcttgtcacagaagttgcctgaaaatgagccgcaattgagggagctgatacaaaatgtgaagggaggagtgtcagttatgggacttgagaagactctggacgcgatcaagagggaaggtcgaagggaaggacgtcgagaagggttgcgcgaggggttacgcgagggattgcgcgagggaatccttgagggaaaacaagagggaaaacgtgagggtctattggagggcaaacaagaggggaagcgcgaagctaaggaggaagttgtgaagcaaatgattgccgaaaacctcgatcctgaccttattgctcgtgtgacgggtttccccttagacattatcacccaactccgtgagaagtctcactaa

SEQ ID NO: 3236 - DNA, 1056 bp, Unknown
  Paenibacillus lentimorbus (multi)
atgggcaccgagacggatgaacaccacacagtgcaccacagacatgacacatcctaccgattcctcctctcatccaagaagctcttcgttgaactactacgctacttcgtccagaaggagtgggttgagcgcattgacgagaccaacgtccaggaaataccccactctttcgttctccaagacttcaaaaggaaggaggcagacctcgtgtaccgggttaagctgaacggacaagacgtggtattctatctgctccttgagatgcagtctaaggttgactttctgatgccataccgactcttgctctaccaagttgagatttggcgttaccttatgaaggatcaggaacaagctaagggaaaacctaaaacctttagacttccgccaatagtgcctattgtcctttacaatgggaaaaggcggtggactgcgaaccgccaattccgtcaactattagcgaacgagaccatgttcgggagcgaactactcaactttgaatatgttctgatcgacgtagcaagatataccgaggaggaacttctcgcgttgtccaacactatcggttcagtcttcctgctggaccaaacggcagaccaggctgaattgctcaaccggcttggaaaactgatgcacacgattcaacaacttccagaggatagtcagcagcaacttgtggcatggatggccaacattctctcacagaaattgccagaaaacgaaccacaacttcgggaactcattcagaacgtcaagggcggagttagcgtcatgggccttgaaaaaacacttgatgcgattaagcgggaaggtcgccgtgaaggacgccgtgaggggcttcgggaaggactgcgggagggactaagggagggcattctggaagggaaacaagagggcaagagggagggattgcttgagggaaaacaggagggaaaacgagaagcgaaggaggaggtggtcaaacaaatgatcgccgaaaaccttgatcctgacctcatcgcccgagtaacaggcttccctttagacattatcacccaattgagggagaagtcacactag

SEQ ID NO: 3237 - DNA, 1056 bp, Unknown
  Paenibacillus lentimorbus (multi)
atggggactgagacagacgagcaccacacggttcatcaccggcacgacacctcctaccggttccttctctctagcaagaagctgttcgtggaactactccgctacttcgtccaaaaggagtgggtcgagcgcattgatgagactaatgtacaggagattcctcactccttcgtcttacaggacttcaaacggaaagaggcggatctcgtttatcgggttaagttaaatggtcaggatgtcgtgttctatttgctcctggagatgcagtcaaaggtggacttcctcatgccttaccgcctgttgctgtaccaagtggagatatggcgctacttgatgaaggatcaggaacaggcaaaggggaagcctaagacctttcggctccctcctattgtccccattgtcctttacaatgggaaacggcgctggaccgcaaacaggcaatttcggcagctattagctaacgagacaatgttcggaagtgaactcttgaatttcgagtacgtgctaatagacgtagcaagatatactgaggaggagttgcttgctttaagcaacactatcggatcagtgttcttgcttgaccaaactgccgaccaagccgaactgcttaacagactcgggaaattgatgcacaccatacaacaactccccgaagacagtcagcagcaacttgtggcttggatggccaacattcttagtcaaaagttaccagaaaacgagcctcagttgagagagctgattcaaaatgttaaaggtggagtcagtgtgatggggcttgagaaaacattggatgctattaagagggagggaagacgggagggtaggcgggaaggtttacgcgagggccttcgtgaaggtctgagggaggggatattggagggcaaacaggagggcaaacgcgagggactattggaaggaaagcaagaggggaaacgcgaggccaaagaggaggtcgtgaaacaaatgattgctgaaaatctggaccccgatctcattgcccgtgtcaccggctttcccttagacattatcacacagttgcgtgagaagtctcactag

SEQ ID NO: 3238 - DNA, 1056 bp, Unknown
  Paenibacillus lentimorbus (multi)
atgggaactgaaacggacgagcatcacactgtccaccatcgacacgacacatcctaccgattcctgctctccagcaagaaattgttcgttgagcttctcagatacttcgtgcaaaaggagtgggtcgagcggatcgacgagaccaacgtccaggaaattccacattcattcgtactccaagactttaaacgcaaggaagccgacttagtttacagagtgaaactaaatggtcaagatgtcgtattctacctactgttagagatgcaaagtaaggtggacttccttatgccttatcgtctgttattgtaccaagtggagatttggcgctacttgatgaaggaccaagagcaagcgaagggcaagcccaagacgttccgtctgccacctattgtcccaatcgtcctctacaacggaaagaggagatggacagctaatcgtcaattcagacagcttctcgcaaacgaaacaatgttcggatcggagctgttgaacttcgaatatgtactgatcgacgttgccagatataccgaggaggagttgctcgccctatctaataccattgggtcggtgttcttgctcgatcagacagcagaccaagctgagctgctgaaccggcttggcaaacttatgcacaccattcagcagttgcccgaagacagtcagcagcaactcgtggcttggatggcaaacatcctgtcccagaaattaccagaaaacgagccacagcttagagagcttattcaaaatgtgaagggtggcgtgtccgtgatgggattggagaaaacgctcgacgctatcaagcgagaaggccgtcgggagggacggcgtgagggacttcgtgagggccttcgagaagggctgagggaggggatattggaagggaaacaggaagggaagcgcgaaggtctgttggaaggcaaacaggaggggaaacgcgaagctaaggaggaggtcgtcaagcagatgatcgcggagaatttggacccagacctaattgcaagagtgactggcttcccacttgacattatcactcagttacgtgagaaatcgcactaa

SEQ ID NO: 3239 - DNA, 1056 bp, Unknown
  Paenibacillus lentimorbus (multi)
atgggcaccgagaccgatgagcaccataccgtgcatcacagacatgatacttcatacagattcctgttgagttccaagaagctcttcgtcgaactccttcgctatttcgttcagaaggagtgggtcgaaaggatcgacgagactaatgtccaggagattcctcattcattcgtgctccaagatttcaaacggaaggaggcggatctcgtgtacagggtgaagttgaatggtcaggatgtcgtgttctacctgctcctcgaaatgcaatctaaggtggacttcctcatgccatacaggctactcctttatcaagtggagatttggcgctatctcatgaaggaccaggaacaagcgaagggcaaaccgaagacgtttagactacctcccattgtgcctattgtgctatacaacgggaaacgaagatggacggcaaatcgacagtttcgtcaattacttgctaacgaaaccatgttcggctcagaactgctcaacttcgaatacgtcctcattgacgttgctcgatatacagaggaggaattactagccctcagcaacaccatcgggtctgtcttcctattagaccagactgcggaccaagctgagcttctaaaccggctcgggaagttgatgcacactatccagcagttgcctgaggactcacagcagcaacttgtcgcctggatggcgaacattctgtctcagaagctgcccgagaatgagccccaattacgggagctaattcaaaacgtgaagggtggtgtgtcagtcatgggactggagaagacgttagacgcgatcaagcgtgagggaagacgggaggggcggcgcgagggactacgggaggggctccgtgagggtttgagggagggcattctggagggaaaacaggagggcaagcgcgaggggctcctggaaggcaaacaagaggggaaaagggaagcaaaggaggaggtggtgaagcaaatgattgccgagaacttagaccccgacctaattgctcgtgttactgggtttcctcttgacatcattactcagttacgggagaagtcacactga

SEQ ID NO: 3240 - DNA, 978 bp, Unknown
  Paenibacillus thiaminolyticus (multi)
atggggactgaaaccgaggagcacaacactgtgcaccaccgtcacgacaccagctatcgcttcctcctttcaagcaagaagctgttcgttgaactcctgcgatccttcgtgcaaaaggaatgggtgaagcgcattgacgagaccaatgtacaggagattcctcactcgttcgtgctacaagacttcaagcgcaaggaggctgatctcgtttaccgggtcaaactgaatggacaggatgtagtgttctatctgctcttggagatgcaatccaccgtggacttcctgatgccatatagactgctgctttaccaagtcgagatttggcgatacctgatgaaggaccaggagaagactaaaggcaaacctaaagccttccgtctgccacccattgtgcctatcgtactctacaatggcaagaggcgctggacagcaaaccggcagtttcgacagttgctcgcaaacgagaccatgttcgggtccgaattactgaacttcgaatacgtcctcattgacgtcgcccgctacaccgaggaggagttactcgccttgtccaataccatcggatcagtgttccttctggaccagactgaggaccaaacagagctgcttaaccgtctgggcaagctcatgcacactattcaacagatgcccgaagactcacagcagcagcttgtggcctggatggccaacatcctgagccagaagctaccggagaacgagccccacctcagggagctgatccagaacgaaaagggtggagtttcagtgatgggccttgagaagacacttgacgccatcaagcgggaaggaaggcgggaaggacgtcgtgaggggaaacaagaggggaagcgggaagctaaggaggaggtcgttcaacagatgattgccgagaacttggaccccgagctaatcgcacgtatcactggattctcccttgacatcatagcacaattgcgcgagaagtcaaagtcaaagtag

SEQ ID NO: 3241 - DNA, 978 bp, Unknown
  Paenibacillus thiaminolyticus (multi)
atgggaacggaaacggaggaacacaataccgtacatcatcgccatgacacctcctatcgctttctgcttagcagcaagaagctcttcgtagaactactgcggagtttcgttcagaaggagtgggtcaagaggatcgacgagaccaatgtacaggaaattcctcactcattcgtccttcaagatttcaaacggaaggaagccgacctcgtgtacagggtcaagttgaacggtcaggatgtcgtattctacctcctccttgaaatgcaatctactgtggactttctaatgccctatagacttctgctatatcaagtggagatttggcgctaccttatgaaggaccaggagaaaactaagggaaagcctaaggcgtttcggctgccaccaattgtgcccattgttctatacaatggaaaacggaggtggacagcaaaccgacaattccggcagctccttgccaacgagactatgttcgggagtgaactcctgaacttcgaatacgttctaattgacgtcgcaagatacactgaggaggaactactcgcattgagcaacaccattggcagcgttttccttctcgaccagactgaggaccagaccgagttacttaacagacttggcaaactaatgcacaccatccagcagatgcctgaggacagccagcagcagcttgtggcatggatggcaaacatattgtctcagaaactaccggaaaacgagcctcacctaagggagcttattcagaacgagaagggaggcgtgagcgttatggggctggagaaaacacttgacgctatcaagcgtgaaggtcgtcgtgagggtcgccgcgaaggcaaacaggaggggaagcgtgaagctaaggaggaagtcgttcagcagatgattgctgaaaacctcgaccccgagctaatcgcccgcatcactggcttttcacttgacatcatagctcaactccgtgagaaaagcaaaagcaagtga

SEQ ID NO: 3242 - DNA, 978 bp, Unknown
  Paenibacillus thiaminolyticus (multi)
atggggaccgaaacggaggaacacaacactgtgcaccaccgccatgatacttcgtatcggttcttactttccagcaagaagctcttcgttgaactccttcgttcattcgtgcagaaggagtgggtgaaacgaatcgacgaaactaacgtacaggagatacctcattcgttcgtgctccaagacttcaagcggaaggaggcggatctcgtttatcgtgtcaagctaaacggacaagatgtcgtattctacctattacttgagatgcagagtaccgtggacttcctcatgccctacagactgctcctttatcaagtcgagatatggcggtatcttatgaaggatcaggagaaaactaagggcaaaccgaaggcttttagactgcctcctattgttcccatcgtgctctacaatggaaaacgtaggtggacagcaaatcgccagtttcggcagttattggccaacgaaactatgttcgggagcgagctacttaactttgagtacgttctgattgatgtagctcgatacacggaggaggaattgctcgcgcttagtaacaccattggctccgtgttcttactggaccagactgaggaccagactgagttgctcaaccgtttgggaaagctgatgcacaccatacaacagatgcctgaggactctcagcagcaattggtcgcgtggatggccaacatcctctcacagaaattgccagaaaatgagccccacctgagggagcttattcagaatgagaagggcggtgtttcagtaatgggcctggagaagacactggacgctattaagagggaaggccgtcgtgaagggagacgtgaggggaaacaggagggaaagcgtgaggctaaagaggaggttgtgcaacaaatgatcgctgaaaacctcgatccagagcttattgcacgaatcaccggattcagcctagacatcatagctcagttgagggagaagtcaaaatcgaagtga

SEQ ID NO: 3243 - DNA, 978 bp, Unknown
  Paenibacillus thiaminolyticus (multi)
atgggcacggagacagaggaacacaataccgtgcaccaccggcacgacacctcatacagattcttactcagttccaagaaactgttcgtggaactgttaaggagtttcgttcagaaggagtgggtcaaacgaattgacgagacgaacgtccaggaaattccacacagcttcgtgctacaagacttcaagcgcaaggaggcggacctcgtgtaccgagtgaaactaaacggtcaagatgtcgtgttctatctgctccttgaaatgcaatctacagttgacttcctaatgccatacagacttctattgtaccaagttgagatttggagatacctcatgaaggatcaggagaagactaagggaaagcctaaagccttccgcttgccacctatcgtgcctatcgtactctacaacggaaaacgccgatggacggcaaatcggcagtttcggcagcttctcgccaacgagaccatgttcggctctgaattgctgaacttcgaatatgttctaattgacgtcgcacgatacactgaggaggaattactggccctcagtaacacaatcggatctgtgttcctactagaccagactgaggatcagactgagctgttgaatcgtctcggaaaactgatgcacacaatccagcagatgccggaggactcccaacagcaattggtggcttggatggccaacattctgagccagaagttgcctgagaacgagcctcacttacgagagctgatccagaacgagaagggaggtgtgtccgttatgggtttggaaaaaactcttgatgctatcaagcgagaagggcggcgcgaagggcgtagggaggggaaacaagagggaaaacgtgaagctaaggaggaagtcgtccaacagatgattgcagaaaacctcgatccagagctgattgctcgcataaccggctttagccttgacataattgcacaattgcgagaaaagtccaagagtaagtaa

SEQ ID NO: 3244 - DNA, 978 bp, Unknown
  Paenibacillus thiaminolyticus (multi)
atgggcaccgaaacagaggagcacaacaccgttcatcaccgccacgacacttcctatcgctttctgctgtcgtccaagaaactgttcgtcgaactacttagatcgttcgtccaaaaggaatgggtgaagcgtatcgacgagactaacgtccaggagataccacactcattcgtgctacaagatttcaaacgaaaggaggccgatctcgtgtaccgagtcaagttaaacggccaggatgtcgtgttctacttactgttggaaatgcaatctactgtggatttccttatgccctacagacttctcctataccaagtggagatttggcgataccttatgaaggatcaggaaaaaacaaaaggaaaacctaaggcgttccgacttccaccaattgtgcccattgtgctgtacaacggaaaacggaggtggacagccaatcggcagtttagacaactccttgcaaacgaaacaatgttcggcagtgaactgctgaacttcgagtacgtgctgatcgacgtggcaagatataccgaggaggaactacttgccctcagtaacaccattgggtcagtcttccttctcgaccagactgaggaccagactgagcttctcaacaggctggggaaactcatgcacaccattcagcaaatgccagaggactctcaacagcaactcgtcgcctggatggcaaacatcttgtctcagaaactacctgaaaacgagccccacctgagggagttgatccaaaacgagaagggaggagtgtcagtaatgggtttggagaagactctggatgccattaagcgggaaggacgccgcgaaggtcggcgggagggaaaacaagagggaaagagggaggctaaagaggaagtggtgcagcagatgatcgccgaaaacttagatccggaactcattgctcgcattaccgggttctcgcttgacatcattgcacagctccgggagaagtccaagtctaagtaa

SEQ ID NO: 3245 - DNA, 1020 bp, Unknown
  Paenibacillus thiaminolyticus (multi)
atgggcacggagactgatgaacattgcaccgttcaccacaggcacgacacctcctaccgtttcctcctgtcctccaagaaattgttcgtcgaactcctccggtctttcgtccaaaaggaatgggtggaacggattgatgagactaatgtccaggaaattccacactcattcgtgctacaggacttcagaaggaaagaggccgacctagtgtacagagtgaaacttaacggtcaagatgtcgtgttctacctccttttagagatgcaaagtaaggtggacttccttatgccgtatcgtttgctcctataccaagtggagatttggcgctacctgatgaaggatcaggagaaggccaacggaaagccaaagactttcagattgccacccatagtacctatcgttctctacaatggaaagaggcgttggacggcttcacgccaattccgccaactacttgccaacgagactatgttcggctcggaattactaaacttcgaatatgtgcttattgacgttgctcgctacactgaggaggaacttctcgcgttgagtaacaccatcggttcggttttcctcctggatcagaccgctgaccaggctgaactactcgaccggctcggcaagctaatgcacactatccagcagttacccgaagattctcagcagcagctcgtggcgtggatggccaacatcttgtcgcagaaactacccgagaacgaaccccaactgagagagctgattcagaacgtgaagggcggagtgagcgtcatgggactggagaaaactcttgatgccattaagcgtgagggtcggcgtgaaggtcgtcgagaagggctgagacaggggctccaggaagggattcgtgagggcaagcgtgagggcctactggaggggaaacgcgaggctattgaggaagttgcaaagcaaatgataagcgaaaacttagatcctgaactcattgcaagagttaccgggttctccctggagatcattacacaactgagggagaagtctcattga

SEQ ID NO: 3246 - DNA, 1020 bp, Unknown
  Paenibacillus thiaminolyticus (multi)
atgggaacggaaactgacgagcattgtaccgtccatcaccgtcatgatacaagctatcgcttcctactcagctccaagaaattgttcgttgaacttctccgctctttcgtgcagaaggaatgggtcgagcgcattgacgagacaaacgtccaggagatcccgcactcgttcgttctccaagactttcggcgtaaggaggccgatctagtatatcgagtgaagctgaatggacaagacgtagtgttctacctactacttgaaatgcagtctaaggtggatttcctaatgccctaccgactcttgctttaccaagtggagatatggcgctacctgatgaaggatcaggagaaggcgaacggcaagcctaagactttcagattaccgcctattgtaccgatagtgctctacaatgggaagcggagatggacagcttccaggcagttccgtcaattactcgctaatgagacaatgttcggatctgaattgctgaacttcgaatacgtcctcatcgacgttgcacgctacactgaggaggaattgcttgcactttcaaatacgattggcagtgtgttcttgcttgaccagactgccgaccaggcggaactgttagaccggttgggaaaactgatgcacaccatccagcaattaccggaagactcacagcagcagctagtagcctggatggccaacatacttagtcagaaactacctgagaacgaaccacagctcagggagctgatccaaaacgtgaaaggtggagtgtcagtgatggggctggagaaaactttggatgcgatcaagcgcgaaggaaggcgtgagggaagacgtgagggactaaggcaaggcttacaggagggcatccgtgagggaaaacgtgagggactgcttgaggggaagcgtgaagcaatcgaggaagtcgcaaagcagatgataagtgaaaatcttgatcccgaactaattgccagggtgaccggattcagcttggagatcattacccaattgcgggagaagtctcattga

SEQ ID NO: 3247 - DNA, 1020 bp, Unknown
  Paenibacillus thiaminolyticus (multi)
atgggcactgaaaccgatgagcactgtacggtgcaccatcgtcacgacacgagctatcgtttcctcctcagtagcaaaaagttgttcgtagaactgctccgcagcttcgttcagaaggaatgggtggagcggattgacgagactaacgtccaggagattccacactccttcgtgctccaagatttccgacgcaaggaggcggatctcgtttatcgcgttaaacttaatggacaagatgtggtgttctatctcctcttggagatgcaaagcaaagtcgatttcctcatgccttacaggctattactatatcaagtcgaaatctggcgttacttgatgaaggatcaggagaaggccaacggaaaacctaagacttttcgcctgcctcctatagtaccaattgtcctttacaatggaaaacggcgatggactgccagccgtcagttcagacagcttctagccaacgagacaatgttcggttctgaattgcttaacttcgaatatgtgctcattgatgtggctcgctatactgaggaggagcttttagcacttagcaataccattggctccgtcttcctgctcgaccagaccgccgaccaggcagaacttctcgaccgtctcggcaagctgatgcacactattcaacagctccctgaggactcccaacaacagctagttgcttggatggcaaacattctgtctcagaagttaccagaaaacgaaccccaattgcgggagctgattcagaatgtgaaaggaggagtgagtgtcatgggacttgagaagacgctcgatgctatcaagagggaaggacgccgggagggcagaagggaagggttacgccagggcctgcaagagggcatccgtgaaggcaaaagggaaggactactggagggcaaacgtgaagcgatagaggaggttgccaagcaaatgatctctgagaacttagacccggaacttattgcacgggtcaccggcttctctctggagatcatcacacagctccgtgagaagtcccactga

SEQ ID NO: 3248 - DNA, 1020 bp, Unknown
  Paenibacillus thiaminolyticus (multi)
atgggcacagaaactgatgagcattgcaccgttcaccatcgccatgacaccagctacagattccttctcagctccaagaagctgttcgtggaattgttacgctccttcgtgcagaaggagtgggtcgaaaggatagacgagacaaacgtccaggagatcccacactctttcgtactacaagactttcgccgtaaagaggccgacctggtgtacagagtcaaacttaatggacaagacgtcgtgttctatctgctactcgaaatgcagtcaaaggtggatttcctcatgccctatcgactcctcttgtaccaagtagagatatggcgctaccttatgaaggatcaggaaaaggcaaacggaaagccaaagacattccgtcttcctccgattgtgcctattgttctctacaacggaaaacgccgttggactgcatctcgacaattcagacagctcttggctaacgagaccatgttcgggtccgaactcctcaactttgagtacgtcctgattgacgttgcaagatacactgaggaggaacttctcgctctttcaaacaccattgggtctgtgttcttgttagaccagaccgcagaccaagccgagttattggaccggctcggcaagttgatgcacaccattcagcaactcccggaagattctcaacagcagttagttgcttggatggcgaatatcctgagccagaagctccccgagaatgagccacagttgcgggaattgatccaaaacgtgaagggaggtgttagcgtgatggggcttgaaaaaactcttgacgctattaagagggagggacggagggaagggaggagggagggcttaagacaaggacttcaagagggcatacgagaagggaaacgcgaggggttattggagggaaagcgtgaggctattgaggaagtcgctaagcagatgatctctgaaaacttagaccctgaacttatcgctagagtcaccggcttcagtcttgagattatcacacagctccgtgagaaatcacattag

SEQ ID NO: 3249 - DNA, 1020 bp, Unknown
  Paenibacillus thiaminolyticus (multi)
atgggcaccgaaacggacgagcactgcacagttcatcaccgtcatgacacttcctaccgtttcctgctttcctccaagaaactcttcgtcgaattactgcggagcttcgtccagaaggaatgggtcgaacgcattgacgagacaaacgtccaggagattccgcacagcttcgtactacaagatttcagacgtaaggaggccgacctcgtttatcgcgtcaagctgaatggtcaagacgtcgtgttctacctcctattagagatgcagtcaaaagtcgatttcctcatgccataccgcctcttactttatcaagttgagatatggcgttacctgatgaaggatcaggaaaaggccaacggaaagcctaaaactttccgtcttccgcccattgtcccaatagtcctttacaatggcaaacggcggtggactgcttcgcgtcagtttcggcaacttctcgccaacgagaccatgttcgggtcggagctgctcaacttcgaatatgtactcattgatgtggcgcgatacacagaggaggaactccttgctctttctaataccattggtagcgtcttcctcttggaccagaccgcagaccaagctgagttgcttgatcgtttggggaaattgatgcacacgatacaacaactacctgaggatagtcagcaacagctcgtggcgtggatggcaaacatacttagtcagaaacttcctgaaaatgagccacagttgcgtgagcttatccagaacgtaaagggaggtgtgtctgttatgggccttgagaaaactcttgatgccatcaagcgcgaggggcggcgcgaaggtcgtagggagggtttgcgacaagggctccaggaggggatacgtgaagggaaaagggaaggacttctggaaggcaaacgcgaagctattgaggaggtggccaaacagatgatctcggaaaacttggacccggaacttattgctcgtgttacggggttcagccttgagatcattactcaactacgggagaagtcgcactag

SEQ ID NO: 3250 - DNA, 1044 bp, Unknown
  Paenibacillus thiaminolyticus (multi)
atggggacagagacagatgaacaccacacggtgcatcaccgccacgataccagttatcggttcctgttatcgtccaagaagctgttcgtggaattgcttaggtcgttcgttcaaaaggaatgggttgaacggatagacgagacgaatgtacaggagatcccgcactccttcgtccttcaagatttcaagaggaaggaggctgacctcgtttaccgcgttaaggttaatggccaagatgtcgtgttctatctgctacttgagatgcagagtaaagttgactttctaatgccctaccgcctattgctctaccaagtcgagatatggcgctatcttatgaaggaccaggagaaggcgaagggcaagcctaagacttttcgcctgccacccattgtccccattgtcctctacaatggaaagcgcagatggactgcctcaagacagttccggcaattgcttgctaatgagactatgttcggatctgagctgctaaactttgagtatgtcctcattgacgtggcaagatacaccgaggaggaacttctcgctctcagcaacaccatcggctctgtctttctgctagaccaaacggcagaccaggctgagttgctggaccggctcggcaagttaatgcacacgattcaacagcttcccgaagactcacagcagcaactaattgcatggatggccaacattcttagtcagaaactacctgagaacgagccgcagcttcgtgagttgatacagaatgttaaaggaggcgtgtcggtcatgggacttgagaaaacactagacgcgatcaagcgggagggaaggcgggaaggacggcgggaagggttaagacaagggcttcaagagggcataagggagggcatccgggagggtattcgtgaggggttgctggagggaaaacaagagggcaaaagggaggctaaggaggaggtcgcaaagcaaatgatctccgaaaacctcgaccctgaacttatcgctagagttaccggcttctcactggacataatcgcacagttgcgtgagaagtctaattga

SEQ ID NO: 3251 - DNA, 1044 bp, Unknown
  Paenibacillus thiaminolyticus (multi)
atggggaccgaaaccgacgagcatcataccgtacatcaccgtcacgacacttcctaccgcttcctgctcagcagcaagaaattgttcgtggaattgctccgctccttcgtgcaaaaggaatgggtcgagcgaattgacgagaccaacgtccaggagatccctcactccttcgtcctgcaagactttaagaggaaggaggcagacctcgtttaccgagtcaaggtgaacgggcaagacgtggtattctacctcctgttggaaatgcagtctaaagttgactttctaatgccttacaggctccttctctaccaagtggaaatctggcgctacttgatgaaggaccaggaaaaggcaaaaggcaagcccaagacgttccggttgccaccaattgttcccatcgtactctacaatggcaagaggagatggaccgcctccagacagtttcggcaactcctggcaaacgagacaatgttcgggagcgaattactaaacttcgagtacgtccttatcgacgtcgcaagatacacagaggaggagctgttagctctctcaaacactatcggtagcgtgttcctgttagaccaaaccgccgatcaagctgaattgttagaccgactggggaagctcatgcacaccatccagcagctacccgaagacagccagcaacagctaatcgcttggatggccaacatactgtcgcagaagctgccggaaaacgagccacaacttcgagagcttattcagaacgtgaagggcggagtgtctgtcatgggattggagaagacactcgacgcgattaagagggaaggacggagggagggtcggcgcgaaggtctgagacaggggctacaggagggtatccgggaggggatcagggaggggatacgcgaaggtttactggaagggaaacaggagggcaaaagggaggcgaaagaggaggtggccaaacaaatgatctctgaaaatctcgatccagagcttatcgctagagtgacggggtttagccttgacataatcgctcagttacgcgagaagtcaaactga

SEQ ID NO: 3252 - DNA, 1044 bp, Unknown
  Paenibacillus thiaminolyticus (multi)
atgggcacagagactgatgagcatcacacagtgcatcacaggcacgacacaagctaccggttccttctctcctccaagaagctcttcgtcgagttactccgcagtttcgtgcaaaaggaatgggtcgaacgcattgacgagacaaacgtacaggagattccgcactcattcgttctacaagactttaagcgcaaggaggcagacctcgtatatcgtgtgaaagtgaacgggcaagatgtcgtattctacctcctattggaaatgcagtctaaagtggatttcctgatgccctaccgtttgctgctctatcaagttgagatttggagatacctcatgaaggatcaggagaaggcaaaaggcaagcccaaaacattccgcctcccacccattgtgcccatcgtcctctacaacggaaagaggcgttggacagcatcgaggcaatttcgacagcttttagctaacgagactatgttcggttcagagttgcttaactttgaatatgtgttaattgatgtagcgcgatacactgaggaggaactgttagccctatccaataccatcggctcggtattcttgttagatcagacagcggaccaggccgagctgcttgaccgtctcggcaagctaatgcacacgattcagcaactcccagaggacagccaacaacagttgatcgcgtggatggcgaacatcctttcgcagaaactacctgagaacgagccacaactgcgagagcttatccagaacgtgaaaggaggcgtctcagtgatgggacttgagaaaactcttgacgccattaagcgtgaggggagacgcgagggccgaagggagggactcagacaaggactccaggagggaatacgcgaagggatacgggagggcatcagggaggggcttctggaggggaagcaagaggggaaacgcgaggctaaagaggaggttgcaaagcagatgatctctgagaatcttgacccagaattgatcgcaagagtgactggattcagcttggacatcatcgctcaattacgcgagaagtcaaattga

SEQ ID NO: 3253 - DNA, 1044 bp, Unknown
  Paenibacillus thiaminolyticus (multi)
atgggcacggaaaccgacgagcaccacacagtgcatcacagacatgacaccagctatcgctttctacttagctccaaaaaactcttcgttgaattgctacgctcgttcgtgcagaaggaatgggtggagcgaattgacgagactaatgtccaggagatacctcactcattcgtgctccaagactttaagcgcaaggaagccgacttagtttatcgcgtgaaggtgaacggtcaagacgtggtgttctatctcctcctggagatgcaatctaaagtcgatttccttatgccatacagactcttgctttaccaagtggagatttggcgttacctcatgaaggatcaggaaaaggcgaagggcaaacccaaaacctttagactccctccaatcgttccaatcgttctgtacaatgggaagcgtcgctggaccgcttcacgacagtttcggcaattgcttgctaatgagacaatgttcggcagcgagttactaaacttcgagtatgttctaattgacgttgctcgctacacagaggaggaactgcttgccctgagtaacacaatcggctcagtctttctgctcgatcagaccgcagaccaagcagaactactggaccggctcggcaagctgatgcacacaattcaacaactccccgaggactctcagcaacaactcatcgcctggatggcgaatatcttgtcgcagaagctgcctgaaaacgagccccaactccgggagttgatacagaacgtaaaaggaggagtgtccgtgatgggactggagaagacgcttgatgcgattaagagggagggaaggcgcgagggacgccgtgagggtttaagacagggcctgcaagagggcatacgcgagggcatacgtgaaggaatacgagaaggcttgctagagggaaaacaggagggcaagcgggaggctaaggaggaagtggccaagcaaatgatctccgaaaaccttgaccctgagcttattgctagagtaacggggttctccctcgacataatcgctcaactcagggagaagtcaaattga

SEQ ID NO: 3254 - DNA, 1044 bp, Unknown
  Paenibacillus thiaminolyticus (multi)
atgggaaccgagacggatgaacaccatacggtccaccaccgccacgacacttcctatcgcttcctcctgtcctccaagaagctcttcgttgaacttttacgctcattcgttcaaaaggaatgggttgaaaggatcgacgagacaaatgtccaggagataccgcactccttcgtgttgcaagactttaagcgaaaggaagctgatctagtttaccgtgttaaggtgaatgggcaagatgtcgtattctatctgctgttggagatgcagagcaaagttgacttcctgatgccctatcggctcttactctatcaagtggagatatggcgctacctgatgaaggaccaggagaaggcgaagggcaagcccaagacgtttcgactcccacctattgtcccaattgttctgtacaacgggaaacgtaggtggaccgcttctcgacaatttcgtcagttattggctaacgagacaatgttcggctcagagctactgaatttcgagtatgtgcttatcgacgttgcacgctataccgaggaggagttactcgctttgagcaacaccataggctccgtattcttgctagatcagacggcagaccaagccgagctgctagacagactcggaaagctgatgcacaccatacaacaactgcccgaagactcccaacaacagcttatcgcttggatggccaacattctctctcagaaattacctgagaacgagcctcagttgcgcgaacttatccagaacgtgaaaggcggagtgtcagtgatgggactggagaagacactcgacgccattaagcgcgaggggaggcgtgagggaagacgtgagggtttacgtcaaggtttacaggagggaatcagggaaggaatcagggaggggatcagggaaggcttgttagagggaaaacaggaaggcaagagggaagctaaggaggaagtggcaaagcaaatgatctccgagaatctggaccccgagttaattgcgcgtgtgaccggattctctctggacataatcgcacagttgcgtgagaagtcgaattga

SEQ ID NO: 3255 - DNA, 1056 bp, Paenibacillus terrae
atggggaccgaaacagacgaacatcacactgtgcatcatcgccatgacacatcctaccgattcttgctctcatccaagaagctcttcgttgagctgcttcggtcattcgttcagaaggagtgggttgagcggatagacgagaccaatgtccaggagatcccacactcgttcgtgttacaagactttaaacgcaaggaagcggatctagtttaccgcgtgaaattgaacggtcaagacgtcgtattctacttactcttagagatgcagtcgaaggtggactttctcatgccataccgactattgctctaccaagtggagatttggcgctacctcatgaaggaccaggagaaggcaaagggaaagcccaagactttccggttaccaccaattgtaccgattgtcctgtacaatggaaagcgtcgctggacagcttccagacaatttcgtcagctactcgctaacgagacgatgttcgggagcgaactgttgaacttcgaatatgttcttattgacgtggcgcgttacaccgaggaggagttactcgctcttagtaacaccatcggttcagtattcctactcgaccagactgccgatcaagccgagttactggacagactcggaaaactgatgcacacaattcagcagcttccagaggactcccagcagcagctagtggcctggatggcgaacatcctttcgcagaaactcccggagaacgagcctcagttgcacgagctaattcaaaacgtgaagggcggtgtgtccgttatggggttggagaaaactttagatgctattaagcgtgagggaaggcgtgaggggagaagggaaggtttgaggcaagggttacaggaggggatacgtgagggtatcagggagggcatacgtgagggcaaacgtgagggcctgcttgagggaaaacaggaggggaaaagggaggcaaaggaggaggtggctaagcagatgatctcagaaaacttagacccagagcttatcgccagggtcacggggttcagccttgacatcatcgcacagcttcgtgagaagtctaagtga

SEQ ID NO: 3256 - DNA, 1056 bp, Paenibacillus terrae
atgggcacagagaccgatgagcaccatacggtccaccacagacacgacacttcctaccgcttccttctatcgtccaagaaactgttcgtcgaattgctccggtccttcgtccaaaaggaatgggtcgagcgaattgacgagacgaacgtccaggaaataccgcacagtttcgtccttcaagactttaaaaggaaggaggcagacttggtgtaccgtgtcaagctgaatggacaagacgtggtattctacctgttgctggagatgcagtcaaaagtggatttcctcatgccctatcgcttactcctctaccaagtggagatatggcggtatcttatgaaggaccaggaaaaggcaaagggaaagcctaaaacgttccgtcttccaccgattgtaccgattgtgctatacaacgggaaaaggcgttggacagcttctcgacaattcagacaacttctggcgaatgagacaatgttcggtagtgagttgcttaactttgagtacgttcttattgatgttgcccgttacaccgaggaggaattgctcgccctatccaataccatcggttctgtctttctactagaccagaccgccgatcaggctgaactcttggaccgcctcggcaagctgatgcacactattcaacagttgccggaagattcacaacaacagcttgtggcctggatggccaacatcctctcccagaaactccccgagaacgagcctcagttgcacgaactaattcagaatgtaaaaggtggggtttccgtgatgggccttgagaaaaccctcgatgctattaagcgcgagggccgccgcgagggccgaagggagggtttacgtcagggcctccaggagggaatacgggagggcatacgggaggggatacgcgaggggaagcgagaagggctgttggaaggcaaacaggagggaaagcgggaagctaaggaggaagtggcaaaacagatgatctccgaaaacctggaccccgagctaattgcccgcgttaccgggttctcactcgacattatcgcccagcttcgtgagaagtcgaagtag

SEQ ID NO: 3257 - DNA, 1056 bp, Paenibacillus terrae
atgggcaccgaaacagacgagcatcacacagttcaccaccgtcacgacacttcctacagattcttgctcagttccaagaaactattcgtcgaattacttcggagcttcgtccaaaaggaatgggttgagcgaattgacgagactaacgtccaggagattcctcactcattcgtactccaagacttcaaaaggaaagaggcggatctagtttatcgcgtaaaactcaacggacaggacgtcgtgttctacttgctcttggaaatgcaaagtaaggtggacttccttatgccgtatcgcctgctgctttatcaagtggagatttggcgctaccttatgaaggatcaggagaaggccaaagggaagcccaagacattccggttgcctccaattgtacctatagtgctttacaacggcaaacgtaggtggacagcctcaagacaattccgtcagctcttggcaaatgagactatgttcggatctgaattgcttaacttcgaatatgtgctaattgacgtggcgagatatacggaggaggagttgcttgctttaagtaacaccatagggagtgtgttcttgctcgaccagacagccgaccaagcagaattacttgatcgtctcgggaagttgatgcacactattcagcagttgccagaggacagccagcaacaacttgtcgcatggatggcgaacatattgtcacagaaactcccggagaacgagcctcaactacacgaactaatccagaatgtcaagggcggagtgagcgtgatgggtcttgagaaaacattagacgcgatcaagagggaaggtcgccgcgaaggaagacgtgaagggctaaggcaaggactccaggaggggatacgcgagggcatacgtgaagggataagggaggggaaaagggagggactccttgagggaaaacaggagggaaaacgtgaagcgaaggaggaagtcgcaaaacagatgataagcgagaacctcgacccagaactcatcgctcgtgtgacgggtttcagtcttgacataattgcccaactaagggaaaagtccaaatga

SEQ ID NO: 3258 - DNA, 1056 bp, Paenibacillus terrae
atggggacagagacagatgagcatcataccgtgcaccaccgccacgatacttcgtatcgtttccttctcagctccaaaaaactcttcgtggaactgctcagatcattcgttcaaaaggagtgggttgagcggattgacgagacgaatgtccaggagatcccacactccttcgtgttgcaagactttaaacgcaaggaagccgacctcgtgtaccgggtgaagttgaatgggcaagacgtcgtgttctacctgctactggaaatgcagtctaaagtggacttcctaatgccctaccggcttctcctctaccaagtagagatttggcgctacctcatgaaggaccaggaaaaggccaaagggaagccaaagaccttcagactaccacctatcgttcctattgtgctatacaatggaaagcgtaggtggaccgcaagcagacagtttcgtcagctattggctaatgagacaatgttcggctcagagctgttgaactttgagtacgtcctaatcgacgttgcacgttacacggaggaggaacttctggccttgtcaaacactatcggttcagtgttcctgttggaccagacagcagaccaggctgagttgctagaccgcttgggaaagctgatgcacaccatacagcagttgcccgaggactcacaacagcagcttgtcgcatggatggccaacatcctgtctcagaaattaccagaaaacgagcctcaattgcatgaactaattcagaatgtgaagggtggcgtttccgttatgggactggagaagacgctcgacgccatcaagcgcgaggggcgacgcgagggcagaagggaagggcttcgtcagggcctacaggagggcattcgggagggaatccgtgaagggatcagggaggggaagcgcgaggggttgcttgaaggaaagcaagagggcaagagggaagcaaaggaggaagttgctaagcagatgatctccgaaaatctggaccccgagctaatagcacgggttaccgggttctccctcgacatcatagctcagctaagggagaagtcaaagtag

SEQ ID NO: 3259 - DNA, 1056 bp, Paenibacillus terrae
atggggacagagacggatgagcatcatacggtccaccacagacatgacacatcataccggttcttgctatccagcaagaagctgttcgttgaacttctccgctccttcgtacagaaggagtgggtcgaaaggatcgacgagacgaacgtacaggaaattcctcactctttcgtcctccaagactttaaacgtaaggaggcggatctggtgtaccgtgttaaactcaatggtcaggatgtagtattctacctgctcttagagatgcagtcaaaggtggactttctcatgccttaccgtctcctactctaccaagtggagatatggcgctacctgatgaaggaccaggagaaggccaaaggcaaacctaaaactttccgccttcctcccatcgtacccatcgtcttgtacaatggaaagaggcggtggaccgcatcaagacagtttcgccagcttctagcgaatgagacaatgttcggatcagagcttctaaacttcgagtacgtccttattgatgtagcgagatacacggaggaggaattgttagccttgtcaaacactatcggtagcgtcttcctactcgaccaaaccgcagaccaggctgagttactggaccgtcttggcaagctgatgcacacaattcagcagctacccgaggactctcagcagcaactcgtcgcctggatggccaacatactgagtcagaaacttcctgagaacgagcctcagctccacgaattgatccagaacgtgaaaggtggagtttccgttatggggttggagaaaactttggacgctatcaagcgggagggaaggagggaaggacgacgagaaggtttgagacaggggctacaggaagggatcagggagggcatccgggagggcatccgcgaaggcaagcgggaggggttattggaaggaaaacaggagggcaaaagggaggcgaaggaggaagtggcaaagcagatgataagtgaaaatcttgaccccgagttaatcgcccgtgtgacaggcttctcactggacataattgcacagctcagggagaagtcaaagtga

SEQ ID NO: 3260 - DNA, 942 bp, Unknown
  Paenibacillus thiaminolyticus (multi)
atggggaaagagtccgatgaacacaacactattcactaccggcacgacaccagttaccgtttcctactgtcgtccaaaaaactcttcgtggagcttctgaggtcattcgtgcaaaaggaatgggttgaacggatcgacgagacgaatgtccaggagataccgcactccttcgtgttgcaagacttcaagcgtaaagaggccgacttagtgtaccgcgtgaagctcaatggccaagacgtagtgttctatctacttctggagatgcaatcgaaagttgactttctgatgccttaccgcctcctgctttaccaagtggagatttggcgctacctcatgaaggatcaggagactgtgaaaggaaagcctaaaaccttccggcttccaccaatagtgccgattgtgctctacaatggaaagcggagatggactgcatcgcgccagttccggcagttgctggccaacgaaacgatgttcgggtctgaactgctgaatttcgagtacgtgctgattgacgtcgcaagatacaccgaggaggaattgctggccctgagcaacaccattgggtccgtcttcctgctagaccaaacagccgaccagacggaactactcaatcgtctcggaaaactgatgcacaccatccagcagcttcccgaagacagccaacaacagttagtggcgtggatggcaaacattctctctcagaaactccccgaaaacgagccacaattgcgagagctgattcagaacgtgaagggcggggtttccgttatgggtttggagaagactttagacgcgatcaagagggagggacgtagggaggggaagcgagaagctaaggaggaggttgtcaaacagatgttggccgaggacttggaacccgagcttattgcaagagttaccggttttagtttagagatgattacgcaacttcgggagcagtaa

SEQ ID NO: 3261 - DNA, 942 bp, Unknown
  Paenibacillus thiaminolyticus (multi)
atgggaaaggaatcagacgagcacaacacgatccactaccgccatgacacttcctaccgattcctactctcctccaaaaaactcttcgttgaactattgcggtctttcgtccaaaaggaatgggtcgagcggatagacgagaccaacgtccaggagatcccacacagcttcgtgcttcaagacttcaaacgcaaggaggccgacctcgtttaccgagttaagctcaacggtcaagacgtcgtattctatctgctcctggaaatgcaatctaaggtggacttcctgatgccatacaggctcctactctatcaagtggagatttggcgttaccttatgaaggaccaggagacagtgaaggggaaacctaaaaccttcagactccctcccatagtgcctattgtgctctacaatggcaaaaggagatggaccgccagccgacagtttcgtcaactcctagctaacgagacgatgttcggttctgagctgctaaacttcgaatatgtgcttattgacgttgcaagatacacagaggaggaattgctcgcactctcgaacaccattggctccgttttccttctggaccagacggcagatcagacggaactcctgaaccgcctcgggaaactcatgcacacgatccaacagctcccagaggatagccagcagcaactcgtggcttggatggcgaacatactctctcagaaattaccagaaaacgagccacagttgcgtgagctgatccaaaacgtgaaaggaggggtgtcagtgatggggttggagaagactctcgatgctattaagcgcgagggaaggcgggaaggcaaacgtgaagctaaggaggaggtggtgaagcaaatgttggctgaggatcttgagcctgagttaatcgcccgcgtgaccggcttcagtttggaaatgattacacaactcagagagcaataa

SEQ ID NO: 3262 - DNA, 942 bp, Unknown
  Paenibacillus thiaminolyticus (multi)
atggggaaggaaagcgacgagcacaacaccatacactaccgccacgatacctcctatcggttccttctcagctccaagaaactattcgtcgaattgcttcgcagtttcgtccagaaggagtgggtggagcgcattgacgagacgaatgtccaggaaattccacactctttcgtgctccaggactttaaaaggaaggaggctgacttggtgtaccgagtaaagctgaacggtcaggacgtggtattctatctcctcttggagatgcagagtaaagtggacttcctgatgccttatcggttactcctctatcaagtggagatatggcgctacctgatgaaggatcaggaaactgtcaaagggaagccgaaaacttttcgtcttcctccaattgtgccaatcgtgctctacaatggcaagcgccgttggacagcatctcgccagtttcgccaattactcgcaaatgagaccatgttcggaagcgagctgctcaacttcgagtacgtgcttattgacgtggcccgatacactgaggaggaacttctagcactttcaaacacaatcggaagcgtgttcttgcttgaccagactgcggaccagactgagcttctaaaccggctcggcaaactgatgcacacaattcagcaacttccggaggacagccagcagcagcttgtggcctggatggccaacattcttagtcagaaacttcctgaaaacgagcctcaactccgcgaactgatacaaaacgtcaaaggtggtgtgtcagtcatgggactggagaaaactctcgatgctatcaagcgcgaagggagacgcgagggcaagcgggaagctaaggaggaggtggttaagcaaatgcttgcagaggatcttgagcccgagctgatcgcacgagtgactggcttttcacttgagatgataactcagctacgcgagcaataa

SEQ ID NO: 3263 - DNA, 942 bp, Unknown
  Paenibacillus thiaminolyticus (multi)
atggggaaggaatctgacgagcacaacacaatccactacagacacgacacgagttatcgcttccttctctcctccaagaagctattcgtggaactactgcgctccttcgttcagaaggagtgggtggaacgtatcgacgagacgaacgtccaggagataccgcattccttcgtgctccaagactttaagcgaaaggaggccgacctagtgtaccgcgtcaaacttaacggtcaagatgtcgtattctaccttctccttgaaatgcaaagcaaggtcgatttccttatgccttacagactactactctaccaagtcgagatttggcgctacctgatgaaggatcaggagacagtcaagggcaagcctaagacttttcgcctcccaccgattgttccaatcgtactttacaatgggaagcgacgttggactgcctctcggcagtttcgccagttgcttgcaaacgagaccatgttcggtagcgaactgctgaacttcgaatacgtgctaatcgacgtggctcgctacacggaggaggaactgctggctttgagtaataccatcggaagtgtgttcttattggaccagactgccgatcagacagaactcttgaacagactcggcaagttgatgcacacgattcaacagttaccggaagactcacagcaacaattggtcgcgtggatggcgaacatcctaagtcagaagttgcccgagaatgagccacagctcagggaacttattcaaaatgttaaaggaggagtatctgtaatgggtcttgagaagactctggatgctattaagagggaaggacgtagggaagggaagcgggaagcaaaggaggaagttgttaaacagatgctggccgaagaccttgaacctgagttaatcgctcgggtcaccgggttttcccttgagatgattactcagctccgcgagcagtaa

SEQ ID NO: 3264 - DNA, 942 bp, Unknown
  Paenibacillus thiaminolyticus (multi)
atggggaaggagtcggacgaacacaacacgatccactaccgtcacgacaccagttaccgattcttattgtcctccaaaaaactcttcgtggagctactcagatcattcgtccagaaggagtgggtcgagcgcattgacgagaccaacgtccaggaaattccacattcgttcgtgttacaagacttcaaacgtaaagaggcggatctcgtctatagagtgaaacttaatggtcaggatgtcgtgttctatctcctattggaaatgcagtcaaaggtggacttccttatgccttatcgacttctgctctaccaagtggagatatggagataccttatgaaggatcaggaaacagtgaagggcaagcctaaaacgttccgcctgccaccaattgtgccaatagtgctgtacaatgggaagcggcgatggaccgcatctcggcagtttcgacaattactcgcaaatgagaccatgttcgggtcagaattgctgaacttcgagtatgtcctaattgatgtggcacgatatactgaggaggagctgcttgctttgagcaacactatcggtagcgtctttctactggaccagactgccgaccagacggagctattgaaccggcttggaaagttgatgcacaccatccaacaattaccagaggactcacagcaacagttggtggcctggatggcgaacatactctcacaaaagctcccagaaaacgagccccaactgagggagcttatccagaatgtcaagggtggtgtgtccgtgatgggacttgagaagacattagatgctattaagcgtgaggggagaagggagggcaagagggaggcaaaggaggaagttgtgaaacagatgctcgctgaggatctggagccggagctgattgcccgtgtaactggcttcagtttggaaatgataacacagttacgagagcagtga

SEQ ID NO: 3265 - DNA, 1299 bp, Unknown
  Paenibacillus thiaminolyticus (multi)
atgaagcacaaacttaagcagaagcaaaatcagcggatcacacgcatcaccgattccaccctcgtggttggagcggatatagccaagaagattcacgtcgcccgtgccgtggacttcagaggaattgaactggggaaggactgcgttttccccaacgaccaacaaggtttgaccaagctgactacttggatgaaggagctgggtcaagcccattctaagaccgatatagtgttcggtatcgagcctaccggccattactggttccctctcgcagcttacttacacgctcagggcattcagatcgtcgtcgtaaacccacaccatgtcaacaaaagtaaggaacttgaagacaactctcaaactaaatcggactacaaggatgctaaagtcattgctgacctcatccggaacggcaagtattccgaaccgaagctcccaactaaggaatacgcggacctgaggatactcatgaacctgcgggaaaaggtgtctgcgtctttaacccaagttaaaggacgtattggtcactggttcgaccgcttttttcctgagtattcgaccgtgtgcaaagactgggatggaaagacctcacttatgacaatgcgttccttcccactgccatcagatattgtcagtaaaagcgctagggaagtgttggctcattggaaaaccgaggttaagcgtggcgttgggattaagagggctgagaagctcgtagccgcagccgcagcttcaatcggcctgacagagggaagtgccgctgcgcggatcgaactgtccacactacttgggcagtttgagcttttccgcgaacaattggaagggatcatgaaggaagtgactcaaattctcgaaaacatacctggtgcagaacacatgctgtccgtccccggcgtggggacagtcaccgtcgctgggttcctcgcagaagtgggcgatctgtcgaattacgatcacgggcaacagatcatacgcctcgctggactaaaccttaaggagaacagttctggaaagaggaagggaaagaccggtatctccaagaggggacgatctaggctgagggccctgctattcagagctgttatgcctatggtcgccaagaacgaagcgttcaagactttgcacaagcactatacgaaccgtagccaaaacccactcaaaaagaagcagtcactcattgcattatgcggaaagctcatacgagtcttacatactttgggcactaagcagagggcgtacaacgctgatgagatgcttgggccagtccgtcagtctcagatgcagcttgaggcagcatag

SEQ ID NO: 3266 - DNA, 1299 bp, Unknown
  Paenibacillus thiaminolyticus (multi)
atgaagcacaaactcaagcagaagcaaaatcagcgcattactcgcatcacagattcgacgcttgtggtgggtgcagacatcgccaagaaaatccatgtcgcaagagcagtggacttccggggaatcgaattgggcaaagactgtgtgtttcccaacgaccaacaaggtttaacgaaactcactacttggatgaaggagctgggccaggctcacagtaagacagatatagtctttggaatcgagcctactggtcactactggttccctcttgcagcgtacctccatgcccagggcatacaaatagtagtagtgaacccacaccacgtcaataagagcaaggagcttgaggataactctcaaactaaatcggattacaaagatgcgaaagttattgctgacctgatccgtaatgggaagtacagcgagccgaaactacctaccaaagagtacgccgacctacggattctcatgaacctccgcgagaaggtttccgcctcattgacccaagttaaagggcgtattgggcactggttcgaccgcttttttcctgagtacagtacagtatgcaaagactgggatggcaagacatctctgatgaccatgagatcattccctttgccatctgacattgtgagcaagagcgcccgcgaagtcctagctcattggaaaaccgaagtgaagcggggagttgggatcaagcgcgccgagaaactggtggctgccgcagcggcatctattggacttaccgaagggagtgcagccgcacgcattgagctttcaacattgcttgggcaatttgaactcttcagagagcaacttgagggtatcatgaaggaggtcacgcagatcctggaaaacatacccggagctgaacacatgctctcggttcccggcgttggaacagttacagttgctggattcctcgcagaggttggagacttaagtaattacgatcacggtcagcagataatccgtctcgcggggttgaaccttaaggaaaactcatcaggcaaacgaaagggcaagaccggaatctccaaacgtggacgatcacgtcttcgagcgctcttattcagagctgtaatgcctatggtggctaagaacgaagccttcaaaactttgcacaaacactacacaaacagaagtcagaatccgctcaagaagaaacagtcacttatcgcactttgcgggaaattgatccgagtccttcatacgctcgggacaaagcaacgtgcctacaatgcagatgagatgttggggcctgtcaggcaaagtcagatgcagctagaggctgcgtaa

SEQ ID NO: 3267 - DNA, 1299 bp, Unknown
  Paenibacillus thiaminolyticus (multi)
atgaagcacaaactcaagcagaagcagaaccagcgcattacccggatcactgactccacgctagtggttggtgccgatattgccaaaaagatccacgtcgcacgcgccgtcgatttcagagggatcgaactcggaaaggactgcgtgtttccaaacgaccaacaggggttgacaaagctcaccacttggatgaaggaacttggtcaagctcatagcaagaccgatattgtctttggaattgaaccgacgggtcattactggttccctctcgcagcctatcttcatgcacaagggatacagatagtcgtagtcaatcctcaccacgtcaataagtctaaggagctggaggataactcacagactaagagcgactacaaggacgcgaaagttattgcagacttgatccgaaacgggaagtacagcgagcctaaactacccaccaaagagtatgcagaccttcgcatacttatgaacttgcgcgaaaaggtttcagcatcccttacacaagtaaaaggccgaataggtcactggttcgaccggttcttcccagagtacagtacggtctgcaaagactgggacggaaagacatcgctgatgactatgcggtcctttcctctaccctctgacattgtgagtaaaagcgctcgtgaagttctggcacactggaagacagaggttaagcggggagttgggatcaagcgggctgaaaagctcgttgcagccgccgctgctagtattgggctgacggaggggtccgctgccgcccgaatcgagttgagtaccctgctcggacaatttgaattgttccgcgaacaacttgaagggattatgaaggaggtcacacaaatcctcgaaaacatacccggcgcagagcacatgctaagcgtacctggcgttgggactgttacggttgccggattcctggcagaagttggggacttgtcaaattacgaccacgggcagcagataatccgtttggctggattgaacttgaaggagaactcctctgggaagcgtaaaggaaagactggcatcagcaagcgaggaaggagcagactccgagccttacttttccgagccgtgatgccaatggtagctaagaacgaggcgtttaaaactttgcacaagcactataccaaccgctcgcaaaatcctctcaagaagaaacagtcgctcatagcactctgcggcaaactgataagggtgttgcatactcttggtactaagcaacgcgcctacaacgctgacgagatgcttgggcccgttagacaaagccaaatgcaactggaagcagcttag

SEQ ID NO: 3268 - DNA, 1299 bp, Unknown
  Paenibacillus thiaminolyticus (multi)
atgaagcacaagctaaagcagaagcagaaccagcgtattacccgcattactgacagcaccctcgttgtcggagcagatattgccaaaaagatccatgtcgcgcgagcagtggatttccgtgggatcgagcttgggaaagactgcgttttcccaaatgaccaacaaggacttaccaaattgaccacttggatgaaggaattgggccaggcccacagtaaaacagacatcgttttcgggattgaacctacaggacactactggttcccactagcagcgtaccttcatgctcagggcattcagattgtcgttgtgaatccacaccacgtaaacaagagtaaggaactggaagacaacagtcaaactaagtccgactacaaggacgctaaagtgattgccgatctgataaggaacgggaagtacagtgagcctaagctcccgacaaaggaatacgccgacctccgcattcttatgaacctcagggagaaggtgtcagcctcacttacccaagttaaggggcggatcggacactggttcgaccgctttttcccagagtacagcaccgtgtgcaaagattgggacgggaaaacgagcttgatgacgatgcgtagtttccctttgccttctgacattgttagtaaaagtgctagggaagttctcgcccactggaagacagaggtgaaacggggtgttgggattaagagggccgaaaagttagtagctgctgcggctgcttctatcggcttaacagagggatcagccgccgcccggatagagctatctactctactgggacaatttgagctattccgggagcagcttgaagggatcatgaaggaggttacccaaattcttgagaacatccctggagcagaacacatgctcagtgtgcctggggtggggactgtcacggttgccggattcttggcggaagtcggcgacttaagcaactacgaccacgggcagcagatcatacggctcgccggactgaaccttaaggaaaactcatcaggaaagcggaaggggaaaacaggaatttccaagcgtgggaggtccaggctaagagcactccttttccgagcagtgatgcctatggtagctaagaacgaggctttcaaaacattacacaaacactacaccaaccgcagccagaacccactcaagaagaagcaatcgctgatcgccctgtgcggaaaactgattcgtgtactccatactcttggaacaaaacagagggcgtacaacgcagacgagatgcttggacccgttcgccagagccaaatgcaactcgaagcagcctaa

SEQ ID NO: 3269 - DNA, 1299 bp, Unknown
  Paenibacillus thiaminolyticus (multi)
atgaagcacaaattgaagcagaagcagaatcagcgcattactagaattacggattcaactctggtggttggagcggacatcgccaagaagatccatgtcgccagagcggtggactttcgcggcatcgaattggggaaagattgcgtgttcccgaacgaccaacagggcttgactaaactcacgacctggatgaaggaattgggccaggctcactctaaaacagacatcgttttcggtattgaacctactggtcactactggttcccactcgcagcttacctgcacgcacagggtatccagattgtcgtagtgaatcctcatcacgtaaacaagtctaaggagcttgaagacaactcccaaactaagagcgactacaaagatgcaaaagtgatcgcagacctcatacggaacggcaagtacagcgagcccaaacttcctactaaggagtatgctgatctccggatactgatgaacttgagggaaaaggtcagtgcttcccttacacaagtcaaggggcgaataggtcactggttcgaccgcttttttccagagtacagtacagtatgcaaagactgggatggcaagacctcccttatgactatgcgctctttccctcttccatccgatatagtgtccaaatcggctcgggaagttctagcacattggaagacggaggtcaaacgcggtgttgggatcaagcgcgctgagaaactcgtcgctgctgccgccgcgagcattggtcttacggaaggatcggcggcggctagaatcgagttgtcaacgttgctcggccagtttgaactattccgagagcagctcgaagggattatgaaggaggtgactcagatattggaaaacattccaggagcggaacacatgctgtctgttcctggcgtcggcaccgttactgttgccggtttccttgcagaggttggcgaccttagcaattacgaccacggacaacagatcatacggttggcgggactgaacctaaaggagaactcatccggaaaacgaaagggcaaaactggtatctccaagcgaggcagatccaggctcagggcactactgtttcgcgcagtcatgccaatggtggccaagaatgaggcgtttaaaactcttcacaagcactacacaaacaggagtcaaaaccctctcaagaagaagcagtccttaatcgccctgtgcggcaaactcattagagtgttgcatactctcgggaccaaacagcgggcctacaacgctgacgagatgttgggtccggtgcgacagagccaaatgcaactagaggctgcttga

SEQ ID NO: 3270 - DNA, 1437 bp, Unknown
  Bacillus sp. multi
atgataatcacccgcaagattaagctaatcatcgtgggtgaggaacgcgacaaccagtacaagttcatccgcgaggagcgctacaagcagaacaaggccctcaacgtcgctatcaaccacctttacttcctccacgtcgctaaggaaaaaatccgcctcctcgaccacaagttcgtccaggacgagcagaagctccaggagacgattgacaagctatacgacgagaagcgaaagcagaaggacgagaagaaaaaagacacaatcgagcaaaaaatcgagaagaaacggaacaagttgaaggagctgcgttcaaagggaaacaaagaggctgcaaagaccctccaggacgcgattaagattaacttcaccaccactacgagggagatcattaacaagcagttcgaccttatgtccgacaccaaagaccgcataacacagaaggtgacccaggacttctccatcgacctcaagaacggcttgttatctggcgagcgttccttgcgaacgtacaagaagaataacccgttgttcatccgtgggcgcactctttacttctaccaggagggaaagtcgattcttattaagtggtgcaagggaatcgtgttcaagtgcatcctcggacgtcaccagaacaatagtcatgagttgtggactatcctcaagaaggtcttggagcagtcatacaaagtgtgcgacagcagtatctctgtcggcaaggacttcatcctcaatcttagcctggacattggggagagcgacaatcgtactgcattcgtggaggggagggtgcttggagtggacttgggcatgaaggtgcctgcctatatgtcgataaacgacaagccctacattcgaaaagcgcttggtagtcttgaagacttccttaagataagggtccagatgcagaagcgacgcaagaacctccacaagacccttgtctctgtgaagggagggaaggggagggagcgcaaagtgaaggccctcgaccgtttcaaggaaaaggagcagaacttcgctactacctacaaccacttcctgtcgcacaatatcgtcaaattcgccaagaagcacaggagcggtcagattaacatggagttccttgcgcttgcgggtgaagataaggacaagatactccggaactggtcttactaccagctccaggagttcattgagtacaaggccaatcaggaggggattaaggtgaagtacgtggacccctatcgaacgagccagacgtgcagcaagtgcggttcctacgagcctggtcagcgagaatcacaggaaaagttcatctgcaaggtgtgcaagctggagatcaacgctgactacaatgcaagtcagaacatcgctcattccaccaagtacatgaccaacaagcagcagtcggaatattttaagcgtctccagcagaccacaaagttggagaaatactcatga

SEQ ID NO: 3271 - DNA, 1437 bp, Unknown
  Bacillus sp. multi
atgattatcactcgcaagatcaagctcatcatagtgggtgaggaacgggacaaccagtacaaattcatccgcgaggaacgttacaagcaaaacaaggctctgaacgtggcgatcaaccacctgtacttcctccatgtcgctaaggaaaaaatccgactcctcgatcacaagttcgtccaggatgaacagaagctccaggagacaattgacaagctctacgacgagaagcgcaagcagaaggacgagaagaagaaggatacgattgagcaaaaaatcgagaagaagcgcaacaagctcaaagagttacgttccaaaggcaacaaggaggccgcgaagactctgcaagacgcgatcaagataaactttactacaacgaccagagagatcatcaacaagcagttcgacctgatgtcagatacgaaggatcggattactcagaaggttactcaagacttttcaattgacctcaagaatggcctgttaagtggcgagcgctcacttcggacctacaaaaaaaacaatccattgttcatcagagggaggacgctctacttctaccaggaggggaagtccatactcatcaagtggtgcaagggcattgtcttcaagtgcatcctgggaaggcaccagaacaactcacatgagctgtggactatcctcaagaaggtgcttgagcagtcttacaaggtctgtgactcaagtatatcggtagggaaggacttcatattgaatttgagcctggacattggagagtccgacaaccggacagcattcgtggaggggcgggttctcggcgtggacctgggcatgaaggtgccagcctatatgagcatcaatgacaagccctatatcaggaaagcgctcggttccctggaagacttccttaagattcgcgtccagatgcagaagcgccgcaagaacctgcacaagacgctagtatccgtgaagggcggaaaaggccgagagcgaaaggtgaaggccctcgaccgattcaaggagaaggagcagaacttcgcaactacctacaaccactttctatcacacaacatcgtgaagttcgccaagaagcaccggagcggtcagatcaacatggaattcctcgctctggctggggaagataaggacaagatactccgtaattggtcctactatcaactgcaagagttcatcgagtacaaggcaaaccaggaggggatcaaggtgaaatacgtggacccgtaccggactagccagacctgttcaaagtgcggaagctatgagcctggccagcgggaaagtcaggagaaattcatctgcaaggtgtgcaagttagagatcaacgctgactacaacgcttcgcagaatatcgctcactccaccaagtacatgaccaataagcagcagtccgagtatttcaagaggctccagcagaccactaagttggagaagtattcctga

SEQ ID NO: 3272 - DNA, 1437 bp, Unknown
  Bacillus sp. multi
atgattatcaccaggaagatcaagctcatcatcgttggcgaggaaagggacaatcagtacaaattcatcagggaggaacggtacaagcagaacaaggcccttaacgtggccatcaaccacctgtacttccttcacgtagctaaggaaaaaatccgactgctggaccacaagttcgtgcaagatgagcagaaactccaggaaaccattgacaaattgtacgacgagaagcgtaagcaaaaggacgagaagaagaaggacaccatcgagcagaaaatcgagaagaaacgcaacaaactaaaggagcttcgtagcaaggggaacaaagaggcagcaaagacactccaggacgcgatcaagataaactttacaaccacgacgcgggagatcatcaacaagcagtttgacctcatgtccgacacaaaggaccggataacacagaaggtgactcaggacttctctatagaccttaagaacggcctcttgtcaggggaaagatcgcttcggacctacaagaagaacaatcccttgttcatacggggacgcactctctacttctaccaggaggggaagtcgatacttatcaagtggtgcaagggcattgtctttaagtgcattctcgggcggcaccaaaacaactcgcacgagctttggaccatcctcaagaaagtgttggaacagagctacaaggtgtgcgattcatcaatatctgttgggaaggacttcatattgaacctgtctctggacatcggcgagtccgacaatcgaaccgctttcgtggaaggtcgtgtcttgggagtggacctcggtatgaaggttcctgcctatatgtccattaacgacaagccttacatccgaaaagcacttggatcgctggaagacttcctaaagattcgagtccagatgcagaaacgccgcaagaatctccacaaaaccctagtgtctgtcaagggaggcaagggtcgtgagcgtaaggtgaaggcgctcgaccgtttcaaggagaaggagcaaaacttcgccacgacatacaaccactttctgtcccacaacatcgtgaaattcgccaaaaagcaccggtcaggccagatcaatatggagttccttgccctggctggcgaagacaaggataagatactccgaaactggtcctactatcaacttcaagagtttatcgagtacaaggctaaccaggagggtattaaggtcaagtatgttgatccctaccgcacctcacagacttgctccaagtgcgggagttacgagcccggccagcgtgagagtcaggagaagttcatctgcaaggtgtgtaagctggagatcaacgcggactacaatgcctcccagaacatcgcccacagcacaaagtatatgaccaacaagcagcagtccgagtacttcaagcggctccagcagactaccaaacttgagaagtattcttag

SEQ ID NO: 3273 - DNA, 1437 bp, Unknown
  Bacillus sp. multi
atgattatcacaaggaagattaagctcattatcgtgggcgaggagcgcgacaatcagtacaaattcatccgggaggagcgctacaagcagaacaaggccctcaacgtagccatcaaccatctctatttcctccacgttgctaaggagaaaatccgcctgctcgaccacaagttcgtccaggacgagcagaagctccaggagacaatagacaagctctatgacgagaagcgtaagcaaaaggacgaaaaaaagaaggacacaatcgagcagaaaatcgagaagaaacgcaacaaactaaaggagctgcggtcgaaagggaacaaagaggcagctaagaccttgcaagacgctattaagatcaactttactacaactacacgagaaatcatcaacaagcagttcgaccttatgtccgacacgaaagatcgaatcacccagaaggtgacacaagacttcagtattgatctcaagaatggccttctgagtggggagcgttcgttacgcacttacaaaaagaataaccccttgttcatccggggtcggactctctacttctaccaggagggaaagtcgatacttattaagtggtgcaagggcatcgttttcaagtgcattctaggtcggcaccaaaacaatagccacgagctatggacgatcctcaagaaagtcctagagcagtcctacaaagtctgcgatagcagcatcagcgtggggaaagacttcatactgaacttgagtctggacattggggagagcgataaccgaacggccttcgtcgagggcagagtgctaggcgtggatctcgggatgaaggttccggcctatatgagtatcaacgacaagccttacatacgcaaggctcttggtagcctggaagatttcctcaaaatccgggtgcagatgcagaagcgacgcaagaatttgcacaagacgctcgtgagcgtcaagggtgggaaaggacgggagcggaaagtcaaggctctcgaccggttcaaggaaaaggagcagaacttcgccacaacctacaaccacttcctgtctcacaatatcgtgaaattcgccaagaaacaccgctccgggcagattaacatggagttcctcgctttggctggtgaggacaaggacaagatcctgaggaactggtcctactaccaactccaagagtttatcgagtacaaggcgaaccaggagggtatcaaggttaagtacgttgatccgtacagaacttcccagacatgcagcaagtgcggcagttacgagcctggtcaacgggagtcccaggagaaattcatctgtaaggtgtgcaagttggagatcaacgcggactacaatgccagccagaacattgctcatagcactaagtatatgacaaacaagcagcagtccgagtacttcaagcgtctccagcagacgaccaagttggagaagtacagttga

SEQ ID NO: 3274 - DNA, 1437 bp, Unknown
  Bacillus sp. multi
atgataatcaccaggaagattaagctcattatcgtcggggaggagcgcgacaaccagtacaagttcatccgcgaggagcgttacaagcagaacaaggccctcaacgtggcgatcaaccacctgtacttcctccacgtggctaaggaaaaaatccggttacttgaccacaaattcgtccaagatgagcagaagctccaggaaactattgacaaactgtacgacgagaagcgcaaacagaaggacgagaagaagaaagataccatcgagcagaaaatcgagaagaaacgtaacaagctcaaggaactccgtagcaaagggaacaaggaggccgccaagaccttgcaagacgctattaagatcaactttaccactacgacgagggagatcattaacaagcagttcgaccttatgagcgatacgaaagaccgaatcacgcagaaggtcactcaagacttctctattgaccttaagaatgggttgctgagtggcgaacgtagcctccgaacctacaaaaaaaataacccgctcttcatacgcggacggactctttacttctaccaggagggcaagtcaatacttatcaagtggtgcaaggggatagtgtttaagtgcatcctcgggagacaccagaacaacagccacgagctatggacaatcctcaagaaagtgcttgaacagtcctacaaggtctgcgacagctcaatcagcgttggcaaagacttcatcctaaacctgtcacttgacatcggcgagagtgataacaggaccgcattcgtcgagggtcgggttcttggggtcgatttggggatgaaggtgcctgcctatatgtccattaacgacaagccttacattcgtaaggctcttggctcccttgaagacttcctcaagataagagtacagatgcagaaaaggcgcaagaatctccacaagacgctggtgtccgtcaagggtggcaaggggcgcgagcgcaaggtgaaggccctggacagattcaaggagaaggagcagaactttgcaaccacctacaatcacttcctttctcacaacatcgtgaaattcgccaaaaaacacaggagcggtcagatcaacatggagttcttagccctggcgggtgaggataaggataagatccttcgaaactggagttactaccaactccaagagttcatcgagtacaaggccaaccaggaggggatcaaggtcaagtacgtcgatccctaccgcacctctcagacttgctctaagtgtggctcttatgagcctggacagcgcgagagccaggagaagttcatctgcaaggtgtgcaagctggagatcaacgcggactacaacgcctcccagaacattgcccacagcacaaagtatatgaccaacaagcagcagtctgagtatttcaagaggctccagcagacgactaaactggagaagtacagttga

SEQ ID NO: 3275 - DNA, 1425 bp, Unknown
  Bacillus sp. multi
atgattatcgcccgcaagattaagctcataatcatcggggagaacagggacactcagtacaagttcataagggaggagcgctacaaacagaacaaggcgctgaacgtggccatgaaccacctctatttcctccacgttgctaaggaaaaaatccgactgcttgacaaaaaattcttacaagacgagaagaagctccaggagggcatcaacaagctctatgcggaaaaaaaaaaagtcatcaaggacgagaagaaacgaaacgaattggagaagaaaatccaaaagcagaccaacgaactcaaaaaactacgttcgaagggaaacaaggaagctgacaagatactccaggaggccattaagataaaccttagcagcaccaccagggaggtgattagcaagcagttcgacttgatctcagacactaaagacaggataacccagaaggtgtaccaagacttcaagtcggatctcaagaatgggttgctcagcggagagcgtgtgttgcgaacttacaagaaaaacaatccactcctcatccgtggtagagcactaaacttctaccgtgaggggaaggacgtgatgattaagtggttcggcgggatcatattcaagtgcatgttgggacagcacaagaacaacgcccaggagttaaaagccaccctcaacaaggtgcttgaggggtcttacaaggtctgcgacagttcgatctctgtgggcaaggaactaatactcaacatcagcttggacatcggcgaggtggacagcaacgtatcctgcaagaagggccgtgtgcttggagtggacttggggatgaaggtgccagcctatatgtctattaacgacaagccgtacatacgcaagtctctgggctccctcgacgacttcctcaagattcgggtgcaaatgcagaagcggaggcgaaatctccacaagacacttgtgagtgtgaaaggagggaagggtcgggagaagaagctacaagctctcgacaggcttaaggagaaggagaagaatttcgccaccacctacaaccactttctgagttacaacatcgtgaagttcgctaaggataaccttgccgaacagatcaacatggagttcctcgcccttgctggcgaagacaagaacatcatcctgcggaactggtcctactaccagctccagcagttcgtggagtacaaagccaagcgggaggggattgacgttaagtatgttgacccatacagaacctcacagatgtgctccaagtgcggcaactacgagcccggccagcgggagagccaggagaagttcatctgcaaaagctgccaccttgagatcaatgccgactacaacgcctcacagaacatcgctcacagcaccaagtacataacgaacaagaaccagagtgaatacttcaaaaagttgcagcacaccattgaatga

SEQ ID NO: 3276 - DNA, 1425 bp, Unknown
  Bacillus sp. multi
atgattatagctcgcaagattaaacttattattatcggcgagaacagggatacccagtataaattcatccgggaagagcgttacaagcaaaacaaagcactcaatgttgctatgaaccacctctacttcctccatgtcgctaaggagaagattagactattagataagaagtttcttcaagatgaaaaaaagctacaggaggggataaacaaactctacgccgaaaagaagaaagttatcaaggatgagaaaaaaaggaatgagttggagaagaaaattcaaaagcagactaacgaactcaagaagttaagatcaaaggggaacaaagaagctgataagattttgcaagaggctatcaagataaacttgagctcaactaccagggaagtgatttctaagcaatttgatctgattagtgacaccaaagatagaataacgcaaaaggtataccaggatttcaaaagtgacttgaagaacgggctcttatctggcgagcgcgttctgagaacttataagaaaaataatccgcttcttattcgtggtcgtgcattgaatttctatagagagggtaaagatgttatgataaagtggttcggtgggataatcttcaagtgtatgttgggtcaacataagaacaacgctcaagaattgaaggctacattgaacaaggttttagagggcagttacaaggtttgtgattcttctatctcagttggcaaagagttgattttgaatattagcttagatattggagaagtggattcgaatgtctcatgcaaaaaaggtcgcgttttgggagtggatctgggtatgaaggtgccagcatatatgagtatcaatgacaaaccatacattcggaaatccttaggatcccttgatgacttcttaaaaataagagtgcagatgcagaaacggagacgcaaccttcataaaacattggtttcagtgaagggtggtaagggtagggagaagaagcttcaagcacttgatagattgaaagaaaaggagaaaaatttcgcaacaacatacaaccactttctgtcatacaatattgttaaatttgctaaggataatctcgcagagcaaatcaatatggagttcctcgccctcgcaggtgaggataagaacatcattttgagaaattggagctattatcagttgcaacagtttgttgagtataaggctaaacgagaaggaattgatgtgaaatatgtcgatccttataggacatcccagatgtgctcaaaatgtggcaattatgaacccggacagcgggaatctcaggagaagtttatttgcaagtcttgtcacttggaaatcaacgcagactataatgcatcgcagaacattgctcattctactaaatatattacaaacaagaatcaatccgaatactttaagaagcttcaacatacaattgaatga

SEQ ID NO: 3277 - DNA, 1425 bp, Unknown
  Bacillus sp. multi
atgataattgcaaggaagattaagttaattatcatcggggaaaatcgcgatacccagtacaaattcatccgcgaggagagatataagcaaaacaaggcgctaaatgttgcaatgaaccatctctattttttacacgtggctaaagagaaaattcggcttctcgataaaaagttcctccaagatgaaaaaaagctacaagaaggtattaacaaattgtacgctgagaaaaaaaaggtgataaaagatgaaaagaaacgcaacgagctggaaaagaagattcagaagcagactaacgagctcaagaagctgagatcaaaaggtaataaggaagctgacaaaattctacaggaagctatcaaaatcaacttgtcaagcacaacaagggaagtcatttcgaaacaattcgatctcattagtgataccaaggatcgcataactcagaaggtctatcaggatttcaaatccgaccttaaaaatggactgttgagtggtgaaagagtgcttaggacttataagaagaataatcctttgcttatacggggaagggctttgaacttctatcgcgaaggaaaggatgtcatgattaagtggtttggaggaatcatttttaaatgtatgctaggccagcacaaaaataacgctcaggagcttaaggcaactcttaacaaagtattagagggttcatataaagtttgcgatagttcaatttcggtgggtaaagagttgattctcaacatttcacttgatattggcgaagtggactcaaatgtttcatgcaaaaaaggaagagttttaggggtcgatttgggtatgaaggttccagcttacatgagcataaatgataagccatatataagaaaaagccttgggtccttggacgattttctaaaaataagagtacaaatgcagaagagaagacgaaacttgcacaagactttggttagtgtgaagggaggcaaagggcgcgagaagaaattacaagcacttgaccgcctgaaggaaaaagaaaaaaattttgctacaacctacaatcatttcctgagctacaacattgtcaaattcgctaaagataatttggctgagcaaatcaacatggagttcttagcactagctggagaggacaagaacatcatacttagaaattggtcatattatcaactgcagcaatttgtggaatataaggctaaacgggaaggaatcgatgtcaagtacgtggacccatatagaacttctcaaatgtgctctaagtgcggtaattacgagccaggacaaagggaatctcaagagaaatttatctgcaaaagctgtcacctcgaaattaatgcagactataacgcctctcagaatatagcacacagcacaaaatatattaccaataaaaatcaatctgagtactttaagaagctccaacacacaatcgaataa

SEQ ID NO: 3278 - DNA, 1425 bp, Unknown
  Bacillus sp. multi
atgattatcgcgcgcaagatcaagttaatcatcattggtgaaaatcgggacacacagtacaagttcatccgggaggaacgatacaagcaaaacaaggccctcaacgtggcgatgaaccacctctacttcctccacgtggcgaaggagaagatccgtctgctcgacaagaagtttctccaggacgagaagaagctccaggagggcatcaataagctctacgccgaaaaaaagaaggtgattaaggacgagaagaagcgaaacgagctggagaagaaaatccagaagcagaccaacgaactcaagaaactcagatccaaagggaacaaagaggctgacaagattctccaggaagcgatcaagattaacttgagtagtaccacgcgcgaagtcatctcaaagcagttcgacctgataagtgacacaaaggaccggattacgcaaaaggtttaccaggacttcaagagcgacctcaagaacggcctgctgagtggcgaaagagtgttgcgaacttacaaaaaaaacaacccattactcatccgagggcgagccttgaacttctaccgggagggaaaggacgtgatgattaagtggttcggtggaatcatcttcaagtgcatgttgggacagcacaagaacaacgcacaagagttaaaagccacgcttaacaaagtgctggagggatcatacaaggtttgcgacagctccatctctgtcgggaaggagctgatactcaatatcagcttggacatcggtgaggtggactccaatgtctcatgcaaaaaagggcgcgtgctgggcgttgatctcgggatgaaggtgcccgcctatatgtcgatcaatgacaagccctacatacgcaagtccctcggctcgttggacgacttccttaagattagagtacaaatgcagaagcgtaggcgcaacctgcacaagacgctcgtcagtgttaagggcggcaaggggcgtgaaaaaaagctgcaagccctcgaccgccttaaggagaaggaaaaaaacttcgcaacaacttacaaccacttcctaagctacaatatcgtcaagttcgccaaagacaatctggctgagcagatcaacatggagttcctcgctctcgctggtgaggacaagaacatcattctgaggaattggagctactaccagttgcagcagttcgtcgagtacaaggccaagcgcgaggggatagacgtgaagtacgtggacccctatcgtacttctcaaatgtgcagcaagtgcgggaactacgaaccagggcagagggagtcacaggagaagttcatctgcaagtcatgccacttggagatcaacgctgactacaacgccagccagaacatcgcgcactccaccaagtatatcacgaacaagaatcagagcgagtatttcaaaaaactccagcacaccatcgagtga

SEQ ID NO: 3279 - DNA, 1425 bp, Unknown
  Bacillus sp. multi
atgataatcgcccgcaagatcaagctcattatcatcggcgagaacagggacacccagtacaaattcatccgggaggaacgatacaaacagaacaaggccctcaacgtcgctatgaaccatctctatttccttcacgtagcgaaggagaagatccgcttgcttgacaagaaattcctccaggacgagaagaagctccaggagggtatcaacaagctctacgccgaaaaaaagaaggtgattaaggacgagaagaaacgaaacgagctggaaaaaaagatccaaaagcagacgaacgaactcaagaagctccgctcgaagggcaacaaggaggcggacaagattctccaagaggccatcaagattaacctctcgtccaccacccgtgaagttatctctaagcagttcgacctcatatctgacactaaggaccgcatcactcagaaggtttatcaggacttcaagagcgacctcaagaacgggttgcttagcggtgagcgcgtcttgcgaacctacaaaaagaacaacccactgctcatcagagggagggccctgaacttctaccgcgaggggaaggacgtgatgattaagtggttcggcggcataatcttcaagtgcatgttgggtcagcacaagaacaacgctcaggaattgaaggctaccttgaacaaggtgcttgaaggttcgtacaaggtttgcgacagcagcatcagcgtggggaaggagttgatactgaacatcagcctggacattggggaggtggacagcaatgtctcctgcaagaaggggagggtgcttggggtggacttggggatgaaggttcccgcctacatgagcatcaatgacaagccgtacatccgtaagtctctcggcagtcttgacgacttcctaaagatacgggtgcagatgcagaagcgacggcggaacctccacaagactttagtctcggtgaagggcgggaaaggtcgggagaagaaactccaggcactagaccgtctcaaggagaaggaaaaaaatttcgctacaacatacaatcactttctgagttacaatatcgtgaaattcgctaaggacaacctcgccgaacagatcaacatggagttcctcgcactcgctggtgaagacaagaacatcatactcaggaactggagctactaccagctccagcagttcgtcgagtacaaagccaagagggaagggatcgacgtgaagtacgtggacccctacaggacgtcacagatgtgctccaagtgcggcaactacgagccagggcagcgggaatctcaggagaaattcatctgcaaatcctgccacctggagatcaacgccgactacaacgcatcacagaatatcgcccattcaacaaagtacatcaccaacaagaatcagtcggaatacttcaaaaagctgcaacacacaattgagtga

SEQ ID NO: 3280 - DNA, 1191 bp, Unknown
  Streptomyces sp. multi
atggcagctatttgggctgggatagacgccggaaagacccatcatcactgtgttgctattgacgagtctggaaggagactcctctcgcgccgcgtagcaaacgatgaacccgaactactggagctgcttaccgatgtgttggcactaggagatgaagtgacatggggaatcgaccttgctgacggcggtgctgcgcttgccattgctattctacttaatcacgaccaacccgttaattacataagcgggcgggccatccaccgtgctagtgaatcctacagaggtgagggcaagacggacgctaaggacgctgccgtaattgcagaccaagtgcgtatccgtcgtgacttaaatcctttgagaacaggggacgaaacagtgaccgatctcaaaatccttacaggaagacgcatggacttagtggccgaccggacgaggaccattaaccgcctgcgagcccagttgtctgggatcttccctggactggaacgcgcactcgatctcaccaacaagggcccactgacattactgacagggtatcagacatccgccgctatccgaagacttgggactaaaaggcttgaaacttggctcaggaatcgtaaagtgctccgcgcagaccaattggccgagactgctgtggctgcggctgaaagacaacatacttcacttcctggggaaaagttgactgctcaaatggtacataccctggctaaggaagtcatggtgcttaccgaacaagtcgcagaagtggacaagctcatcgaggccagatttcgagaccacaggcacttcgatgtgattaccagtatgcctggattgggcataattctaggtgctgaattcctcgcagcaacaggaggtgatatgaccatcttcgacacacctgacagacttgccgcattcggtggagtggctcccgtgcccagggacagtggcaagatcagcggaaacctgcggagaccccagcgatacaaccggagattgcagcgtgtgttctataccagtgcccttttcagtatcagaaaatgtgaggagagtcgccggttttacgaccgaaaacgcgcggaaggcaagcgtcacactcaagcggtgctcgctcttgcacggagaagggtgaacgtgctttgggccttgctccgtgatggcagagcttacgaacttacacctcccaccgcactggctgcatag

SEQ ID NO: 3281 - DNA, 1191 bp, Unknown
  Streptomyces sp. multi
atggcagcaatctgggctggcattgatgctggaaagacccatcatcactgcgtcgcaattgatgagtctggtcgcagactactgtcacgacgggtagctaacgatgagccggaactgcttgaactattaaccgacgtgcttgcactcggagatgaggtgacctggggtattgacttggccgatggaggtgccgccttagccattgctattctcctcaaccacgaccagcctgtgaactatatcagtggacgcgccatccaccgtgcttctgagagttatcgcggcgaagggaaaaccgatgccaaagatgcagcagtgattgcagatcaagttcgtattcggcgtgatcttaatcccctgagaactggtgacgagaccgtaaccgatttgaagatactcaccgggcggcgtatggatctcgttgccgacaggacacgcacgattaaccgcctgagggcacagctctccggtatcttccccggtttggagagagctttggatctgaccaacaaaggaccattaacattgctcacagggtatcagactagcgcagctatcaggagattggggacaaagaggctggagacttggctcagaaaccgaaaggttctcagagcagaccagttggccgaaactgctgtcgctgctgccgaaagacaacacacctccctacctggtgagaagctgacggctcagatggtacatactctggctaaggaggtgatggtcttgactgaacaagtggcggaagttgataagctcatcgaggcccgcttccgagatcatcggcacttcgatgtgattacgtccatgccggggttgggaatcatcctcggggcagaattcctcgctgcaaccggtggtgacatgacgatcttcgataccccagatcgcttggcagcattcggcggcgtagcaccagttcctcgtgacagcggcaaaatctccggcaatttgagacgcccgcaacgttacaaccgacgcttgcaaagggtattctatacttctgcgttgttctctatcaggaaatgtgaggaatcgaggcggttctacgacaggaaacgtgctgaggggaaacgtcatactcaagcagtgttagcattggccaggcggcgtgtcaatgttctctgggcactgcttcgagacggtcgcgcgtacgaacttaccccgcctacagccttagccgcatag

SEQ ID NO: 3282 - DNA, 1191 bp, Unknown
  Streptomyces sp. multi
atggctgcgatttgggctgggatcgacgctgggaaaacccatcatcactgtgtcgcaattgacgagtctggaaggagactactttccaggagggtcgccaacgatgaaccggaactcttggaacttctcacagatgtgttggccctgggagatgaagttacatggggtattgacttggctgacggcggagctgctcttgccatagcaatcttgttaaaccacgatcaacccgtgaattacatcagcggtcgcgcaatccacagggcgtccgagtcataccgaggcgaggggaaaaccgatgctaaggacgccgctgtaatcgctgaccaagttcgcattcgccgcgatctaaacccattgaggacgggagacgaaaccgtgacagatttgaagattctgacaggccggaggatggacttagtagccgaccgcactcgcaccatcaaccgtctccgtgcacagctctctggcatattccccggccttgagcgggctttggacttgacaaacaagggaccgcttacactcctcactggctaccaaactagcgctgccatcaggcggctcggcactaagaggttggagacctggttacggaaccgcaaggtgctcagggcagaccagcttgctgaaaccgcagtcgccgctgcggaaagacagcacacatccttgcctggtgagaagctgactgctcaaatggttcacaccctagcgaaggaggttatggtccttaccgaacaagtcgctgaggtggacaaactcattgaggcacggtttcgggatcaccgccacttcgacgttatcacatcaatgccaggactggggattatcctgggtgctgaattcttggcggctactggaggcgacatgacgatattcgatacaccagaccgtttggctgccttcggaggagtggccccggtcccgagagatagtggcaaaatcagtgggaatctgagacgaccgcaaagatacaacaggcgcttacagcgcgtattctataccagcgcactcttcagcatccgaaaatgtgaggagagtaggagattctacgaccgaaagcgagcagagggcaaacgccacactcaagctgtcttggctttggccagacgtagagtcaatgtgctgtgggccctgctgcgggatgggagagcctacgaactgactccaccaactgcattggcagcctaa

SEQ ID NO: 3283 - DNA, 1191 bp, Unknown
  Streptomyces sp. multi
atggccgcaatctgggccggaatagacgctgggaaaacacatcaccactgcgttgcaatcgacgagtccggacgtaggctgctctcccgccgcgttgccaacgatgaacccgaactcctggaactacttaccgacgtgcttgctctcggcgacgaagtgacttggggaatcgacctcgctgacggcggtgcagcacttgcaattgccatcctgcttaaccatgaccaaccggttaattacatatccgggcgggcgattcaccgcgcaagcgagagctacagaggtgaggggaagaccgatgcaaaggatgctgctgttattgccgaccaagtacgcatcaggcgagaccttaatcccctcagaactggagatgagacagttactgacttgaagatattgactggaagacgaatggatcttgtggcagacagaacgaggaccatcaaccgcctcagggcacagctatccggaatcttcccaggacttgaaagagcattggatttgaccaacaagggaccgttgacgctcttaacgggttaccaaacatctgctgccatccgtcgcctgggcactaaacgcttggaaacatggttgagaaacagaaaagtgctgcgggcagatcaactcgcggagactgctgttgctgccgccgaacgccaacacacctcactccccggtgagaagctaactgctcaaatggttcacactctagctaaagaggttatggtgcttaccgaacaagtcgctgaggttgacaaattgatcgaggcacgctttcgagatcaccgacacttcgacgtgattacctcgatgccggggttggggatcatactgggtgcagagttcttagcagctacgggtggcgatatgacgatcttcgacacaccggatcgtctcgctgctttcggtggagttgctcctgttccccgcgacagcgggaagataagtggaaatcttcggcgtccacaaagatacaaccgcagacttcagagggtgttctacacctctgcactgttctcgatcagaaaatgtgaggagtcccgccggttttacgaccgtaagcgtgcggagggcaaaaggcacacacaagccgtcttggctctcgctaggaggagagtgaatgttctctgggctctacttcgggatggacgcgcgtatgagctaactcctccgactgctctagccgcttaa

SEQ ID NO: 3284 - DNA, 1191 bp, Unknown
  Streptomyces sp. multi
atggcggctatatgggccggtattgacgccggaaagactcaccaccactgcgttgccattgacgaatctggtcgccgactgctttccaggagagttgccaatgatgaacctgaactcctcgaactcttgaccgatgtgcttgctttgggagatgaggtgacttggggcattgaccttgctgacggtggcgcagctttggcaattgctatcctgctcaaccacgaccagcctgtgaactacatatctgggagagctatccatagggcatcagagagctacagaggtgagggcaaaaccgatgctaaggacgctgctgtgatcgccgaccaagttcgaatcaggcgagatttgaatcctctcagaacaggggatgagactgtgaccgacctcaaaatcctgactggccgacgaatggatctcgttgccgacaggactagaactatcaatcgtttgcgggcccagctatccggcatattcccaggcttagagcgcgcgttggaccttacaaacaagggcccgctcacactgcttacagggtatcagacctccgctgccatccgcagacttggtactaaacgacttgaaacatggttgaggaatcgcaaggtgctcagagctgaccagcttgctgagactgccgtcgctgctgccgagagacaacacactagccttcctggtgagaagctcacagcacagatggtgcacactctcgctaaggaagtcatggtgctgacagaacaagtcgccgaagttgataaactgattgaagcacgcttcagagatcacaggcacttcgacgtgattacgtctatgccaggactagggatcattctgggtgcagaattcctcgctgctacaggcggcgatatgacaatcttcgacacacccgatagactggctgccttcggcggtgttgctccagttcccagggactctggcaaaatctctgggaacctccggcgtccacagcggtacaaccgtcgattgcaacgagtattctatacttctgcactgttctccatccgcaaatgcgaggagagccgacgattctatgaccggaaacgggcagagggcaagaggcacacccaagcggtgttggctttagctcggagacgagtgaatgtcctgtgggctttgctacgcgacggtagggcatacgagttgacaccacctactgcccttgctgcttga

SEQ ID NO: 3285 - DNA, 1131 bp, Unknown
  Bacillus sp. multi
atgagagtccaggaggttatcctcgaaaacggcaaacgctatatcttggtggactcggacggggtgcccgtcattcccgtggtcaagtatttgaagtatctcgacgtgaccgggaaaagcagcaacacacaaaaaacatactgttacgcattgaagcaatattttctctacctccaggaaaccgaaaaggattacaagcacattcggttggaggacttagtggagttcgtcggctggttaaggaacccttacgagagcactaaagttatgtctttgaggccggttcagaccaagaagacggaacgaactgtgaacttgacggtgaccgccgttacgaacttttacgattacctttaccgcaacgaggaactgccactggacatggaggagaagctcattcgacaagtattcactggcggtagaactcgttacaagagctttctacaccacgtcaacaaggataagccgtcaatgcgtaacgtccttaagatcaaggagccccgcaagagggtgcagacgttgaccattgaacaagttgagcaagtgcttgccgctaccacgaacattcgggatactttcctcatcagactgctgttcgaaactggcttgcgtattggcgaagctctctctctattcctcgaagacttcaagttcagccaccaaaagggtcaccggatcaggcttactgatcgtggtgagcttgagaacagtgccaaactcaagactggggagcgtgaaatcttcgtttcccaggagcttatggacctttacgatgactatatgtacgatgtggtagatgagctggacttcgagactaacttcgtgttcgtgaaactacgtggcaagaatcgaggcaagccaatgacgtacggtgacgtcgaggcgttgttcaagcgtctaagacagaaaatcggcctgaatatccacccgcacttgttccggcacacgcacgcgaccatgtactaccaggagactaaggacatcaagcaagtacaggaaagacttggacactcgcagatccagactactatgaacctctatcttcatccttccgatgaggacaccaggaaagtgtgggagaaggcacaaggagcgttccagatcaagcagcagaacggtgggaaggagtga

SEQ ID NO: 3286 - DNA, 1131 bp, Unknown
  Bacillus sp. multi
atgcgcgtgcaagaggtgatcctcgaaaacgggaagcggtacatcctggttgactcggacggcgtgcctgtcattcccgtcgtcaagtacctaaagtatctcgacgtcacgggcaaatcgtccaacactcagaaaacttattgctatgcccttaagcagtacttcctctatctccaggaaaccgagaaagactataagcacattagacttgaggatctcgtggagttcgtcgggtggttgagaaacccgtatgagtccactaaggtgatgagcctcaggccggtgcagaccaagaagactgagcgtaccgtgaaccttacagttaccgcagtgaccaacttctacgactacctttacaggaacgaggaattacctcttgatatggaggaaaagctgatacgccaagtgttcactggagggcgtacccgctacaagagtttcctgcaccacgtgaacaaagacaagccctcaatgcggaatgttcttaagatcaaggagccccgcaagagggttcaaactcttactattgaacaagtagaacaagtccttgcagcaaccacgaacataagggatacctttctcataagattacttttcgaaactgggctaaggataggggaagctctttcgctattcttggaggacttcaagttctcacatcagaagggccaccgtatccggctaacggacagaggtgagttggagaacagcgccaagttgaaaacgggcgaacgagagatattcgtatcccaagaattgatggacctctacgacgactatatgtacgatgtggtggacgaactggacttcgaaacgaatttcgtcttcgtcaagctacgcggcaagaatcgagggaagcccatgacctatggagatgttgaggccctgttcaagcgcctacgccaaaaaatcgggctgaacatccaccctcaccttttcagacacacccacgcgacaatgtactatcaggagactaaggacattaagcaagtacaggaacgtttgggacactcccagattcagacaaccatgaacctctatcttcaccctagtgatgaggacactcggaaggtttgggagaaggcacaaggagccttccagatcaagcagcaaaacggaggcaaggagtaa

SEQ ID NO: 3287 - DNA, 1131 bp, Unknown
  Bacillus sp. multi
atgcgggtccaggaagtgatactggagaacggcaaacgctacatcttggtggattccgacggagtgccagtcatcccagtggtgaagtatctaaagtaccttgacgtgacaggaaagtcatccaacactcagaagacatactgctacgctcttaagcaatattttctgtacctacaggaaacggagaaagactataaacacatccgtctggaggatctcgtagagttcgtgggttggcttcgaaatccttacgagtccaccaaagttatgtctttacgacctgttcagaccaagaaaacggaacgtaccgtaaacctcaccgtgaccgcagtgaccaacttttacgattacctgtaccgaaacgaggagttgcctttggacatggaggagaaactgattcgtcaagtgttcactggcggacgaactcgctacaaatcgttccttcaccatgtcaacaaagacaagccgagtatgagaaacgttctcaagattaaggagccgcgcaaaagggttcagactctcacgattgaacaagtcgagcaagtgctggctgccaccaccaacattcgggatactttcctcattcgactccttttcgagacgggactaagaattggggaagctctgtccttgttcctggaggactttaagttctcccaccaaaagggccacaggatcagattgacagaccgaggtgagttggaaaactcagcgaaattgaagacgggtgagcgagagatattcgtgagccaggaactgatggacctgtacgatgactatatgtacgatgtcgtagatgagttagacttcgagactaacttcgtcttcgtgaaactccggggcaagaaccgaggcaagcccatgacctacggggacgttgaggcactcttcaaacgccttcgacagaagatcggtctgaatatccacccgcacttgttccgtcacacccacgcaaccatgtactaccaggagacaaaggatattaagcaagttcaagagcggttgggacactcccagatccagaccactatgaacctgtacttgcacccttccgatgaggacacccgtaaagtctgggagaaggcacaaggcgctttccagatcaagcaacaaaatggcggcaaagagtaa

SEQ ID NO: 3288 - DNA, 1131 bp, Unknown
  Bacillus sp. multi
atgagagtgcaagaggtgatacttgaaaacggaaagcgctacatacttgtggattcagatggggtgcctgtcattcctgtggtcaaatacttgaagtacctcgacgttaccggaaaatcgtcgaacacacagaagacttactgctacgccctcaaacaatattttctctatctccaggagaccgagaaagactataagcacatacgtctcgaagacttggtggagttcgtcggatggctcagaaacccctacgagagcacgaaggtgatgtctctgcgccccgtgcagaccaagaaaaccgagcgcacggttaatcttactgttacggccgtcactaacttctacgactacctctaccgtaatgaggagttgccattggacatggaggagaagctaatccggcaagtgttcaccggaggacggacacgctacaagtcattcctccaccacgtcaacaaggacaagccctccatgagaaatgtcttaaagatcaaggagccgcgtaagcgcgtacagactcttactattgagcaagttgaacaagtccttgccgccaccacgaacatccgggacaccttccttattcgtctgcttttcgagaccggtttgaggatcggtgaagcactttcactcttcctcgaagacttcaagttctctcatcagaagggacaccgcattagactgacggacaggggcgaattggaaaacagcgccaagttaaagacaggggagcgagagatattcgtgtcccaggagttaatggatctctacgacgactatatgtacgatgtggtggatgagctggacttcgagacaaacttcgtgttcgtcaagttgcgtggcaagaaccgtggaaagcctatgacgtacggtgacgtggaagcacttttcaaacgacttcgccagaagatcgggcttaacatccacccgcatctgttcagacatacacacgccaccatgtactaccaggagactaaagatattaagcaagtgcaagaacgacttggacactctcagatccagacaaccatgaacctgtaccttcaccctagcgacgaagacactcggaaagtgtgggagaaggcacagggtgcctttcagatcaagcagcagaacggcgggaaagagtga

SEQ ID NO: 3289 - DNA, 1131 bp, Unknown
  Bacillus sp. multi
atgcgagtacaggaggtcatcttggagaacggaaagcggtatatcttggtcgatagtgacggggtgcctgtaattcctgtcgttaagtatttgaagtaccttgatgtgacggggaagtcctcaaacactcagaaaacgtactgctacgcactcaagcagtacttcctctacctccaggaaaccgagaaagactataaacacatcaggctggaagacttagtggagtttgtcggatggctcaggaacccatacgaatctacgaaggtcatgtcactccggcccgtccagaccaaaaagaccgaacgcacggttaatctcaccgtcaccgcagtaacaaacttctacgattacctttaccgcaacgaggagttgcctctggacatggaggaaaagctaatcagacaagtcttcactggtggcagaacgcggtacaagtccttcctccaccacgtcaataaggacaagccctcgatgcgaaacgtcttgaagattaaggaacccaggaagcgtgttcagacattgaccattgaacaagttgaacaagttcttgcggctacgaccaatatccgcgacactttcctcatccgacttctattcgagacgggcttgcgtattggcgaagctctctcactattccttgaggacttcaagttctcacaccaaaagggccaccgcatcaggctcacagacaggggagaactggaaaacagtgccaagctcaagacaggcgaacgggaaatcttcgtgagtcaggagctgatggacctttacgacgactatatgtacgacgtagttgatgaacttgacttcgagaccaacttcgttttcgtgaagttgcgtggcaagaaccgtggcaagccgatgacttatggcgacgtggaggccctattcaagcggctcaggcagaagataggtcttaacatccaccctcacctcttccgccacacccatgctactatgtactaccaggagactaaggacattaagcaagtacaggaacggttgggtcattcacagattcagacgaccatgaacctctacttacacccctccgatgaggacaccaggaaggtgtgggagaaggctcagggagcctttcagattaagcagcaaaacggcggcaaggagtga

SEQ ID NO: 3290 - DNA, 3018 bp, Unknown
  Bacillus sp. multi
atgcctagcattgaggacacagcgtacccgcgcttgaaatccaatcctagccagaaggagcttcaagagctgtactctcccaccatcgaggagattcactggatgaagccccacgtgaaaggcgacgttgccaagctcggggtattcgttctcctcaagacctttcaacgcctgggctactttctcccggttaccgagattccggaggacatcgtgatccacatcgcccagaagatgaatcttacactcgtttcccgcaatgacctccagaagtatcataattccggaacacagaagcgccaccacgcgctcataagggaataccgcaacatccacttctttaacgaccaggcgaggaagattatgatcgacacgatgaatcaggtgtcaagtacaaaggatgactctgccgactttatcaatgcagcaatcgacgaactcatacgccagagatttgagcttccaaccttctctaccctgaacgagactgccaaaaggctcaggagtcagtcctatcacgtagtgtacgaacaagtctatcagtcgataaacgagaacgataagaacaagatcgactcattgttccagaccaacgacggcaccgtttacactccgtggcaccacctaaagcaagacgccaagaaccccactatcaagcactttcgggagttagtcactcaaatggagtggcttatggcccagaaggtcaacacaaccatccttaagtctatacctagcgtaaagatccggcagatgacaagtgaagcgaagaccctggacgcagctcgtatgaagaaaatggagcccaagaagcgttacgctctggccttgtcgttcattcagtcccagttggctcatgtgcttgacaacatcggggagatgatggtgaagcggatgatgtccgcccggaacaagtccagggaccagctccagcactaccagatgaagaatcagaagcgcacagacctcctcataaccactctgtacgacgtgattctcgcttaccgcagtggaaacgaatctcaggacaagatggaggctattgagcaagtggtgggaaacagacatgaggaaatactgcacgattgcgagtcccacctggcctacagcggggataactacttcgtgttcgtttgggactactacaagagttctcgcagtaccctgttcaagatattgaacacagtgtcgctacgttcaacaaatcaggatcagggtcttgaagatgcaatcgccttcctcaaaacccaccagaactccaggaaggagagcctctcaatcgttagtatcgagaagaagggttactggaaaaaggaaatcaagccgttacttgacctatcctggattccagacgcttggtggcgttggattgcgcccaatcgtaagtcagggtgctatccagaggaggtcaacaggcgacactttgaggcgtgcgttttcacccagatcatgtggggcctaaagtccggcgacttgtacattgaagggagcgagaagtacgcagactacagacagcaactcatatcctggaatgagtacgagcagaagctcctcgacttctgtcacaagtcgaatctgccgagcacaggcaaggagtacgtgaagcagttgcgtaaacgctttatgaagatagccaagaagaccgacgccagtttcccctacaacaagcaagtccgaattgagaacggcgaaatagtcatcggaaagtccaagaaacgaaaaccttcacctaagctgaaatcgctggaaaagtacatgacacaaaacttagttcctattaacgtccttgatatgctcggcgacacagagcactggttgaattggacaagattcttcaagcccatatccaaacacgaggctcgtctggaagatccgattgagcgatacctcactacagtattctgttacgggtgcaatctggggccagttcaaaccgcacgctccctcggaaacatggaccggaggcaaatcagttgggtgaatcagcgtcacatcactactgagaacttagaccaagccatccagttcatcatcaactcatacaacaaattcgggcttcctaagtattggggtgatggcaagtccgcctctgctgacggcactatctgggcgctatacgagcagaacttgctctcagagagacacatacgctacggcgggtacggtggcatcggctactaccacgtgagcgacaactacattgcattgttctcacacttcattccctgcggagtgtgggaggggctgtacatcctcgacgtcctgatgaacaacaacagtgagatacagccagaggttatccattccgacactcaggggcaaagcgctactatcttcggtctgagcacattgatgggaattgagctgatgccacgaatacgaaattggaaagacctcaaaatgttccggcctgacaaggagtcacgcttcaaacatattgacgacatattcaccgacgagattgactgggacttaattgagatccattacaaggacatgctccgagttgccatgtctattgaagtcgggaaaatcacaccctccaccatacttaacaagctaggaacttactccaaaaaaaataagctatatcaagcctttcgagagctggggagggtgattcggactatgttcctactcaagtacattgccgacgagcagctcagacgcaccatacagacagccaccaacaagtctgagtcgttcaacggattcacaaaatggttattcttcggcggtgagggcattatcaccgaaaacaacagggagaaccagcgaaaagtcattaagttcaatcatctagtagctaattgcctcatattctacaacgtctttgctcttacacaagttctacacgcctaccgacaagatggcaacgagctggacgaggaagtcctgtcagagctttcgccctacataaccgctcacgtgaatcgctttggcaagtacggtattgatcccaatcgacaacctccagacctccagtttgacatgccaatctaccaagttgcaaactga

SEQ ID NO: 3291 - DNA, 3018 bp, Unknown
  Bacillus sp. multi
atgcctagcatcgaggacactgcgtacccacgcctcaagtccaacccttcccagaaggaattgcaagagttgtactcgcccacaattgaggaaattcactggatgaagcctcacgttaagggagacgtcgctaaactgggagtcttcgtcctcctcaagacgtttcaaaggctcggatactttctgcccgttaccgagatcccggaggatattgttatccatattgctcagaagatgaatctgaccctagtgtcgagaaacgaccttcagaagtaccataactcggggacgcagaagcgtcaccacgcactcatcagggaataccgaaacatccatttctttaacgaccaggcccgcaagattatgattgacactatgaatcaggtgtccagcacgaaggatgactccgccgacttcatcaacgctgcaatcgacgagcttattcgtcagaggttcgagctgcctaccttcagcaccctcaacgaaactgccaagcgtcttagatcccagagctaccacgtcgtctatgaacaagtctatcagtcgataaacgagaacgacaagaacaagatcgactccctgttccagactaacgacggtactgtctatacaccctggcaccaccttaaacaggatgctaagaacccgaccattaagcactttcgagagttagttacacaaatggagtggttgatggcgcaaaaggtgaacacgaccatcctcaagagcatcccctctgttaagataaggcaaatgacatccgaggcaaagacgctggacgcagcccggatgaagaagatggagcccaaaaagcgttatgccttagcactgtccttcatacagtcacagcttgctcacgtacttgacaatatcggcgagatgatggtcaaacggatgatgtcagccagaaacaaatcacgcgatcagcttcaacactatcagatgaaaaaccagaagcggacggacctgctgattaccaccttgtacgacgtcattcttgcttaccgtagcggcaacgagtctcaagacaaaatggaggctatagagcaagtcgttggcaatagacacgaggagatcctgcacgattgcgagtcacaccttgcctactccggtgacaactacttcgtcttcgtttgggactactacaagtcatcacgaagcaccttgttcaagatactcaacactgtgtcgcttcggagcaccaaccaggatcaaggactggaggacgccattgcattccttaagacccaccagaacagtcggaaggagtccctctcaatcgttagcatcgagaagaagggatattggaagaaagagattaaacccctattagacctgtcctggattcccgatgcgtggtggcgctggatcgctcctaaccgtaagtctggttgctaccccgaggaagtgaatcgaagacacttcgaagcctgtgtgttcactcagataatgtggggccttaagtctggtgacttgtacatcgaggggagtgaaaagtacgcggactacagacagcaacttattagctggaacgagtacgagcagaaactcctggatttctgccataagtccaacctgccttcgaccggcaaggagtacgtgaaacagttgcggaaaaggtttatgaagatcgccaagaaaacagacgcatcgtttccctacaacaagcaagttcgaatcgaaaatggtgagattgtgatcggcaagagcaagaagcgaaagccatccccgaagctcaagagtttggagaagtacatgacacagaacttagtgcccatcaatgtgctcgacatgctaggggacacggagcactggctgaattggacgaggttcttcaaacctattagcaaacacgaggcacgcttggaagaccccatcgagcgttacttaaccactgtgttctgttatggctgcaatttgggtccagtgcagacggcacgctcactagggaacatggacagacgtcagatcagttgggtgaatcagaggcacattacaacggaaaacttggaccaggcaatccagttcatcatcaactcatacaacaaattcggattaccgaaatactggggtgacgggaagtccgcgagcgccgatggaacaatatgggcgctttatgaacagaacctgctctccgaacgacacattcgctacggtggatacggcgggatcggttactatcacgtatcggacaactacatcgcattgttctctcacttcatcccttgcggggtctgggagggcctttacatcctcgacgtgctcatgaacaacaactctgagattcagcccgaggttatccactctgacacccagggccagtccgcaaccatattcggactttcgaccttgatgggaattgaactaatgccacgtatccgcaactggaaagacctcaaaatgtttcgccccgacaaggagtcccgattcaaacatattgatgacatattcacggacgagatcgactgggatctaattgaaatccactacaaggatatgctccgggtggctatgtctatcgaggtcggaaagattaccccttccactatactcaacaaattggggacttacagcaaaaagaacaaactataccaggctttccgagagctgggccgagtgattcgaactatgttcctgcttaagtacatcgccgatgaacaactcagacggactatccagaccgctaccaacaagtcagagagtttcaacgggttcaccaaatggctctttttcggcggagaaggaatcatcaccgagaacaatagggaaaatcagcgaaaagttattaagttcaatcacttggtggcaaattgcctcatattctacaacgtcttcgcattaacccaagtcctccatgcctaccgacaagatggaaacgaacttgacgaggaagttcttagtgagctatcaccgtacatcacggcccatgtgaacagatttggcaagtacggaattgatcccaatagacagccacctgacctccaattcgacatgccgatctatcaagtcgctaactga

SEQ ID NO: 3292 - DNA, 3018 bp, Unknown
  Bacillus sp. multi
atgccgtcaattgaggataccgcctatccaagactgaaatccaacccctcacagaaggaattacaggaactttacagcccgaccatcgaggagattcactggatgaagccccatgtcaagggcgacgttgcgaagctgggcgtgttcgtgcttctgaaaaccttccaaaggctcggctacttcctaccggtgaccgagataccggaggacattgtgattcatatcgctcaaaaaatgaacttgacattggtcagccgcaacgacttgcagaagtaccacaatagcggtactcaaaagcgtcaccacgcactcatacgtgaataccggaatatccacttcttcaatgaccaagcccgcaagatcatgattgacacgatgaatcaggtgagcagcactaaggacgactccgctgacttcatcaacgccgccattgacgagctaatccggcaacgcttcgaattgccgacattctcgacgctgaacgagaccgctaagcgtttgaggagccaatcttaccacgtagtttatgaacaagtgtaccagagcatcaacgaaaatgacaagaataagatagacagcctgttccagaccaacgatgggacagtttacactccgtggcaccacctcaaacaagatgccaagaaccccaccattaagcactttcgagagctggtgacccagatggagtggttaatggctcagaaggtcaacaccaccattcttaagtccatcccctcagtgaagattcgccaaatgaccagcgaggccaagactctcgacgcggccaggatgaagaagatggagcccaaaaaacgctacgccctggccttgagcttcatccagagccagttggcccacgttcttgacaacatcggggagatgatggtgaagcgaatgatgagtgcacgaaacaagtcacgggaccagttacagcattatcagatgaagaatcagaagcgaacggacctgctgataacaaccctgtacgatgtcatcctcgcataccggtctggaaatgagtctcaagacaagatggaggcgattgagcaagtggtcggaaaccgtcatgaggagatacttcacgactgtgagagtcaccttgcatatagtggagacaactacttcgtgttcgtttgggactattacaagtcctctcgatccacacttttcaagatcctaaacacggtatccctgcgttctacgaaccaggatcagggactggaagacgctatcgccttcctgaaaacccatcagaactcaaggaaggagtctctgtctatcgtatctatcgagaagaaagggtactggaaaaaggaaatcaagccactcctggatctcagttggattcccgacgcctggtggcgctggatcgctccaaaccgcaagagcggctgctatcctgaggaggtgaacagacggcacttcgaggcttgcgtcttcacacagattatgtggggacttaaatctggagacctgtacattgaaggatctgaaaagtatgcggactacaggcagcagctaatcagttggaacgaatatgagcagaagctactagacttctgccataagagcaacctccctagcacgggaaaggagtacgtcaagcagttgcggaaaaggttcatgaagattgccaagaagacagacgctagtttcccttacaataagcaagttcggattgagaacggggagatcgtgattgggaaatccaaaaaacgaaaacccagccctaaactgaaatcccttgaaaagtatatgactcaaaacttagtgccgatcaatgtccttgatatgcttggggacacagagcactggctaaactggacacgctttttcaaacccatctcgaagcacgaagcacgccttgaagaccccatcgagcggtatttgactaccgtattctgttacggatgtaatctagggccagtgcagactgctaggtcactagggaacatggatcgaaggcagatcagttgggtgaatcagcggcacatcactactgagaacttagaccaggctatccaattcattatcaattcttacaacaaattcggactacctaagtattggggcgacgggaagtctgcgtcggcggatgggacaatctgggcactttacgaacagaacttactaagtgagcggcatatcagatacggtggctatggaggaatcggctattaccacgtatcggataactacatcgcgttgttctcacacttcattccctgtggggtgtgggaggggttgtacatcctcgacgttctgatgaacaacaattccgagattcaacccgaggttatccactcggacacccagggacagtcagcaacaatcttcggtctaagcacactaatgggaattgagcttatgccaagaatccgaaactggaaagacttgaagatgttcagacctgacaaggagagccggttcaaacacatcgacgacatattcactgacgagatagactgggacttaattgagatccattacaaggatatgttgagggttgcgatgtccattgaagtggggaagataaccccgtcaacgatcctcaacaaactgggaacctatagcaagaagaataagctgtaccaggcgttccgtgagctaggccgagtaatacgaactatgttcctcctaaagtatatcgcagacgagcagctccggaggaccatacagactgctaccaacaaaagcgagtcctttaacggattcaccaagtggctgttcttcggtggggaggggatcataactgagaacaatagggaaaaccagaggaaagtcattaagttcaaccacctagtagccaactgcttgatattctacaacgtctttgccctaacgcaagttctgcacgcctatcgacaagacgggaacgagcttgacgaggaagtcctttcagaactttctccttacatcacagctcacgtgaaccgattcggaaagtacggcattgacccgaaccgccaaccaccagacctacagttcgacatgcccatctaccaagttgctaactag

SEQ ID NO: 3293 - DNA, 3018 bp, Unknown
  Bacillus sp. multi
atgccctccattgaggataccgcgtatcctagactgaaatccaacccctctcaaaaggaattacaggaactttactctccgaccattgaggaaatccactggatgaagcctcacgtgaaaggagatgtggcaaagctcggcgtcttcgttctcctaaagacctttcagcggctcggctacttcctgcccgtgaccgagatacccgaggacatcgtgatccacatcgcccaaaaaatgaacctgactttagtgtcacggaacgacctccagaaataccacaattcgggaactcagaaacgtcaccacgcgctcatcagggaataccgcaacatccacttcttcaacgaccaggctcgcaagattatgatcgacactatgaaccaagtgtctagcacaaaggatgattccgccgacttcatcaacgccgccattgacgagttgatccggcagaggttcgagttgcccacttttagcaccctaaacgagaccgcaaagcgccttcggtcccagtcgtatcatgtcgtttacgagcaagtgtaccagtctatcaacgaaaacgacaagaacaagattgacagtctattccagacaaacgacgggacagtttacacaccctggcaccatcttaagcaagacgctaagaaccctactatcaagcacttccgggagctagtcactcagatggagtggttgatggcccagaaggtgaacactacgattcttaagtcgataccgtcagtgaagattcgtcagatgacctccgaggctaagactcttgatgccgcccgtatgaaaaagatggagcccaagaagcgatatgcgctggctttatccttcatacagtcccagttggcccatgttcttgacaacatcggggagatgatggtgaaacggatgatgtctgctcgaaacaaatctagggaccaacttcagcattatcagatgaagaatcagaagcgtaccgacttgctcatcactacactttacgacgtgatcctcgcttatcgaagtggaaacgagtcccaagacaagatggaagccattgaacaagttgtcgggaacagacatgaggaaatcctacatgactgcgagagtcacttggcctacagcggagacaactacttcgttttcgtatgggactactacaagtcgtcacgctccaccctcttcaagattctcaataccgtgtctctaaggtcaactaatcaggatcaagggcttgaagatgcgattgcattccttaagactcaccaaaacagccgtaaggaatcactctcgatagtgtcaatcgaaaaaaaaggttattggaagaaggaaattaagcccctactggatctgagctggatacctgacgcatggtggcggtggattgctcccaaccggaaatccggctgctacccggaggaagtgaatcgacggcacttcgaggcttgcgtgttcacgcagatcatgtggggcctgaaatccggcgacctgtacatcgaagggagtgagaagtacgcagactacaggcaacagcttatctcatggaacgagtacgagcagaagctgcttgacttctgtcacaaatccaacctaccctccacgggaaaggagtatgttaaacaattgcgaaagcgattcatgaagattgccaaaaagactgacgctagtttcccgtacaacaaacaagtgcgaatcgaaaatggagaaatagtgatcggcaagagcaagaagcgtaagccgagcccgaagctaaagagccttgagaagtacatgacccagaacttagtacccatcaacgtgctagacatgctaggggatacagagcactggctgaactggacgaggttttttaaacctatctcaaagcacgaggctcgattggaagaccccatcgaacgttaccttacaactgtgttctgctatggttgcaacttgggccccgttcagactgctagatcactgggaaacatggatcggaggcaaatctcatgggtgaatcagagacacatcactacggagaacttggatcaagcgatacagttcatcatcaactcctacaacaaattcgggctgccgaagtattggggagacgggaagtcagcttccgccgacggcacaatctgggccttgtacgagcaaaacctgcttagcgaacggcacatacggtacggtggatatggtgggattggctactaccacgtttcagataactacatcgcgctgttctcccactttatcccttgtggggtttgggaaggactctatatcctggacgtcttgatgaacaataactctgagattcaaccagaggtgatccactcggatacacagggacagagtgctaccatcttcgggctttccacgcttatgggaatcgaactgatgcccaggataaggaactggaaagaccttaagatgttccgaccggacaaggaatcccggttcaagcacatcgacgacatattcaccgacgaaatagactgggatctgatcgagattcactacaaggacatgctgagggtcgccatgtctatcgaagttggcaagatcaccccttctaccatactgaacaaacttggaacctactccaaaaagaacaagctgtaccaggcttttagagagttggggagggtcattcggaccatgttcttgttaaagtacattgcagacgaacaattgcggcgcaccatccagacggcaacaaacaagtccgagtctttcaatgggttcactaaatggctattcttcggaggcgaaggaatcatcaccgagaacaacagggaaaatcagaggaaggttattaagttcaaccacttggtcgcaaactgcctgatattctacaacgtcttcgccctgactcaagtattacatgcctacagacaggatgggaacgagcttgatgaggaggtgctgagcgagttgagcccttacataaccgcgcacgtgaaccgcttcggcaagtacggaattgatcccaacaggcaaccgcccgacctacagttcgacatgccgatctatcaagtcgctaactag

SEQ ID NO: 3294 - DNA, 3018 bp, Unknown
  Bacillus sp. multi
atgccgagcattgaagacaccgcctatccaagactaaagtccaatcccagccaaaaggaactacaggagctttactcaccaacgattgaggaaattcactggatgaagcctcacgtcaaaggagatgttgctaagctcggcgtgttcgttctcctaaagacgtttcagcgactgggctactttctacctgtcaccgagataccagaggacattgtgattcatatcgcccagaagatgaatctcaccctcgtgtctaggaacgacctccagaaataccacaacagcggaacacagaagcgtcatcatgccctcatacgggagtaccggaacatccattttttcaacgaccaggctaggaagattatgattgataccatgaatcaggtgtctagtacgaaagatgattccgccgacttcatcaatgccgcaattgacgagctgatacgtcaaagattcgagctgccaacattcagcaccctgaacgagaccgccaagaggctgcgaagccagagctatcacgtagtatatgaacaagtatatcagagcatcaacgagaacgacaagaacaagatagactcacttttccaaacaaacgacgggaccgtttacactccgtggcaccacctcaaacaagatgccaagaatccaactattaagcactttcgggaactcgtgacgcagatggaatggttaatggcacagaaggtgaacacgacaatactcaagtccatcccatctgttaagataaggcagatgacttctgaggccaagaccctcgacgccgctcgtatgaagaagatggagcccaaaaagcgatatgcgttggcactcagctttatccagtcccaacttgcccacgttcttgacaacatcggggagatgatggtgaagcgcatgatgtccgctaggaacaagtcacgggaccagttgcagcactatcagatgaaaaatcagaaacgcacggatctgctcatcacgactctatacgatgtcattctcgcataccgctcaggcaacgagtcccaagacaagatggaggccatcgaacaagttgtcgggaaccggcacgaggaaatccttcacgactgtgagtcccatctggcttactcgggagacaactatttcgttttcgtctgggactactacaagtcaagcagatcaacgctgttcaagatacttaacactgtctcactgcggtcaactaaccaggatcagggcctcgaagatgcaatcgccttccttaagacccaccaaaactcccgaaaggagagcttatcaatagtgtctattgaaaaaaagggatactggaagaaagagatcaaaccacttctcgacctgagttggattccagacgcatggtggagatggatcgcaccaaaccgaaagtcgggctgttacccagaggaggtgaaccgaagacactttgaggcttgcgtgttcacccagataatgtggggacttaaaagtggagacctctacatcgagggaagtgagaagtatgccgactaccggcagcagttgatctcgtggaatgagtacgagcagaagctattggacttttgccataagtcgaatcttccatcaaccggcaaggagtacgtcaagcaacttcgaaagcggttcatgaagatcgccaagaagacggacgcctcgtttccctacaacaaacaagtacgaattgaaaatggggagatcgttattggaaagagcaaaaagcgaaaaccttctccgaagctcaaatcacttgagaagtatatgacgcagaacttagtgcccatcaacgttctcgacatgcttggagacacagagcactggttgaactggacaaggttctttaagcccatctctaagcacgaggctcgcttggaagaccctattgaacgctaccttactactgtgttctgttacggatgcaatctggggccagtgcaaaccgcccgctctttgggcaacatggaccgtcgtcaaatcagttgggtcaaccagcggcacatcaccactgaaaacttagaccaggccattcagttcatcatcaactcatacaacaaattcgggttgccgaagtactggggtgacggcaagtcggccagtgctgatgggaccatctgggcgctatatgaacagaacctcttgagtgagcgacacattcgttacggtggttacggcgggattggctactaccacgtttccgacaactacattgccctattctctcacttcattccctgcggggtgtgggagggattgtacatcctcgacgtccttatgaacaataacagtgagatccaacctgaggtgatccatagtgatactcagggacagtccgcaaccatcttcggactttcaacactgatgggaatcgagttgatgcccaggatcaggaattggaaggacttgaaaatgtttcgtcctgataaggagtctcgcttcaagcacattgatgacatattcacggacgagatcgactgggatctaatcgagattcactacaaagatatgctgagggtggctatgagcatcgaggtggggaagataacgcccagcaccatcctgaacaaattgggcacttacagcaagaaaaataagctctaccaggcttttcgtgagctggggcgtgtcattcgcactatgttcttactcaagtatatcgcagacgagcagcttagacgcacaattcagacagctacaaacaagtcagagagctttaacggattcacaaaatggttattcttcggtggcgaagggataattaccgagaacaacagggaaaatcagaggaaggtcatcaagttcaaccacctagttgccaactgcctgatattctacaatgtcttcgctctcacccaagttctccacgcttaccgccaggatggaaacgagcttgacgaggaggtgctgagtgaattgagtccctacatcaccgctcatgtcaatcgcttcgggaaatacggaatagacccaaacagacagccgccagaccttcagttcgacatgcctatctatcaagttgccaactag

SEQ ID NO: 3295 - DNA, 1464 bp, Unknown
  Bacillus sp. multi
ctgattaccagccggaagatccgtctctccatcgttagcgacaactccaccgaggcttacaacttcatccgcaaggagatgcgggagcagaacaaggcgcttaatgtggccatgaaccacctgtacttcaactatgttgcaaggcagaagatcagcttcgctgacaaggcttaccagcacaagctcaacaaagcgatagaggcccagcagaagtccttcatcctactcaaggaattggagcagaaacaaatcgtggagaccgactccagcaagaaatccattctcaaggagcgcctcatcaagtccaagaccacgtacgagaaaactaaggagaagctcagtagcctccgtaaggctaggaacaaggaacttttccaagagtacaacaacatgattgggcaacttgaggagacccacttacgggatattgtgagcagccagtttaacttgctcagcgacacgaaggaccgccttaccaagatcgcctaccaggacttcaagaacgatattacagaggtcttaagtggggaccgtagtctccggacatacaagaaaaataacccgctctatatccgaggacgtacgcttaacctgtttaaggagtctgaggagttttttattaagtggaccaaaaagatcgtctttaagtgtgtgctcggcgtgaagtaccaaaacaaaaccgaactgtacaagactctggagtgcatccttactggtgaatacacgctttgcgattctagtatgaacttcaatcagcagaacaagctgatactgaacttggcattgaacatcccggagaagtcggagaacaggaaggtgccaggacggattgcgggaattgacctgggattgaagatccctgcctacttcgccgtcaacgacgtgccttacatccggaaagctcttggaaagatcgaagacttcctcaaagtccgtacgaacatacaatctcaaaagcgttccctccagagggccttgcaatctagcaagggcggaaaggggcgcaaaaagaagctcaaggcactggaccaattcaaggagaaggagaagaactacattatcacctacaatcacttcatatccaaaaagatcatctctctggcagtgcaatacggggtggagcagattaacctggaacttctcacactcaaggagactcagaagaaatccctcctgcgtaactggagctattaccaactacagcagttcattgagtacaaggcgaaccgcgaggagatcagcatcaagtacgtggacccattccacacatcgcagacctgctccaagtgtgggcattacgaggatggccagcgtgagaaacaggataccttctgctgcaagtcatgcgggttcattgacaacgctgactacaacgccgcccgcaacatcgcagcatccacccggtacatcaccaacaaggaggagtcggagtattaccgcaaaaacaataacgagatagcctga

SEQ ID NO: 3296 - DNA, 1464 bp, Unknown
  Bacillus sp. multi
ctgattacatcgcggaagatccgcctcagcatcgtgtcagacaattccaccgaggcgtacaacttcattcgtaaggaaatgcgcgagcagaacaaggcgcttaatgtcgccatgaaccacctctacttcaactacgtcgcaaggcaaaaaatctcattcgcagacaaggcgtaccaacacaagctgaacaaggctatcgaggcccagcagaagtccttcatcctgctcaaggagctggagcagaagcagatcgttgagacggactccagcaaaaagtccatcctgaaagagcgtctcattaagagcaagaccacctacgaaaaaacgaaggagaaactgtcttcgctccgtaaggcgaggaacaaggaacttttccaagagtacaacaacatgatcgggcagttggaggagacccaccttcgggatatagtgtccagtcagttcaacctactttcagacaccaaagacaggctgacgaagatcgcctaccaggacttcaagaacgacattactgaggtgctgagtggcgacaggagtcttcgcacttacaagaagaacaatcccttgtacatccgtggacggacacttaacctcttcaaggagagtgaggagtttttcatcaagtggaccaaaaagatcgtcttcaaatgcgtgttgggagtgaagtaccagaacaagacagagctttacaagaccctggagtgcattctgactggcgagtatacactttgcgattccagcatgaacttcaatcagcagaacaaactaatccttaacttggcccttaacatacccgagaagtcggaaaaccgcaaggtgccggggcggatagcggggattgatctgggcttgaagattcctgcgtacttcgcggtcaacgacgttccctacatcagaaaagcactcgggaagatcgaggacttccttaaagttcggaccaacatccagtcccaaaagcggtcattacaacgggccctacaatcctctaagggcggcaagggacgcaaaaagaagctcaaggccctcgaccagttcaaggaaaaggagaagaactacattatcacttacaaccacttcataagcaagaagattatctcgctggccgtgcagtacggcgtcgagcagatcaacttggaactgctaacccttaaggaaacacagaagaaatcactgcttcgcaactggagctactaccaattgcaacaattcatcgagtacaaggcaaacagggaggaaatcagcatcaagtacgtggacccattccatacctctcagacctgtagtaagtgcgggcactacgaggacgggcaacgggagaaacaggatacgttctgttgcaagagctgcggcttcattgacaacgccgactacaacgcggccagaaacatcgccgcaagtacccgctacatcacaaacaaggaggaatctgagtattaccgcaaaaacaataacgagatcgcctga

SEQ ID NO: 3297 - DNA, 1464 bp, Unknown
  Bacillus sp. multi
ctcatcacttcccgcaagatccgattgtccatcgtgtcagacaactcaaccgaagcctacaacttcatccgtaaggagatgagagagcaaaacaaggcccttaacgttgcgatgaaccacctctacttcaactacgtggcccgccagaagatatcctttgccgacaaggcgtaccagcacaaactcaacaaggcaattgaggcccagcagaaatcattcatcctgcttaaggagttggagcagaagcagatcgttgagaccgactccagcaaaaagtccatactcaaggaacgtctcatcaagtcgaagaccacctacgagaaaactaaggagaagctgagttcattgaggaaggcgcgcaacaaggaactgttccaggagtacaacaacatgatcggtcagttggaggagacccacttgcgcgacatcgtgtcctcccagttcaacttgctctccgatacgaaggacagacttaccaagattgcgtaccaggacttcaagaacgacatcacagaagtgctgagcggtgacaggagcctccgtacctacaagaaaaataaccctctctacatcaggggtcgaactcttaacctgttcaaggagagcgaggagttttttatcaaatggaccaaaaagatagtctttaagtgcgtcctcggcgtgaagtatcagaacaagaccgaactatacaagactcttgagtgcattcttaccggcgagtataccctttgcgattcgtcgatgaacttcaaccagcagaacaaactgatcctgaacctggccctgaacattccggagaagtcggagaacaggaaggtgccaggacgtatcgctggaattgacctcggccttaagattccagcttacttcgcggtgaacgacgtgccctacattcgtaaggctctcggcaagatcgaggacttccttaaggtcaggacgaacattcagagtcagaaacggagtctccagagggcacttcagtccagcaagggtgggaaggggcgcaaaaaaaaactaaaggctctcgatcagttcaaggagaaggagaagaactatatcattacatacaaccacttcatctccaagaaaatcatctccctggccgtgcaatacggggtcgagcagatcaacctagagttactcacattgaaggaaactcagaagaagtcgctgctccgtaactggagctactaccagctacagcagttcattgagtacaaggccaaccgggaggagatcagtattaagtacgtggacccgttccatacgtctcagacctgctcaaagtgcggtcactacgaggacggtcagagggagaaacaggacacattctgctgcaaatcttgtgggttcattgataacgccgactacaacgccgcccgcaacatcgcagcctcgacgcgctacattacaaacaaagaggaatcagagtactaccgcaagaacaacaacgagattgcctga

SEQ ID NO: 3298 - DNA, 1464 bp, Unknown
  Bacillus sp. multi
ctaatcacgtcccgcaagatccgtctatccatcgtgtcagacaatagcaccgaggcgtacaacttcatccgcaaggagatgagagagcaaaacaaagccctgaatgtggcgatgaaccacctgtacttcaactacgtggcccgccagaagatctcattcgccgacaaggcgtaccagcacaaattgaacaaagccattgaggcccagcagaagtccttcatccttctcaaggagctggagcagaaacagatcgtcgagaccgactccagcaaaaagtccattctcaaggagcggcttattaagtccaagacaacgtacgaaaaaactaaggagaaactctcgtccctgcggaaggctaggaacaaggagctgttccaagagtacaacaacatgatcgggcagctagaggagacccacctcagggacatcgttagctcacagttcaacctgctgtccgacactaaggacaggctgactaagatcgcatatcaagactttaagaacgacatcacagaagttctgagtggggaccgtagcctcaggacttacaagaaaaacaatccactgtacatacgcgggagaacactaaaccttttcaaggagagcgaggagttttttatcaaatggaccaagaaaatcgtctttaaatgcgtattgggtgtgaagtatcagaacaaaaccgagttgtacaaaactttggagtgcatactgaccggggagtacacactctgcgatagtagcatgaacttcaatcagcagaacaagctcatcctaaacctggccctcaacattcccgagaagtctgagaacaggaaggtgccgggccgcatcgcgggaattgacctggggcttaagatccctgcatacttcgcggtgaatgacgtgccgtacataaggaaggctcttggcaaaatcgaggacttcctcaaggtccgcaccaacatccagagtcagaagcggtccctccagcgggcgctccagtccagtaaaggcggaaagggacgcaagaaaaaactcaaggctctggaccagtttaaggagaaggagaagaattacatcatcacatacaaccacttcatcagcaagaagatcatctcactggctgtgcagtacggggttgagcagatcaatctggagttgctgaccctcaaggagacacagaagaagtctctgctgaggaattggagctactatcaattgcaacagttcatcgagtacaaggccaacagggaggagatcagtatcaagtacgttgatccgttccacacctcgcagacttgttctaagtgcggccactatgaggacggccagcgcgagaaacaggacaccttctgctgcaagagctgcgggttcattgacaatgcggactacaacgcagccaggaacatcgccgcctctacccgctacatcaccaacaaggaggagtctgaatattatcgcaaaaacaacaatgagattgcgtga

SEQ ID NO: 3299 - DNA, 1464 bp, Unknown
  Bacillus sp. multi
ctcatcacatctcgcaagataagactgtccattgtgagcgacaacagcaccgaggcttacaacttcatccgtaaggagatgcgcgagcagaacaaggctcttaacgtggccatgaaccacttgtacttcaactacgtggctcgccagaagatatccttcgcagacaaggcgtaccagcacaagctaaacaaggcaattgaagcgcagcagaagtcattcatcctcctcaaggaacttgaacagaagcagatcgtggagaccgactctagcaagaaatccatactcaaggaacgccttattaagagtaaaaccacgtacgaaaaaactaaggagaaactgtcctcgctccgaaaggcccggaacaaggagttgttccaagagtacaataacatgatcggacagctagaggagacccacctacgggatattgttagttcccaattcaacttactgagcgacacaaaggaccgtcttaccaagatcgcgtaccaagactttaagaatgacattacggaggtgctatcgggcgaccggagcctgaggacatacaaaaagaacaatccactctacattcgcggccgtaccttaaacttgttcaaggagagtgaggaattcttcattaagtggaccaagaagatagtcttcaagtgcgtgttgggtgtgaagtaccaaaacaagactgagttgtacaagaccctggagtgcattcttacaggggaatatacactttgcgacagctccatgaacttcaatcagcagaacaagctcatcctgaaccttgcactcaacatcccggagaagtctgagaaccgaaaagtgcctgggcggatagcgggaatagacctgggactcaagatccccgcatacttcgccgtgaacgacgtaccctacatccggaaagcactgggcaagattgaagatttcctcaaggtgcgaacaaacattcagtcacagaagcggagcctccagagggctcttcagtctagcaaaggcggcaaggggcgcaaaaagaaactcaaagccctggaccagttcaaggagaaggagaagaactatatcatcacatacaaccacttcatctccaaaaaaatcatcagtctggcggtgcagtacggtgtcgagcagatcaaccttgagttgctgacattgaaggagacccagaagaagtctctcctccgtaattggagctactatcagcttcagcagttcatcgagtacaaggcgaaccgggaggagatcagtatcaagtacgtggacccgttccataccagccagacatgctccaagtgcgggcattacgaggacggccagagggagaaacaggacaccttctgctgcaagtcctgcggcttcattgacaacgccgactacaacgctgcccgcaacatcgccgccagcacccggtacatcaccaacaaggaggagtcagagtattaccgcaaaaacaataacgagattgcttag

SEQ ID NO: 3300 - DNA, 1464 bp, Unknown
  Bacillus sp. multi
cttattacatccaggaagattcgactcagcatcgtttccgacaactctacggaggcgtacaacttcatccgtaaggaaatgcgtgagcagaacaaggcgctcaacgtggcgatgaaccacctttacttcaactatgtggcccgacagaagatttcctttgcagataaggcgtaccagcagaagctaaacaaggccatcgaggcccaacaaaactcattcatcttgctcaaagagctagagcagaagcagatcgctgagactgattccagcaaaaaatccatcctcaaggagcgactcatcaagtcgaagaccacgtacgaaaaaacgaaggagaaactgtcgtccctccgcaaggctaggaacaaggaattgttccaggagtacaacaacatgatcgggcaattggaggagacacacctcagggacattgttagttctcagttcaacttgctctccgacactaaggaccgacttactaagatagcctaccaagacttcaagaacgacatcacggaggttctgagcggggaccggagtcttcgcacctacaagaaaaataacccactctacatccgtggacgtaccctgaacttgttcaaagagtcggaggagtttttcatcaagtggaccaagaagattgtcttcaaatgcgtcctcggcgtgaagtaccagaacaaaaccgagttgtacaagacacttgagtgcatacttacaggcgagtatacactttgcgattcatctatgaactttaaccagcagaacaaactcatccttaatctcgcactcaacatccctgagaaatctgagaacaggaaagtgcccggccggatagctggcattgatcttggtcttaagatcccggcatacttcgccgtcaacgacgtcccgtacattcgaaaggccctcggcaagatcgaagacttccttaaagtccgcacaaacatccagagtcagaagcgcagcttgcagagggcactccagtcctctaagggcgggaagggccgcaaaaagaagctcaaggcccttgaccagttcaaggagaaggaaaaaaattacataacaacctacaaccacttcatctccaagaagatcatctccctggccgtgcaatacggcgtggagcagatcaatcttgaacttctcaccttgaaggagacccagaagaagtcactcctgagaaactggagctactatcagcttcagcagttcatcgagtacaaggcaaaccgcgaggagatcagtatcaagtatgtggacccgttccacacctcccagacttgttctaagtgtggccattacgaagatggtcaacgcgagaaacaagacactttctgttgcaagagctgcgggttcatcgacaacgccgactacaacgccgctaggaacatcgcggcctccactcggtacatcaccaacaaggaggagggcgaatattgtcgtaagaacaacaacgagatcgcttaa

SEQ ID NO: 3301 - DNA, 1464 bp, Unknown
  Bacillus sp. multi
cttatcacctcccggaagatccgactgtctatagtctcggacaactctaccgaagcctacaacttcattcgtaaggagatgcgcgaacaaaacaaggcgcttaacgtggcgatgaaccacctatacttcaattacgtggcccgccagaaaatctcattcgctgacaaagcctaccagcaaaagctcaacaaggcaatcgaggcccagcaaaactccttcatcctgctcaaggagcttgaacagaagcagattgccgagactgacagctccaaaaaatccatacttaaagagcgtctgattaagtcgaagaccacctacgagaaaactaaggagaagctaagctccctccgtaaggccaggaacaaggaactgtttcaagagtacaacaacatgattggtcaactggaggagacccacctgagggatatagtgagtagccagttcaacctgctgtccgatacgaaagatcgcttgactaagattgcgtaccaggacttcaagaatgacattacagaggtgctcagcggagaccgcagcctgcgaacgtacaagaagaacaacccgctctacatcaggggcagaactcttaacctattcaaggagtcggaggaattctttattaaatggaccaagaagatagtcttcaaatgcgttctcggtgtgaagtaccagaacaagaccgaactctacaagacgctagagtgcatcttgactggtgaatacactctatgtgattcgtccatgaacttcaaccagcagaacaagctcatcctcaacctcgctcttaacatccccgagaagtctgaaaacaggaaagttccgggtcgtatcgctgggatcgacctcgggttgaaaatccctgcttacttcgctgtcaacgacgttccctacatcaggaaggctctggggaagatcgaagacttccttaaggtccgcaccaacatccagtcacagaagcggtcactccagcgcgccctccagagtagcaagggtggcaaaggccgcaagaagaaactcaaggccctcgatcagttcaaggagaaggagaagaattacatcacgacttacaaccacttcattagcaagaaaattatcagcctcgcagttcagtatggagtagagcagatcaacttggagctactgaccttgaaggagacacaaaaaaaatctctattaaggaactggtcttattaccaactacagcagtttatcgagtacaaggcaaaccgggaggagataagtatcaagtacgttgaccctttccacacatcccaaacatgctctaagtgcgggcactacgaggacgggcaaagggagaagcaagacactttctgttgcaagagctgcgggttcattgacaacgctgactacaacgcggctaggaacattgccgcatcaacccgctatatcaccaacaaggaggagggcgagtactgtcgcaagaacaataacgagatcgcatga

SEQ ID NO: 3302 - DNA, 1464 bp, Unknown
  Bacillus sp. multi
ctcataacttcgcgcaagatcaggctctctatcgtctcagacaactcgaccgaggcttacaacttcatccgcaaggaaatgagagagcaaaacaaggcactcaacgtcgccatgaaccacctctacttcaattacgtggcaaggcagaagattagcttcgccgacaaggcttaccagcagaagctcaacaaggccattgaagcccagcagaactcgttcatcctcctcaaggagttggagcagaagcaaatcgctgagaccgactcttccaagaagtctattctaaaggagcgtcttatcaagagcaaaaccacctacgagaagaccaaggagaagctgtcctccctccgcaaagcccggaacaaggaactgtttcaagagtacaacaacatgatcggccagttggaggagacccacttgcgcgatatagtatcttcccagttcaacttgctctctgataccaaagacaggctgacgaagattgcgtaccaggacttcaagaacgacatcaccgaggtgctgtcaggagacagatccttgaggacatacaagaaaaataatccactctacattcgcggtcggactctaaacctctttaaggagtccgaggagtttttcataaagtggaccaaaaaaatcgtcttcaagtgcgtcctgggagtaaagtaccagaacaagaccgagctttacaagactttggagtgcattctgacaggggaatacacactgtgtgactcgtccatgaacttcaaccagcagaacaagctgatccttaaccttgccttaaacattcccgagaagtccgagaaccgcaaggttcccggccgaatcgccggaattgatctcggccttaagattccagcatacttcgctgtcaatgacgtgccctacattcgtaaggcgttggggaagatcgaagacttcctgaaagttcgcaccaacatccagtcccagaagcgctcattgcagcgtgcccttcagtcatcgaagggtgggaaggggcgcaaaaagaaactaaaagcacttgaccaattcaaggaaaaggagaagaattacataacaacctacaaccacttcatatccaaaaaaataatctccctggccgtgcagtacggagttgagcagatcaacctggaattgctgactcttaaggaaacacagaagaaatctctgctgagaaactggtcttactaccagctccagcagtttatcgagtacaaggccaatagggaggagatttccatcaagtatgtggacccattccatacctcccagacttgttctaagtgcgggcactacgaagacggacagagggagaaacaagataccttctgctgcaagagctgcgggttcatcgacaacgccgactacaatgcggctaggaacatcgccgcaagcactcggtacatcaccaacaaggaggagggcgagtactgccgtaagaacaacaatgagatcgcctag

SEQ ID NO: 3303 - DNA, 1464 bp, Unknown
  Bacillus sp. multi
ctaattacctcccgtaagatacggctctcaatcgtgtcggataactccaccgaggcgtacaacttcattcgtaaggagatgagagagcagaacaaggcgctgaacgtcgccatgaaccacctgtacttcaactacgtcgcacgccaaaaaatctccttcgctgacaaggcttaccagcagaagctcaacaaggccatcgaggcccagcagaactccttcatattactcaaagagcttgagcagaagcagatagcggaaaccgattcgagcaaaaagtccattctcaaggagcgacttatcaagtctaagaccacctacgaaaaaactaaggagaaactcagttcactccgtaaagcccgcaacaaggagttgttccaggagtacaacaacatgatcggacagttggaggaaacgcacctccgcgatattgtgagtagccagttcaaccttctgagtgacacgaaggaccgactgaccaagattgcctaccaagactttaagaacgacattacagaggtgctcagtggggaccgatccctcaggacgtacaaaaagaataaccccttgtacatccgagggaggactctcaaccttttcaaggagtctgaggagttttttatcaagtggaccaagaagattgtcttcaagtgcgtgcttggtgtgaagtaccaaaacaaaacggagctgtacaagacccttgagtgcattcttaccggggaatataccctgtgtgactcctctatgaacttcaaccagcaaaacaaactaattcttaacctcgccctaaacattccggagaagtctgaaaacaggaaggtgcctgggcgaatagctggtattgatcttggattgaagatcccggcatacttcgccgtgaacgatgtaccctacatccggaaggcgctggggaagatcgaggacttcctcaaggtgcgtacgaatatccagtcccaaaagcggtctttacagagggccttacagtccagtaaaggcgggaaggggcgcaaaaagaaactaaaggcgctggatcagttcaaggagaaggagaagaactatatcacaacctacaaccactttatcagcaaaaagatcatctcactcgctgtgcagtacggagtggagcagataaacctcgaattgcttactctcaaggagactcagaagaaatcactgttgagaaattggtcgtactatcagcttcagcagttcatcgagtacaaggctaaccgtgaggaaatcagcatcaagtacgtggacccgttccacacctctcagacgtgctccaagtgtggtcactacgaggacggacagagggagaagcaagataccttctgctgcaagtcctgcggcttcattgacaacgcggactacaatgcggcccggaacatcgccgcgtccactcgctacatcaccaacaaggaggagggcgagtactgccgcaaaaacaataatgagatagcctag

SEQ ID NO: 3304 - DNA, 1464 bp, Unknown
  Bacillus sp. multi
ctcatcaccagccgaaagattcgcctgtccatcgtcagcgacaactccaccgaggcgtacaacttcatccgcaaggagatgagagagcagaacaaggccctcaacgttgcgatgaaccacctctacttcaactacgtcgcccggcagaagatatcctttgccgacaaggcttatcagcagaaactcaataaggccatcgaggcccagcagaacagcttcatccttctcaaggagctggaacagaaacagatcgccgagaccgactcatccaagaagtccatcctcaaggagcgtcttatcaagtctaagaccacttacgagaaaactaaggagaaactctcctcacttcgcaaggccagaaacaaggaactattccaagagtacaacaacatgatcggacagctagaggagacccacctgagagatattgttagttcgcagttcaacctcctctcagacacgaaggacagactcactaagattgcctaccaggacttcaagaacgacataaccgaagttctgtctggggaccgctccctcagaacgtacaagaaaaacaacccgctgtacatcagaggtcgtactctcaaccttttcaaggagtctgaggagttttttatcaagtggaccaaaaaaatcgtcttcaagtgcgtgctcggtgtgaagtaccagaacaagaccgaactgtacaagacacttgagtgcatcctgacaggagagtacactctgtgcgactcctctatgaacttcaatcagcagaacaagctcatcctgaacttggcccttaacatacccgagaaaagtgaaaatcgaaaagtgcccggccgaatcgctggcattgacctgggtctaaagattccagcttacttcgcagtcaacgatgtcccgtacatccggaaggctctagggaagatcgaagacttccttaaagtccgtaccaacattcagagccagaagcggagcctccagcgcgctctccagagtagcaaaggcggaaaaggccgcaagaagaagctcaaggccctggaccagttcaaggagaaggaaaaaaattacatcacgacatacaaccacttcatctccaaaaagatcatctcactggcagttcagtacggggtcgagcagatcaacctggaattgctgacactcaaggagacgcagaagaaatcactcctccgcaactggagctactaccagcttcagcagttcatcgagtacaaggctaaccgtgaggagattagcatcaagtatgttgatccctttcacacaagccagacctgctctaagtgcgggcactacgaggacggccagagggagaaacaggacactttctgctgtaagagctgtgggttcattgacaacgctgactacaacgcagcccgtaacatcgccgcttcgacccggtacattaccaacaaggaggaaggagaatactgccgcaaaaacaataacgagatcgcctga

SEQ ID NO: 3305 - DNA, 1461 bp, Unknown
  Bacillus sp. multi
ctaatcacctctcgaaagatccgactctccatcgtgtccgacaacgccgccgaagcgtacaacttcatacgaaaggaaatgcgcgagcagaacaaagccctcaacgtcgccatgtcgcacctgtactttaactccatcgccaggcagaagattctgttggccgacgaagcctatcagcagaagctcaaggacgcgatcaactcccaggagaaatccttcaacacacttaaggagctggagcgtaaacagtgcatcgaaggtgacagtgaaaaaaaacagaccctcaaggagcggctcatcaagacccagaacgcctatgagaagtcgaaggaaaaggtgtcaaatctgcgaaagtccaggagcaaagacagcttccaagagtacaacaatatcatcgggcaagtcgagcagacccacctgagggacgtgattagcagccagttcaaccttcactccgacacgaaagacaggcttacgatgatcgccaatcaggacttcaagaacgacatcggggaggtgctgagcgggaattgttccttgagaacctacaagaagaataacccgctctacattcgtgggcgcaacacagtcctctacaaagagggcaacgagtttttcatcaagtggatcaagggcatcgtattgaagtgcattctaggagtcaagaatcagaacaagactgagttgtacaagacactggagtgcgttctcgccggggtgtacaagatttgcgatagtagcatgaacttcaatcagcaaaacaagctgatactgaaccttgctcttaacatgcccgacaagagcgaaaacaagaaagttcccggccggatagctggaatcgacttggggttgaagatccccgcatacttctccgtcaacgacgcaccgtacatccgtaaggggattgggaagattgaagacttcctcaaagtgcgtacttccatccagtcgcagaaacgctcgcttgaacgggccctacagtcctcgaagggcggcaaagggcgcaaaaagaagctcaaggctctaaatcagttcaaggagaaggagaagtcctacgtgaccacatacaaccacttcatctccaaaaagatcataagcctcgcaatccagtacggcgttgaaaggatcaacctggagttgctcaccctcaaggagacccagaagaaatcgctgctccgaaattggtcctactatcagctccaacagttcatcgagtacaaagccaacagggagggaatccttattaagtacgttgacccgttccacacctcacagacgtgcagcaaatgcgggcactacgaggacggacagcgtgagaaacaagataacttccactgcaaaagctgcgggttcaaggagaacgcagactacaacgcagccaggaacatcgctaagtcaactaactacattaccaagaaggaagaatcagagtactacaagcgtaacaatgagatagcctga

SEQ ID NO: 3306 - DNA, 1461 bp, Unknown
  Bacillus sp. multi
ctcatcacctcccgtaagatacgcctcagcatagtgtcagacaacgcagcggaggcgtacaacttcatccgcaaggagatgcgggagcagaacaaggccctcaacgtggccatgtcccacctctacttcaacagcatcgcccgccagaagattcttctcgcagacgaggcttatcaacagaagctcaaagatgctatcaactcccaggagaaatctttcaacaccctcaaggagttggaacggaagcagtgcattgagggcgactccgagaagaaacaaactctcaaggaacgcctgattaagacacagaacgcatacgagaagtcaaaagaaaaggtgagtaacctccggaagtcaaggtctaaggacagtttccaggagtacaacaatatcattggtcaagttgagcaaacccacctaagggacgttatatcaagccaattcaacctgcactccgacacaaaagacagactcacaatgatcgctaaccaggacttcaagaacgacattggcgaggtcttgtccggaaattgttcattacgcacctacaagaaaaataatccgctctacataagagggcgcaacactgttctgtacaaagaggggaacgaattctttattaagtggattaaggggattgtgctcaagtgcattctgggagtcaagaatcagaacaaaaccgaactgtacaagaccttggagtgtgttttggcaggggtttacaagatctgcgactctagtatgaacttcaaccagcagaacaaactcatccttaacctggctctcaacatgcctgacaagtccgaaaacaagaaagtgcctggccggatagccgggatcgacttggggctcaagatacccgcctacttcagcgtgaacgacgcaccctatatcaggaagggaatcggaaagatcgaggacttccttaaggtccgcacttcaattcaatcacagaagcggagccttgaacgagctttgcagtcttcaaaagggggaaaggggcgtaaaaagaaactcaaagccctgaaccagttcaaggagaaggagaagtcttacgtgacgacgtacaaccacttcatctccaagaagatcatttccctcgccatacagtacggcgtggaacgtatcaaccttgagctgctaactttgaaggagacccagaagaaatccttactacgaaattggtcttactaccagcttcagcagttcatcgagtacaaggcgaaccgcgagggcattctaatcaagtatgtggaccccttccacacaagccagacgtgcagtaagtgcggccactacgaggacgggcagagggagaaacaggacaatttccactgcaaatcttgcggattcaaggagaacgcggactacaacgctgcccggaatattgcaaaaagtacaaactacatcaccaagaaagaggagtcggaatattataagcgcaacaacgagattgcctag

SEQ ID NO: 3307 - DNA, 1461 bp, Unknown
  Bacillus sp. multi
ttaatcacttcaaggaagatccgtctgtcaatcgtcagtgataacgccgccgaggcgtacaacttcatccgcaaggaaatgcgcgagcagaacaaagcgcttaatgtggccatgagccacctctacttcaatagcatcgcccgccagaaaatcttgcttgctgacgaggcttaccagcagaagctcaaggacgccatcaactctcaggaaaagtctttcaacactctcaaggaactggaacgcaagcagtgcatcgaaggcgactcggagaagaaacagacgctcaaggaaaggctcatcaagacccagaacgcctacgagaagtcaaaggagaaggtgtccaacttgaggaagtcgcggagcaaggactccttccaagagtacaacaacataattggacaagttgagcagactcacctgagggacgtgatctccagccagttcaatctgcactcggatacgaaagatcgcttgacgatgatcgccaaccaggacttcaagaacgacattggcgaggtgctaagcgggaattgttccctgcgaacatacaagaagaacaatccgctgtacattagaggtcgcaacacagtgctgtacaaggaggggaacgaattctttatcaagtggatcaaggggatcgtcctaaagtgcatcctgggtgtcaagaaccagaacaagacggaactttacaagaccctggagtgcgtgttggctggggtttacaagatatgtgacagctcgatgaacttcaatcagcagaacaagctcattcttaaccttgcactgaacatgcctgacaagtccgagaacaagaaggttcctggacgtatcgccggaattgatctgggacttaagattccggcctacttcagcgtgaacgacgcaccgtacatcaggaagggcatcgggaagatcgaggacttccttaaggtccgtacctcaatccagtcacagaagcgctctttggaacgcgccttgcagtctagcaagggaggaaaaggtcgcaagaaaaagttgaaggcccttaaccagttcaaggagaaggagaagtcatacgtgaccacctacaatcactttatctccaagaagatcataagcctcgccatccaatatggggtcgaaaggataaacctcgaattgcttaccttgaaggaaacgcaaaaaaaatcactcctccggaactggtcctattaccaattacagcagttcatcgagtacaaggccaacagggagggcatccttattaagtatgttgatcctttccacactagccagacatgctccaagtgcgggcactacgaggacgggcagagggagaagcaagataacttccactgtaaatcgtgcggcttcaaggaaaatgccgactacaatgcggctaggaatatcgccaagtccacgaactacattaccaagaaagaggagtccgagtactacaagcggaacaacgagatcgcatga

SEQ ID NO: 3308 - DNA, 1461 bp, Unknown
  Bacillus sp. multi
ctcatcacatcgcgcaagatccgactttcaatcgtgtccgacaacgcggccgaagcctacaacttcattcgaaaggagatgagggagcagaacaaggcgctgaacgtcgcaatgtcccacctgtacttcaactcaatcgcccggcagaagatactcctcgcggacgaggcttatcaacagaagctaaaggacgccatcaactctcaggagaagtcattcaacacgcttaaggagctggaacgtaagcagtgcatcgaaggcgattccgagaagaaacagacactcaaggagcgcctcatcaagactcaaaatgcctacgagaagtctaaggagaaggtgtcgaacctgcgtaaaagtcggagcaaggactcattccaagagtacaacaacataattggtcaagtagagcagacccacttacgtgacgtgatctcctcgcagtttaacctccactccgacacgaaggacaggctcacaatgatcgccaaccaggacttcaagaacgacatcggggaggttctctccggcaactgctcactgcgaacatacaaaaagaataaccctctgtacatccgtggtaggaacactgttctatacaaagaggggaacgaattcttcattaagtggattaagggaatcgtgttaaagtgcattctcggtgtcaagaatcagaacaagactgagttgtacaaaactcttgaatgcgtgttggccggggtgtacaagatatgtgattcatctatgaacttcaatcagcagaacaagttgatccttaacttggctttaaacatgcccgacaagagcgagaacaagaaggtgcccggtcgcatcgctggcatcgacctgggtctaaagatccccgcctactttagtgtgaacgacgccccgtatatccggaaggggatcgggaagatcgaggacttccttaaagttcgaaccagcattcagagccagaagcgctctctcgaacgggctctgcaaagctcgaagggtggcaagggccgcaagaagaaattgaaggctttgaaccagtttaaggagaaggagaagtcttacgtgacaacctacaaccacttcatctccaagaagattatctccctcgcaattcagtacggggtggagcggataaaccttgaactacttactttgaaggagacccaaaaaaagtcccttctccgtaattggtcgtactaccagctccagcagttcattgagtacaaggccaacagggaaggaatccttatcaagtatgttgaccctttccatacaagccagacctgctccaaatgcgggcactacgaggacggccagagggagaagcaagacaacttccactgcaagagctgcggcttcaaggagaacgcagactacaacgccgcacgcaacatcgctaagagtaccaactacatcaccaagaaagaggagtccgagtattacaaacgcaacaacgagatcgcttga

SEQ ID NO: 3309 - DNA, 1461 bp, Unknown
  Bacillus sp. multi
ctgattaccagccgaaagatcaggcttagcatcgtgtcagacaacgccgccgaggcttacaacttcatccggaaggaaatgcgggagcagaacaaggccctcaacgttgccatgtcgcacctctactttaactccatcgctcgccagaagatcctcctcgcagacgaggcgtaccagcagaaacttaaagatgccattaactcacaggagaaatccttcaacaccctcaaggagctggagcggaagcagtgcatcgagggagactccgagaagaaacagaccttgaaggaacgcctcattaagactcagaatgcctacgagaagtctaaggagaaggtgtcgaatctccgaaagagtcgatctaaggactccttccaggagtacaacaacattatcggccaagttgagcagacccacctccgtgacgtgatctcgtctcagttcaacctccactctgacacaaaggaccgtttgactatgattgcaaatcaggactttaagaacgacattggggaggtgctttcggggaattgctcacttcgaacttacaagaagaacaatcctctgtacatcagagggcggaacacggtgctgtacaaggagggcaacgagtttttcattaagtggatcaagggcatcgtgcttaagtgcatcttaggtgtcaagaatcagaacaagactgagttgtacaagacacttgagtgcgtgctggctggtgtttacaagatatgcgattcaagtatgaacttcaatcagcagaacaagctaatcctgaatctagcccttaacatgcctgacaagagcgagaacaagaaagtgccgggaaggatagccgggatagacttgggactcaagatcccagcctacttctctgtcaacgacgctccgtacatccgcaaggggatcggcaagattgaagacttcctaaaagtccgaacctccatccagagccagaagcgctctctcgaaagggcgctgcaaagttctaaaggcggaaaggggcgcaagaaaaagttgaaggcactcaatcagttcaaggagaaggagaaatcatacgtcacaacctacaaccacttcataagcaaaaagatcatctcactggcaatccaatacggggtggaaaggatcaacctggagctattgaccctcaaggagacccaaaaaaagtccctattaaggaactggagctactaccaactacaacagttcattgagtacaaggccaaccgtgagggaatccttattaagtacgtcgatccgttccacacctcacaaacttgcagcaagtgcggacactacgaggacgggcagcgcgagaaacaagacaacttccattgcaagagctgcggcttcaaggagaacgcggactacaacgccgcccgtaacatcgccaagtccactaactacatcaccaaaaaggaagaatcagagtactacaaacgcaacaacgagatcgcctga

SEQ ID NO: 3310 - DNA, 1839 bp, Unknown
  Lysinibacillus sp. multi
atgctcgcctacttccctagaccctacgagaacgagacgatctactcgatagccgcccggtacgcgcgccacatgggcatcttatccaagcgaaacgtgctaaaggacttgttcgagattgtgaacccaacctcctccgaggactacacattccacatctacaccctcgtcaacaagatccgccacttttccaacgaatatacggacgagtactttctgaacaagcacacggtttccccactctactctccgttcatcaaggactcatccggcaacccgtcccggagccttgacaacttcatcaagggcaaaaagcgctatatgtgggacatccccgaaaaggagaacttattctattgctccgagtgcgttgaggaagacctggagaaatacggtgaatgctactggaacagaatcttccaaatccccggcatcatgatctgcggcaagcacgaacgtccgctctccaagtcccagctcaacattcacaggaatcctctcaacaaattcatcatgcccaaccaggaggttgccgtggacatcaagatcgacaacgagatattcgaacagcttctggagattacgcgcaacgtcgaatatttcttcacaaacaaagtggacactttcaattaccaggaactttacgagaagtatttcgagtttatcaagatcgccagcatcgccatacccctcagccatctcaagaagaagctcggagaactgattatctcacggtttaacgagaagactctggatttcctcaactccaatccccgtaagaacgactggctcagttacctgagcgttgaacggatcaagcacattcacccaatccgtcatgtgctgctgatgatgagcctggcactgtctgtggagcggtttatcaacatcgtaccgaagtatcagcccttcgggtccggcgcttggatttgcatgaacagtctttctgagcactacttggaaaaggtggtcaccaacgtgaacatcaccttcaacaaagacattgggaactttcaaggtgagttcaagtgcagttgcggcttcacctatgttctctacaacggtgaaaacaatccgtgcaatatcagcaaattcagcccaagagtgaaggagaagggtcacatctggcgtaaggagttcgacgagctggtgagtcgcggggcgtccatcaaggagattgcacttaagacaaattactcaacagggaccgtccggaagatcatcaagcaagggcacaactaccacgaaaacgagaagaaacgacgacaacagaacctggaggagcggcggataatcagggagaagaacgataagatggactggaacggcattcggaggaagtatccgaactcttcaaggaccgagttgatgtacgagaacaaggccctatacaaccgtctcctcagatacgaccgcgagtggcttatcgagaactcgccgaccagccagcggggagccgtgaagacctccgacgacattaaccacaaacgggacgtgctttacttgaaggtcgctcaggatatgctcgaaaactggagtgagtacgagaagcaagccgggaagatcatcaagaaaacccagtttaccctctacacaagactagggatgaagaccaggaacaacgacaagtaccctcttacggtcgcctttatctctaccttcattgagagtaacgaggactatcagattcgtcttatcaaccagtgcatcgagaaccactttatcaattccgagatcaagcggtatcgaatcctggaatactctggcctccgatacctacaccctaaggcggagaagtaccttgaggtcatcattaacgaaaacaataagcgcaactaa

SEQ ID NO: 3311 - DNA, 1839 bp, Unknown
  Lysinibacillus sp. multi
atgctcgcatacttccccaggccatacgagaacgagacgatctactccatcgccgcccgatacgcccgacacatggggattctcagcaagcgcaacgtgctcaaagacttgttcgaaatcgtgaacccgacgtcctccgaagactacaccttccacatctacactctcgtgaacaagatacggcacttctccaacgagtacacagacgagtactttctcaacaagcacaccgtctctcctctctactccccgttcatcaaggactcctccggcaacccatcacgctccctggacaacttcatcaagggcaaaaagcggtatatgtgggacatccctgaaaaggagaacctattctattgctccgaatgtgtggaggaagaccttgagaaatacggagagtgctactggaaccgcatcttccaaatacctggcatcatgatctgcgggaaacacgaacggcccctgtctaagtcccagctcaacatccaccggaatcctcttaacaaattcatcatgcctaaccaggaggttgcggtggacattaagatcgacaacgagatattcgagcagctactggagataacccgcaacgttgagtacttcttcacaaacaaagttgacaccttcaattaccaagagctttacgaaaaatattttgagttcattaagatagcgtctattgcgataccactgtcccacctcaagaaaaaactcggagaactcatcatcagccgcttcaacgagaagaccctcgacttccttaattcaaatcctcgtaagaacgactggttgagctacctttccgttgagcgtatcaagcacattcaccccatccgtcacgtgctgcttatgatgtctctggcactgtctgtggagcggttcatcaacatcgtgccaaagtaccagcctttcgggtccggcgcttggatctgcatgaacagcctgagcgagcactacttggagaaggtggtcacaaacgtgaatatcaccttcaacaaggacattgggaactttcagggagagttcaaatgctcctgcggtttcacctacgtgctatacaacggtgagaacaatccatgcaacatctcgaagttcagcccgagagttaaggagaaggggcatatctggcggaaggagttcgacgagttggtgagccgaggtgcgtccatcaaggagatcgcactcaaaacaaactattcaacgggaactgtgcggaagatcattaagcaaggacataactaccatgagaacgaaaaaaaacggagacagcagaatcttgaggagcggcgaatcatccgcgagaagaatgacaagatggactggaatggaatccgtaggaagtacccgaactccagccgcactgaattgatgtacgagaacaaggcactatacaacaggctcctgcgatatgaccgagaatggctgattgagaactcacctacctcccagcgcggagccgtcaagacaagcgacgatattaaccataagcgggacgtgctctacctgaaagttgcacaggatatgctggagaactggtctgagtacgagaaacaagctgggaagatcatcaaaaagacacagttcaccctctacacccgacttgggatgaagacccgtaacaatgacaagtaccctttgacagtagccttcatcagcacgttcatcgagagcaacgaggactaccagatacggctcatcaatcagtgcattgagaatcacttcattaactctgagatcaagcggtatcggatattggagtattctgggttgcgttatctccacccgaaggcggagaagtaccttgaggtcatcatcaacgagaacaacaagcggaactag

SEQ ID NO: 3312 - DNA, 1839 bp, Unknown
  Lysinibacillus sp. multi
atgcttgcctacttcccgaggccgtacgagaacgagaccatctactccatcgcagcgcgttacgcgaggcacatgggcattctgtccaagaggaatgtgttgaaagacctcttcgagatcgtaaaccccacgtcttcggaggactacactttccacatctatacgctcgtcaacaagatccgacacttcagcaacgaatacacggacgagtactttctgaacaaacacaccgtgtcccctctatacagtccgttcatcaaggacagcagcggcaatccttctcggtccctcgacaacttcattaagggcaagaagcgctatatgtgggacatcccggagaaggagaacctattctactgctcggagtgcgtggaggaagatttggagaaatacggggagtgctactggaaccggatattccagatccctgggatcatgatatgcggaaagcacgagcgcccactgtctaagtcgcagcttaacatccaccggaacccattgaacaagttcattatgcctaatcaggaggtggcagtggacatcaagatagacaacgagatattcgaacagttgcttgaaattactaggaacgttgagtacttttttaccaacaaagtggacacattcaattaccaggagctttacgagaagtacttcgaattcatcaagatcgcatcaattgcgataccccttagccacctcaaaaagaaactcggggaattgataatctcacggttcaatgagaaaaccctggactttctgaactccaacccacgtaagaacgactggttgagctaccttagtgtggagcgcatcaagcacatccaccccatacgtcacgtcttacttatgatgtcccttgctctttcagtggaacggttcatcaacattgttcccaagtaccagcccttcgggagcggggcttggatctgcatgaacagtctttctgagcactacttggagaaggtggtcaccaacgtgaacattaccttcaacaaggatattggaaactttcagggagagtttaagtgctcgtgcgggttcacctacgtcctctacaatggcgagaacaacccctgcaacatctcaaagttcagtccccgtgtgaaggagaagggccacatctggcggaaggagtttgacgagctagtgtcacgaggcgcgagcattaaggagattgcgctaaagactaactattctacggggacagtgaggaagatcatcaagcaaggacacaactaccacgagaacgagaagaaacgtcgtcaacagaatctggaggagagacggatcatccgtgaaaaaaacgacaagatggactggaacgggattcgtcgaaagtaccccaacagtagccgcacggagctgatgtacgagaacaaagctctctacaaccgcctcctgcggtacgaccgcgagtggctgattgagaactctcctacctctcagcgaggggccgtgaagacctcagacgacattaaccacaagcgcgacgtactttacctcaaagttgcccaagacatgctggagaactggagtgagtacgagaagcaagctgggaagattatcaagaagacgcagttcaccctctatacacgattggggatgaagactaggaacaacgacaagtatcctttgaccgtggcgttcatctccacgtttatcgaatccaacgaggactaccagatccggctcatcaaccagtgcattgagaaccacttcatcaattcggagattaagcgttacagaatcttggagtacagtggattaagatacctccaccctaaggccgagaagtatctggaagtcattatcaatgagaacaacaagcgtaactga

SEQ ID NO: 3313 - DNA, 1839 bp, Unknown
  Lysinibacillus sp. multi
atgctggcttacttcccgcgcccatacgagaacgagaccatctactctatcgccgcccgctacgcccgccacatgggcatactctcaaagcgcaacgtacttaaagacttgttcgagatcgtcaaccccacgtcctccgaggactacaccttccacatctacacactcgtcaacaaaatccgccacttctccaacgaatatacagacgaatattttctcaacaagcacactgtgtccccgctgtactctccattcattaaggactcctccggaaacccatcacggtcacttgacaacttcatcaagggcaagaaacgctatatgtgggacatccctgagaaggagaacctgttctattgttcggagtgcgtggaggaagaccttgaaaagtacggggagtgctactggaaccggatcttccagatcccagggattatgatctgcggaaagcacgagcgtcccctgagcaagtcccagctcaacatacaccggaacccgttgaacaagttcatcatgccaaatcaggaagttgccgtggacattaagattgacaacgagatattcgaacaactacttgaaatcacccgtaacgtagaatatttctttaccaacaaggtggataccttcaattaccaggaactttacgagaagtatttcgagttcattaagattgcttccatcgctataccactgtctcacctcaaaaagaagctaggggagttgataatctctcgcttcaacgagaagactctggacttcctaaacagtaaccctcgtaagaatgactggctatcctacctgagcgtcgagcgcatcaagcacatccaccccatccgccatgtgctacttatgatgtcactcgcgctgtccgtggagcgcttcatcaacatcgtcccaaagtaccagcccttcggcagcggtgcttggatctgcatgaactccttatccgagcactacttggagaaggtggtgaccaacgtaaacataaccttcaacaaagacattggaaactttcagggagagtttaaatgctcttgcgggttcacctacgtgctctacaacggcgaaaacaacccctgcaacatcagcaagttctcccctcgtgtcaaggagaaggggcacatctggaggaaggagtttgacgagctggtgagccgtggggccagtatcaaggagatcgctcttaagactaactactctacgggcaccgtgaggaagattatcaagcaaggacacaactaccatgagaacgagaagaagcgacgccaacagaaccttgaggaaagacgcattatccgtgaaaaaaatgacaagatggattggaacggaatcagaaggaagtacccaaacagcagtcggacggaacttatgtacgagaacaaagctctgtacaatcggctacttcggtacgacagagagtggcttatcgagaatagcccaacctcccagcgcggcgctgtcaagacgtcggatgacatcaatcataagcgagacgtcctatacctcaaagtcgcccaggatatgctggagaactggtctgagtacgagaaacaagcggggaagattatcaagaaaacccagttcaccctctacactcgcctcggcatgaagacccgtaacaacgacaagtaccccttgacagtcgccttcataagcaccttcatcgagagcaacgaggactaccagatccggcttatcaatcagtgcatcgagaaccacttcattaacagtgagattaagcgctaccgaatccttgagtacagtggcttgagatacttacaccctaaagccgagaagtatctggaagtcatcattaacgaaaacaacaagcgaaactga

SEQ ID NO: 3314 - DNA, 1839 bp, Unknown
  Lysinibacillus sp. multi
atgctggcgtacttcccacggccttacgagaacgagaccatatacagcatcgccgcccgctacgccaggcacatgggcatcctctccaagcgaaacgtactcaaggacttgttcgagattgtgaaccccacgtctagcgaagactacacattccacatctacacccttgtgaacaagatccgccacttcagcaacgaatataccgacgaatattttctcaacaaacacaccgtgtctcccctctattcaccgttcatcaaggactcttcgggcaacccgagccgctcgctcgacaacttcatcaagggcaagaaacgctatatgtgggacatacctgagaaggagaacctgttctactgctctgagtgcgtggaggaagacctggagaagtacggggagtgctattggaacaggatattccaaattcccggaatcatgatatgtgggaagcacgagagacccttgtcgaaaagtcagctcaacatccaccgaaaccctctcaacaagttcatcatgccgaatcaggaggtggctgtggacatcaagatcgacaacgagatattcgagcagttacttgagattacccgcaatgttgagtactttttcaccaacaaggttgacacctttaactaccaggaactatacgagaaatatttcgagttcatcaagatcgccagcatagcaattccactttcccacctcaagaaaaaactgggcgaactgattatctctcggtttaacgagaagaccctggatttcctgaactccaatccgcgtaagaacgactggctaagctacctgagtgttgagcgcatcaagcacatccatccaatacgtcacgtacttctgatgatgtcccttgcccttagcgtggaaaggttcattaacattgtgcctaagtaccagcccttcggctccggggcctggatttgcatgaactccctatccgagcactaccttgagaaggtggtgactaacgtgaacatcaccttcaacaaggacatcgggaacttccagggcgagtttaagtgctcttgtggcttcacgtatgtcttgtacaacggggagaacaacccttgcaacatcagcaagttcagtccacgggtgaaggagaaggggcacatctggcgcaaagagttcgacgagctagttagtcggggagcctccattaaggagatcgccctgaaaacaaactactcaacagggactgtccgcaagatcatcaagcaaggacacaactaccacgagaacgaaaaaaagcgccgacagcagaacttggaggaacgaaggatcatccgtgagaagaatgacaagatggactggaacggtatccgacggaagtacccgaacagctccaggactgagttgatgtacgaaaacaaggctctatacaaccggctgctgagatacgacagggagtggctcattgagaacagccccacgtctcagcggggagccgttaaaacgtcagacgatattaaccacaagcgcgacgtgctctatctcaaggtggctcaggatatgcttgagaactggagcgagtacgagaagcaagccgggaagatcattaagaagacacagtttaccctctatactcggctggggatgaagactcggaacaacgacaagtaccccttgactgtggccttcatatcgacctttatcgaatccaatgaggactatcagatccgcctgattaaccagtgcattgaaaaccacttcatcaactcggagatcaagcgctaccgcatcctggagtacagcgggctccgatacctgcacccaaaggccgagaagtaccttgaagtgattatcaatgagaacaacaagaggaactga

SEQ ID NO: 3315 - DNA, 1431 bp, Unknown
  Bacillus sp. multi
ctgggtcgtctcatcttccgcaacgggcggatcgtcaacgacacctagtacattaaggactgtttccttctcatctccgtccggttcagtccaatcttactgtaggaagtggagcaagccaacgaaaacctgtgataattcctcggggtgttcttgtacggcctcatcaacaagaagaagataatcagcaatcacatctacgggctcatcttcacgcagttatcgttcctcttccacaaaaagtgactgacgcacctcaagcacagccgtcggacagaggagaacggcgaccaacttcctattcagatggccttttagtccttctcgttctacttttttacaatggtcaacatgaaggagtagtttccgtgcttcaagtgaaatctcgacctgcccacctagcgagtgcctatcatgtacctctcccaccgggactccatctgccggggagtttgccatatctacattgacaccaccgagacgttcactacgcgcggcattctctattcctttctattcctgagctactctctcatcttgcagagtttcctgctactgttcatctgcaagtccatgaacaaccatacaagctggtacttcatcagtcactcctacatctctattggctacttcatcggactgagctggctggagcgggtgcattgatacctgcacatatacctgtacatcctctgcacgttcttggactcaagtattctcaagataattcgttgtgagatattcctgattaacacttgcattggattcaacactcgtgacatcgtgtccctcttcatactgtacatgctcaaaatcttccagatgaagatcccctagatcaccgacacctgaatcatctggtgctactcttggaacacccagaggacgattggatcaatcatgctgtttccgtggacctgcatggatatgtgagagctgagcgcctgatgagtcatcttcaagctcaatttccacccatcctctatggccacctcgtcgtccccgaggatcaacggctgaaagtatatctggaaactcaaatgcagcggaatttgaaacgccaacactcttgagaaccgtggtgtctggaggcggaagtggcatcgctagagctagttttttatctaaaaggtgagtcagtacatgctctgaaaactgaattgctagtgcatcaagccgctcatccagtcgttctggaccgacgaatatttctgtggctgattctgaaccgctcggtagctctcctgacgagggtgctctgacatcctcacccacccctacacttgaagcgactgaatcttctgtctggtgtttaccagctcgctttacaagacgaacatctcaagcaagatcccttgagggatctggcgttgaaagacattgaacctgctctccaagtgactctagttcatccgccaccgcaaccgccac

SEQ ID NO: 3316 - DNA, 1431 bp, Unknown
  Bacillus sp. multi
ctcggtcgcttgatcttccgcaacgggcgcatcgtcaacgacacctagtatatcaaggactgcttcctgctgatctcggtccggttctccccgatcctcctgtgagaagtggaacaagccaatgagaacctctagtgattcctcggcgtgttcctttacgggctcattaacaaaaagaagatcatctccaatcacatctatgggctcatcttcacgcagctctccttcctcttccacaaaaagtagctgacccaccttaaacattcccgccgcacagaggagaacggcgaccagctcccgatccagatggccttctgatccttttccttctatttttttactatggtgaatatgaaggagtgattcccctgcttcaagtaaaacctcgacctccctacctagcgtgtccccatcatgtacctctctcaccgcgacagcatctgccgtggcgtgtgccacatctacattgacacgacggagaccttcaccacgcggggcattctctactctttcctcttcctctcctattccctgatcctacagtctttcctcctcctctttatctgcaagtctatgaacaaccacacatcatggtacttcatctcacattcgtacattagcatcggctacttcatcggcctatcctggctggagcgggttcactgatacctacacatatacctttacatactgtgtaccttcctcgatagctccattctcaagatcatacggtgcgagatattcctcatcaacacttgcatcgggttcaatacgcgcgacattgtgagcttattcatcctctatatgctcaagatattccagatgaagatcccctaaatcacagacacctagatcatctggtgctactcgtggaacacccagcgcaccatcggctccatcatgcttttcccctggacttgcatggatatgtaagagcttagtgcttagtgagttatcttcaagctcaatttccatccatcatcaatggctacctccagcagtccccgtattaacggctaaaagtatatctggaaactcaaatgctctgggatctgaaacgccaataccctggagaatcgtggagtgtggcgacggaagtggcacagataatcctgattcttcatttgaaaggtgtcccagtacatgctctaaaagctcaactgctagtgcatcaagccccttattcagagcttctggaccgacgaatatttctgcggatgattctaaacagctaggtgattgtcatagcgcgggtgcagcgacatcctgacccacccctacacctagtccgactgaatcttctgcctagtgttcaccagcagcctctacaagacgaacatcagctccaagataccctgaggaatctggaggtgaaagactctaaacctcctcagcaagtagctgtgattcatccgacaccggaaccggcac

SEQ ID NO: 3317 - DNA, 1431 bp, Unknown
  Bacillus sp. multi
ctgggccgactcatcttccggaacggccgaatcgtcaacgacacctagtacatcaaggactgcttcctgcttatctccgtcagattctccccaatcctcctgtgagaagttgaacaagcaaacgagaacctctagtgattcttgggcgtcttcctctacgggctcatcaacaagaagaagataatctccaatcacatctacggcctgatcttcacacaattgagcttcctcttccacaaaaagtgacttactcacctcaagcactcccgcagaacggaggagaacggtgaccagttgcccatccagatggctttctagtctttctcgttctacttttttactatggtcaatatgaaggagtgattcccctgcttcaagtgaaacctcgacctccccacgtagcgcgttcccatcatgtacctttcccaccgcgactcaatctgccgtggagtctgccatatctacattgacaccaccgagaccttcacaacccgaggaatcctttactcattcctgttccttagttactcgttgatcctccagtcattcttgctcctgttcatctgcaagtctatgaacaaccacacctcgtggtacttcatctctcactcttacatcagcatcggctacttcatcggtctatcgtggctggagcgcgtgcattgatacttgcacatctacctgtacatcctttgcaccttcctcgactcatcaatccttaagatcattcgttgtgagatattcctcattaacacttgcatcggcttcaacaccagagatattgtcagcctgttcatcttgtacatgctcaaaatcttccagatgaagattccgtgaatcacggacacctgaatcatctggtgctactcatggaacacacagcgtaccattggatcaatcatgctcttcccctggacctgcatggatatgtgagaactctccgcctgatgagttatcttcaagctgaacttccacccctcctcgatggccacgagcagctcgccacgtatcaacggctgaaagtatatctggaaactcaagtgcagcgggatctgaaacgcgaataccctggagaaccgtggcgtgtggcggcggaagtggcaccgctagtcctagttctttatctgaaaggtgtctcagtacatgctttaaaagttgaactgctagtgcatcaagcccttgatccagagcttctggaccgacgaatatttctgtggatgattctgaacggcgcgatgattgtcctgacgcgggtgcagcgacattctgacccatccctacacctagtccgactgaatcttctgcctggtgttcacgtcctccctctacaagaccaacatcagttccaagatcccttgagggatctggcgctgaaagacacttaacttgctttccaagtgactttagttcatccgtcaccgtaaccggcac

SEQ ID NO: 3318 - DNA, 1431 bp, Unknown
  Bacillus sp. multi
ctggggaggctgatcttccgtaacgggcggatcgtgaacgacacctagtacattaaggactgcttcctcctgatctccgtccgcttctcaccgatcctgctgtaggaggtggagcaagccaacgagaacctgtagtgattcctcggcgtcttcctgtacgggcttatcaacaaaaagaaaattatctctaatcacatctatgggcttatcttcacgcagctctccttcctcttccacaagaaatgacttacgcacctaaagcactccagacgcaccgaggagaacggcgaccagttgcccatccagatggcattctagtcattcagcttctatttctttactatggtcaacatgaaggagtgattcccctgtttcaagtgaaacctcgacctccccacctagcgagttcccatcatgtacctgagccaccgggacagtatatgcagaggtgtgtgccacatctacatcgacactacggagacgttcactacccgtggcattctatactctttcctctttctcagttattcgctaatccttcagagtttcctgctgctgttcatctgcaagagcatgaacaatcacacctcatggtacttcataagccacagttacatcagcataggctacttcatcggcctgtcctggctggagcgagtccactgatacctccacatatacttgtacatactctgcaccttcctggacagctctatcctcaagatcatccggtgcgagatattccttatcaacacttgcatcggattcaatacccgagatattgtgagcctgttcatcctttacatgctcaagatattccagatgaagataccttgaatcacagacacttgaatcatctggtgttactcctggaacactcagaggacaatcggcagcatcatgctcttcccgtggacctgcatggatatgtgagagttgtccgcctgatgagtcatcttcaagttgaacttccacccatccagcatggctacctcctcctccccgaggatcaacggttgaaagtatatctggaaactcaagtgcagcgggatctaaaacgccaacacactggagaatagaggtgtgtggagacgcaagtggcaccggtgatcgtaattcttcatttgaaaggtgagtcagtacatgctctgaaagttgaactgctagtgcatcaagcccttaatccaatccttctggactgacgagtacttctgtggctgattctaaactgcccgatgactctcctgacgagggtgcagcgacatactgacgcacccttacacatgatcggactgaatcttttgccttgtctttacctcttccctctacaagacgaacatctcctcgaagatcccgtagggaatttggcggtgaaagacactcaacctgctctctaagtgactgtgattcattcgtcaccgaaaccggcac

SEQ ID NO: 3319 - DNA, 1431 bp, Unknown
  Bacillus sp. multi
cttggaagactgatattccgcaacggcagaatagtaaatgacacttagtacattaaggactgcttcctcttgatctccgtccgcttcagcccgatcctcctctaggaggttgaacaagccaacgagaacctgtgatgattcctcggcgtgttcctctacggactcatcaacaagaagaagataatcagtaaccacatctacggcctcatcttcacccagctctcgttcctgttccacaagaagtaactcactcaccttaagcacagtcggaggaccgaggaaaatggagaccagctccccatccagatggccttctagtccttctccttctatttctttactatggtgaacatgaaggagtagtttccgtgctttaagtgaaacctggacctcccaacttagcgggtgcccattatgtacctgtcgcaccgtgactccatctgccgtggggtctgccacatctacatcgacaccaccgagacgttcaccactagagggatactgtactcgttcctcttcctctcctactccctgatccttcagtcattccttctgctctttatctgtaagtcgatgaacaaccacacctcttggtacttcatctcccactcctatatctccatcgggtacttcatcgggcttagctggttggaacgggtccattgatacctgcacatctacttgtacattctctgcactttcctcgacagcagcatactcaagatcatccgttgcgaaatcttccttatcaacacttgcataggcttcaacactcgtgacatcgtgtccctgtttatcctttacatgctaaagatattccagatgaagatcccttgaattacggacacctgaatcatctggtgttactcctggaacacccagcggaccattggctccataatgctattcccgtggacctgcatggatatgtgagagctgagtgcgtgatgagtcatattcaaactgaacttccacccatcgtcaatggctaccagctcctcaccccggatcaacggctgaaagtatatctggaaactcaaatgctccggaatctgaaacgcgaacacactggaaaaccgaggggtgtggagaaggaagtggcaccgctgatcctgatttttcatctgaaaggtgagtcagtacatgctgtgaaagctgaactgctagtgcattaagccgctgatacagagcttctggacggacgaatatttctgtggatgattctgaaccgcgcgttgacttagttagcgcggctgctccgacatcctgacgcacccttacacctagagcgactgaatcttctgtctcgttttcacatcctcgctgtacaagacgaacatcagcagcaagatcccgtgagggatttggaggtgaaagacgttgaacctccttagtaagtgactctagttcattcgccaccggaaccggcac

SEQ ID NO: 3320 - DNA, 828 bp, Unknown
  Streptomyces sp. multi
atgtcagagcgccgccgctatccttctgacttgagcgacgcctcctggcaattggtggagcccgtgcttgcagcttggaggtgtgagcggcgaggaaggggactggacatcggcagaccacctgaccatgatctgcgaagtctgcttgatgccgtactttatgtgaaccgcactggtattccgtggcgctacttgcctcatgattacccgcattggaacaccgtttacgcctactttgcacgctggcaggaggaagacatattcgaccagttgaataccctattacgaagacaagagggtcgtgaggaggagcccaccgcatgtgtgatcgactcccaatctatcaagacatctaccaacgtaccagcacgggaacaagggattgacgctggcaagaaaatcgtggggcacaagcggaatatcgttattgacactgttggcctcttgcggactgttctggtgacagccgcatctgtacaagactcaatcgctggtcagactctcattgaccgtatcgccgccgatcatcctacagttcggaagacttgggttgatggcggatacagacaatatctcgtggaacatgccgcaactctcggcattgacatgcacatcgtcaggcgagatccgactactaggggttttaccgtgttaccgcgccgatggacagtggaacggacacttggatggctcatgaaccaccggaggcttgcgagagattacgaggctcattcacgttgctccgaagcaatgattcacctcgctatgataaaccttatgactcgcagaccaacagcagaatgcactcctacatggcgtggagcctga

SEQ ID NO: 3321 - DNA, 828 bp, Unknown
  Streptomyces sp. multi
atgtcggagcgaaggcgctacccgagcgatctctctgatgcgagctggcaacttgtggaacctgtactcgctgcttggaggtgcgaacgccgaggcagaggactcgatattggccgaccgcctgaccacgacctacgcagccttctcgatgcggtgctctacgtgaaccgaacggggataccctggcgctaccttcctcacgactatcctcactggaatactgtttatgcctacttcgctcgatggcaagaggaggacatattcgaccaactcaacaccctgctccgccgtcaagagggccgcgaggaggagcctactgcctgtgtcattgactcacagtccatcaagacctctactaatgtaccagcacgtgaacaggggatcgacgctggcaagaagattgtgggtcacaaaaggaacatcgttatcgacaccgtggggttgttaagaactgtcttggtgaccgcagcctcagtccaagatagcatagctggccaaactctaattgacaggatagctgccgaccacccaaccgtgcgtaagacttgggtggatggcggatacagacaatatctcgtggagcacgctgcaacactcgggattgacatgcacattgttcgtagagatcctacaactcgcggattcactgtgcttccaagacgatggacagtcgagcgcacgctggggtggcttatgaaccaccggagacttgctagagattatgaggctcattcaaggtgtagtgaagcaatgatccacctggctatgattaacctcatgacgaggagaccaaccgccgaatgcacacctacatggaggggtgcgtga

SEQ ID NO: 3322 - DNA, 828 bp, Unknown
  Streptomyces sp. multi
atgagcgaaaggaggcgctacccatctgacctcagtgacgcatcctggcaactcgtggagcctgtcctagcagcctggagatgtgaaagacggggaaggggactcgacattggacgaccaccggaccacgacttgcgctccctcctagatgctgttctctatgtaaacagaaccggcatcccgtggcgctaccttccccacgactacccacactggaatactgtttacgcctactttgcgagatggcaagaagaggacatattcgaccaattgaacacgcttctacggcgtcaggagggtagggaggaggagccgactgcttgcgtaatcgactcgcagtctatcaagaccagcacaaatgttccagctagggaacaagggattgatgctggcaagaagatagtgggtcacaagaggaatatcgtcattgatacagtcgggttgctgcggacggtcttggtgacagcagcctcagtacaagacagtatcgcgggccagaccctcattgaccgcattgcagcggatcaccccactgttcggaagacctgggtggatggcggatacagacagtacctcgttgaacacgctgctacactgggcatcgacatgcacattgtacgacgcgaccctacaacccgaggtttcacagtccttccccgaagatggaccgttgagcgcacactcggatggttgatgaaccatcggagactggcacgggactatgaggcccattcaaggtgctcagaggccatgatccatcttgctatgataaaccttatgactaggagaccaacggccgaatgcacccctacctggcgcggagcttga

SEQ ID NO: 3323 - DNA, 828 bp, Unknown
  Streptomyces sp. multi
atgagcgaacgcagacgctatccatccgacctctctgatgcttcgtggcaacttgtggagccggttctagccgcctggaggtgcgaaaggaggggtaggggactcgacattggaagaccacccgaccatgacctgcgttccctgctcgatgccgtgctctatgtgaaccgaaccggcattccgtggcgttacctgcctcatgactatcctcattggaataccgtgtacgcatacttcgcgcgctggcaagaggaggacatattcgatcaattgaacacactcctacgcagacaggagggtagggaggaggaacctactgcctgtgtgattgactctcagtcgatcaagacttctaccaacgtcccagcccgtgagcaaggaatcgacgctggcaagaaaatcgtcgggcacaagcgaaacatcgtgattgacactgttgggttactacgaaccgtgttagtgacagcggctagtgtgcaagattctattgctggacaaacactgatcgaccgaatcgctgcggatcacccaacggtgcgaaagacatgggttgatggaggttaccgacagtacctggttgaacacgctgcgacacttgggattgacatgcacattgttcggagagacccaacaactaggggattcacagttctaccgaggcgttggactgtggagcgcacactgggatggcttatgaaccacaggagattagcgcgcgactatgaagcacacagtcgttgcagtgaggctatgattcacttggcgatgattaacctcatgacccgaagacctaccgctgagtgcacccctacttggcgtggagcctga

SEQ ID NO: 3324 - DNA, 828 bp, Unknown
  Streptomyces sp. multi
atgtccgaaaggcgtcggtatccctccgacctctctgacgcctcttggcaactcgttgaacctgtcttggctgcatggcgctgcgaaaggcgtggacgcggacttgacatcgggcggccacccgatcacgacctccggtcactcctggatgccgtgctctatgtcaatcgaactggcatcccctggagataccttccccatgattatccacactggaacacggtttatgcctatttcgctagatggcaagaggaggacatattcgaccagctcaatacccttctacgcagacaggaaggaagggaggaggaacctacggcatgtgtgatcgactctcagtctattaagactagcacaaatgtgcctgcacgcgaacaagggatagacgctggcaagaaaatcgtcgggcacaaacggaatatcgttattgacactgtggggctgctacgcaccgtcttggtgacagcagcatccgttcaagactcaattgcgggacagacactcattgacagaatagccgctgaccatcccaccgtgaggaagacctgggtcgatggagggtacagacaatatctcgtagagcacgctgcaactctcgggattgacatgcacatcgtcaggagagatcccactacaaggggtttcacagtcctgccacgtcggtggacagttgaacgcactcttggatggcttatgaaccaccgcagactcgctagggattacgaggctcatagcagatgcagcgaggcaatgatccacttggctatgattaaccttatgactagacggcccactgccgagtgcaccccaacatggcgcggagcgtaa

SEQ ID NO: 3325 - DNA, 1332 bp, Unknown
  Bacillus sp. multi
atgaagtaccagatcgtgtgccctgtgaacatcgagtggaagaccttcgaaatctacttacgaaccctctcctaccacttccggaccattggcaatcgcaccatacagaagctctgggagtacgacaaccagtccctaaagcacttcaaggacaccggccagtacccaagcgcacagcaactctacggctgcacccagaaaacgatctcgggctacatctacgaccagctcaaggaggagtaccaggacattaacaaagcgaacatgagcacaacccttcagaaaactattcgcacatggaactctcgcaagaaggaaatctggagtggggagatgagcattccctcattccgcaacaacctacccatcgacatccacggcaactcgatccagatcatcaaggagaagtccggcgactacatcgcctccgtgagcctgttcagttccaaattcattaaggagaatgacctcccgaacgggaagatactcgtgaagctctcgaccaggaagcagaacagcatgaaggtgatacttgaccgcataatcgacagcacttacgcgaagggtgcttgcatgttgcataagcacaagaaaaaatggtacttgtccataacctacaagagcaatatcaaggaggagttgaagttcgacgaagacttgataatggggatagacatggggaagatcaacgtcttgtacttcgcctttaacaagggcctggtgcggggcgcaatatccggcgaggaaatcgaggcttttcgcaagaaaatcgagcaccgccgtatctccttacttcgtcagggaaagtattgcagcggcaacaggatcggcaaggggagggagaagcgtatcaagcccatcgacgtccttaatgataaggtggcaaagttcagaaacgctacgaaccacaagtacgccaactacattgtgcagcagtgcctaaagtacaactgcggaaccatccagttggaagacctcaaagggatctcaaaggagcagacattcctcaagaattggacctacttcgacctacaggagaagatcaaaaaccaggcaaaccagtacggcgtaaaggttgtgaagatcgacccctcttacacttcccaaaggtgcagtgagtgcgagtacatccacaagaacaatagacaggaccagtccaccttcgaatgccagcagtgttcgttcaaggtgcacgccgattacaacgcggccaagaatatcagtgtttacaacattgagaaggtcatccagaagcagcttgaattacaggagaaattgaaccagactaagtacaaggaacagtatatcgagcagatgaaaaatatcaactag

SEQ ID NO: 3326 - DNA, 1332 bp, Unknown
  Bacillus sp. multi
atgaagtaccagatcgtgtgcccggtgaacatcgagtggaagaccttcgagatataccttagaacactctcctaccactttcggaccatcggcaatcgaacaattcagaagctgtgggagtacgacaaccagtcgttgaagcacttcaaggacaccggccaataccccagcgcccagcagctctacgggtgcacacagaaaactatcagcggctacatatacgaccagctcaaggaggagtaccaggacatcaacaaggcgaatatgagcaccactttgcagaaaactatacgaacatggaactcccgcaaaaaagagatttggagtggcgagatgtctatcccgagtttccgcaacaaccttcccatcgacatccacggcaactcgatccagatcatcaaggagaagtccggagactacatcgcttcagtgtcgctcttcagttccaaattcatcaaggagaatgacttgcccaacggcaagattctcgtcaagctatccactcggaagcagaactctatgaaggtcattctggaccgcataattgactcaacctatgctaagggtgcctgcatgttgcacaagcacaagaagaagtggtatctgagcataacgtacaagtcaaacatcaaggaggagcttaagttcgacgaggacttgataatggggatcgacatgggaaagattaacgtcctctactttgcgttcaacaagggcttggtcaggggagctatctcaggggaggagatcgaggctttccgcaagaagatagagcaccgccgtatttcgttactacgccaggggaagtactgctcgggcaaccggattggaaaggggcgggaaaagcggattaagccgattgacgtattgaatgacaaggtggccaagttccgtaacgctactaaccacaaatacgctaactacatcgtacagcagtgccttaagtacaactgcggcacgatccaactggaagacctcaagggtatcagcaaggagcagaccttcctcaagaattggacctacttcgacctccaggaaaaaatcaagaaccaggccaaccagtacggggtgaaggtcgtcaagattgacccctcctacacatcccaacgctgctccgagtgtgagtacattcacaagaacaaccgccaagatcagtcaactttcgaatgccaacagtgctccttcaaggttcacgccgattacaacgcggccaagaatatctccgtgtacaacatcgagaaggtgatacagaagcagctcgaactacaggagaagctgaaccagactaagtacaaggagcagtacattgagcagatgaaaaacatcaattga

SEQ ID NO: 3327 - DNA, 1332 bp, Unknown
  Bacillus sp. multi
atgaagtaccagatcgtatgcccggtcaacattgagtggaagaccttcgaaatctaccttagaacgctgagttaccacttccggacaatcggcaaccgcaccatccagaaattgtgggagtacgacaaccagtccctcaaacactttaaggacacaggacagtacccgtcggcccagcagctctacggctgcacgcagaaaacgatctctggctacatctacgaccagctcaaggaggagtatcaggacatcaacaaggcaaacatgagcactaccctacagaaaaccatccgcacttggaactcacgcaaaaaagagatatggagcggggagatgagtattccgagcttccgtaacaacctcccaatcgacattcacggcaactctattcagatcattaaggagaagtcgggagactatatcgcctctgtgagcttgttctcaagcaagttcattaaggaaaacgacctccccaatggcaagattctcgtgaagctgtccacgcgcaagcagaacagcatgaaggtcatcctggaccggatcattgactctacttacgctaaaggtgcgtgcatgttacacaagcacaagaagaagtggtatctgtccatcacctacaagtcgaacatcaaggaggagttaaagttcgacgaagacttgataatgggaattgacatggggaagatcaatgtcctatactttgctttcaataagggcctggtgcgaggagctatcagtggggaggaaatcgaagcgtttcgcaaaaaaatcgagcaccggcggatcagcctcctccgccaggggaagtactgttcgggcaatcgaattggaaaaggccgtgagaaacggatcaagcctattgacgtactgaacgacaaggtggctaagttccgcaacgcgaccaaccacaagtacgccaactacatcgttcagcagtgcttgaagtacaactgcggcaccattcagcttgaggatctaaaggggatcagcaaggagcagacattccttaagaattggacttacttcgacctccaggaaaaaatcaagaaccaggccaaccagtacggggtgaaggtcgtgaagatcgacccctcctacacaagccagcggtgctccgagtgcgagtacatccacaagaacaacagacaagaccagagcacctttgagtgccagcagtgcagtttcaaagtgcacgcggactacaatgccgccaagaacattagcgtgtacaacatcgagaaggtcatccagaagcagctcgaactccaggagaagctgaatcagaccaagtacaaggaacagtacatcgagcagatgaagaacatcaactga

SEQ ID NO: 3328 - DNA, 1332 bp, Unknown
  Bacillus sp. multi
atgaagtaccagatcgtctgccctgtgaacatcgagtggaagaccttcgaaatctacctccgcaccctctcgtaccacttccggaccatcggcaaccgcaccatccagaagctctgggagtacgacaaccagagcctcaagcacttcaaggacaccggccagtacccttccgctcagcagctatacggctgcacccaaaaaactatcagcgggtatatctatgaccagcttaaggaggagtaccaggacattaacaaggccaatatgagtacgacgctccagaaaactatccgtacctggaactcccgcaagaaggaaatctggagtggcgagatgagtatcccgagtttccgaaacaacctgccgattgacatacacggaaacagcattcagatcattaaggagaagtccggcgactatatcgcaagtgtctccctgttcagctccaagttcatcaaggagaacgacctgccaaacgggaagatcctagtgaagctgagcacccgcaagcaaaacagtatgaaggtgattctcgaccggatcattgacagtacctacgcaaaaggggcgtgcatgttgcacaagcacaaaaagaagtggtacttgtcaattacatacaagtccaacatcaaggaggaattgaaattcgacgaagacttgataatggggattgacatgggcaagataaacgtactatactttgccttcaataagggacttgtgcgtggggcgatctctggtgaggagattgaggcgtttcgcaagaagatagagcacaggagaatctcgctcctcaggcaagggaagtactgctccggcaatcgaatcgggaagggccgcgagaagcggattaagcctattgatgtgctgaacgataaggtggccaagttccgtaacgcgacgaaccacaagtacgccaactacatcgtgcagcaatgcctcaagtacaactgtggcactattcagttggaggacttgaaagggattagcaaggagcagaccttcctcaagaactggacgtacttcgacctccaggagaagatcaaaaaccaggcgaaccagtatggcgtcaaggtggtgaagatcgacccctcctacacctcgcagcgttgcagcgagtgtgagtacatccacaagaacaaccgacaggaccagtcaaccttcgagtgccagcagtgcagcttcaaagtccacgccgactacaacgcagctaagaacatatcagtttacaatatcgaaaaggtcattcagaaacaactggaactacaggaaaagctgaaccagacgaagtacaaggagcagtacatcgaacagatgaaaaatatcaactga

SEQ ID NO: 3329 - DNA, 1332 bp, Unknown
  Bacillus sp. multi
atgaagtaccagatcgtgtgtcctgtgaacatcgagtggaagacgttcgaaatctacttgagaactctctcctatcacttccgcaccatcggcaaccgcaccatccagaagctctgggagtacgacaaccagtccctcaagcacttcaaggacaccggccaataccctagcgcccagcagctttacggctgcacccagaaaacaatcagcgggtacatctacgaccagcttaaggaggagtaccaggacatcaacaaggcgaatatgagcactaccttgcaaaaaaccatccgaacctggaacagtcgcaagaaggagatatggagtggggagatgtcaatcccctcctttcgcaacaacctcccaattgacattcacggcaattctatccagatcattaaggagaaaagtggagactacatcgccagtgtttcgttattctccagcaaattcatcaaggagaacgacttgccaaacggcaagatcctcgtgaagctcagtacgcgcaagcaaaactctatgaaggtcatcttggacaggataatcgactctacctacgcaaagggtgcctgcatgttacacaagcacaaaaagaagtggtacttatcaatcacatacaagagcaacatcaaggaggaattgaaattcgacgaagacttaatcatgggcattgacatggggaagataaacgtgctttacttcgcgttcaacaagggacttgtacgcggggcaatctccggcgaggaaatcgaggctttccgcaagaagatagagcatcgtcgcatctcgctcctaagacagggcaagtattgctccggaaaccggatcgggaagggtagggagaaacgcattaagccgattgacgtcctcaacgacaaggtggccaaattccgtaatgccactaaccacaagtacgcgaactacatcgtgcagcagtgccttaagtacaactgcggcaccatacagctagaggacttgaaggggatttcgaaggagcagacattcctcaagaattggacctacttcgacctccaggagaagatcaaaaaccaggccaaccagtacggtgtgaaggttgtgaagatcgaccccagttacaccagccaaaggtgtagcgagtgcgagtacatccacaagaacaacaggcaagaccagtccacgttcgaatgccagcagtgctcattcaaggttcacgcagactacaacgccgccaagaacatctctgtttacaatatcgagaaggtcatccagaagcagcttgagttacaggagaagttgaaccagactaagtacaaggagcagtacattgagcagatgaaaaatatcaactga

SEQ ID NO: 3330 - DNA, 1362 bp, Unknown
  Bacillus sp. multi
gtcacgtacctctcgattgccgtcaaggtcatgaagtaccagatcgtgtgccctgtgaacatcgagtggaagacgttcgagatatacctccgaaccctatcgtaccacttccgtaccatcggcaaccgcaccattcagaagctgtgggagtacgacaaccagtcccttaagcacttcaaagacaccggccagtacccctctgcccagcagctatacggatgcactcagaaaactatctccggctacatctatgaccagcttaaagaggagtaccaggacattaacaaggccaatatgagcactacgttgcagaagacaatcagaacctggaactcacgcaagaaggaaatctggagcggcgagatgagcatcccgagcttccgcaacaacctgccaatcgacattcacggcaacagcatccagatcatcaaggagaagtcaggcgactacatcgcgtctgtgtcgttattctcaagcaagttcatcaaggagaacgacttgcccaacgggaagatactcgtgaagttgtcaacccggaagcagaacagcatgaaggtgatcctggaccggatcattgactccacgtatgcaaagggtgcttgcatgttacacaagcacaagaaaaagtggtacttgtctatcacttacaagtcaaacattaaggaggagttgaaattcgacgaagacctcattatgggaattgacatggggaagataaacgtgctctacttcgccttcaataaggggctagtccgtggtgcaatctccggggaggagattgaagcgttccgcaagaaaatcgagcacaggagaatcagcttgctgaggcaagggaagtactgctccgggaaccgcatcggaaaggggcgtgagaagcgcatcaagcctatagacgtcctcaacgataaggtggcaaagttccgcaatgctacaaaccacaaatacgcgaactacattgtgcagcagtgtctcaagtacaactgcgggacgattcaactcgaagaccttaagggtatcagcaaggagcaaacattcctcaagaactggacctacttcgacttacaggaaaaaatcaagaatcaggcgaaccagtacggagtgaaggtcgtcaagatagacccgagttacacctcccagcgatgttctgagtgcgagtacatccacaagaacaaccggcaagatcagagtaccttcgagtgccagcaatgctcgtttaaggtgcacgccgactacaatgcggccaagaacatctctgtttacaatatcgagaaggtgattcagaagcagctagagttacaggagaagctgaaccagactaagtacaaggagcagtacatcgagcagatgaaaaatatcaactga

SEQ ID NO: 3331 - DNA, 1362 bp, Unknown
  Bacillus sp. multi
gtcacgtacctttccatcgccgtgaaggtgatgaagtaccaaatcgtgtgcccggtgaacatcgagtggaaaaccttcgagatatacctccgcaccctaagttaccacttccgcaccattgggaaccgcaccatccagaagttgtgggaatacgataaccagagcctgaaacacttcaaggataccggccagtacccatccgcccagcagctctacggatgcactcaaaaaactatctctggctatatctatgaccagctcaaagaggagtaccaggacattaacaaggccaatatgtcaacaactttgcagaaaaccatccgcacctggaactcacgcaagaaagagatttggagcggtgagatgtcaatcccgtcgtttcggaacaacctgcccattgacattcacggcaactccattcagattatcaaggagaagtctggggactacatcgcaagtgtgtcactctttagcagtaagttcatcaaggagaacgacttgccaaacgggaagattctcgtcaagctgtcaactcgcaagcagaacagtatgaaggtcattctggacagaatcatcgacagcacctacgcaaaaggagcctgcatgttacacaagcacaaaaagaagtggtacttatccatcacctacaagagcaacatcaaggaggagctgaaattcgatgaagacctgataatggggattgacatggggaagatcaacgtcctttacttcgctttcaacaagggtctggtacggggtgcgattagcggggaggagatcgaggctttccgcaagaagattgagcacaggcggatctcactcctccgtcagggaaagtattgctcgggaaaccgcatcggcaaggggagggagaagcgcattaagcccattgacgttctcaacgacaaggtggccaagttccgcaacgccaccaaccacaagtacgccaactacatcgtacagcagtgcttgaagtacaattgcggcacaatccaacttgaagacttaaagggaatttcaaaggagcagactttccttaagaactggacctacttcgacctacaggagaagatcaaaaaccaggcgaatcagtacggggttaaggtggtgaagatcgacccctcatatacctcccagcgctgttccgagtgcgagtacatccacaagaataaccgccaggaccagagcacctttgagtgccagcagtgctccttcaaagtgcacgctgactacaacgccgccaagaacattagcgtgtacaacatcgagaaggtgatccagaaacagttagaactccaggagaaactgaaccagacgaagtacaaggagcagtacatcgagcagatgaaaaatatcaattga

SEQ ID NO: 3332 - DNA, 1362 bp, Unknown
  Bacillus sp. multi
gtgacttacctctctatcgccgtgaaggtgatgaagtaccaaatagtgtgtcccgtaaacatcgagtggaagacgttcgaaatctacttgcgtaccttgagctaccacttccggaccattgggaatcgaaccatccagaagctgtgggagtacgataatcagtcgctcaagcacttcaaggacaccggacagtatcccagtgcccagcaactctacggctgcacccagaagaccatctcaggctacatctatgaccagcttaaggaggagtaccaggacatcaacaaggccaacatgagtacaacgcttcaaaaaactatccgtacatggaactcacgcaagaaagagatatggagtggggagatgtccatcccctccttccgcaacaacttgcctatcgacatccacgggaactccatccagatcatcaaggagaaaagcggcgactacattgcgtcagtgagccttttcagcagcaaattcatcaaggagaatgatctcccgaacgggaagattctagtcaaactctccacccgcaagcagaactccatgaaggtgatattggaccggataatcgacagcacatacgctaagggtgcctgcatgttgcacaagcacaagaagaagtggtatctctccatcacttacaagagcaacattaaggaggagttgaaattcgacgaagacctcattatgggcatcgacatgggcaagatcaacgtattgtacttcgctttcaacaagggactggttcgcggagctatcagcggtgaggagatcgaggcttttcgcaaaaaaatcgagcacagaaggataagcctgctacgccagggcaagtactgttcgggcaatcggattggcaaggggagggagaagcgcatcaagcctatagacgtgctaaacgataaggttgcgaagttccggaatgccacaaaccacaagtacgcaaactacattgtgcagcagtgcctcaagtacaactgcggaaccatccaacttgaggacttgaaaggaatcagcaaggagcagaccttcctcaagaactggacctacttcgacctccaggaaaaaatcaagaatcaggccaaccagtacggggtgaaggtggtgaagatcgacccaagctacacttcacagcggtgctcggagtgcgagtacatacacaagaacaaccgccaagaccagagcacattcgagtgccagcagtgctccttcaaggtgcacgccgattacaacgcagccaagaacatctccgtttacaacatcgagaaggtgatacagaaacagcttgagttacaggagaagctaaatcagacaaagtacaaggagcagtatatcgagcagatgaaaaacatcaattga

SEQ ID NO: 3333 - DNA, 1362 bp, Unknown
  Bacillus sp. multi
gtgacgtacctatctatcgcggtcaaggtgatgaagtaccagatagtgtgtcctgtcaatatcgagtggaaaaccttcgagatatacctccggacactctcctaccacttccgcactatcggcaatcgcaccattcagaagctctgggagtacgacaaccagtccttgaaacacttcaaagacacggggcagtaccccagcgcccagcagctctacggctgcacccagaagacaatcagcggctacatctacgaccagctcaaagaggagtatcaggacatcaacaaggccaatatgtcaaccactttacagaaaacgatccgtacctggaactcccgcaaaaaggaaatctggagtggggagatgagcataccttcattccgaaacaatttgcctatagacattcacgggaactccatccagatcatcaaggagaaatcaggagactacattgcatctgtgagtctgtttagctcgaaattcattaaggaaaacgacctccctaacgggaagatactggtcaaattgagcacccggaagcagaactctatgaaggtcatactggaccgaatcatcgactccacctacgcaaaaggcgcgtgcatgttgcataagcacaagaaaaaatggtatctatctatcacttacaagtccaacatcaaggaggagttgaaattcgacgaggacttaatcatgggcatcgacatgggcaagatcaacgtgctttacttcgccttcaacaagggtcttgtgcgtggtgccattagcggggaggagatcgaggcgttccgcaagaagatcgagcaccgccgcattagcctgctcagacaggggaaatattgctccgggaaccgaattgggaagggaagggagaagcgtattaagcctatagacgtccttaacgacaaggtggctaagttcagaaacgccaccaaccacaagtacgccaactacattgtgcagcagtgcttgaagtacaactgcgggacaattcagttggaggacttgaagggtattagcaaggagcagaccttcctcaagaattggacctacttcgacttacaggagaagatcaaaaaccaggcgaatcagtacggagtcaaggtcgtgaagatcgaccccagctacacctctcagaggtgctccgagtgcgagtacatccacaagaacaaccggcaagaccaaagtaccttcgagtgccagcagtgcagtttcaaggtccacgccgactacaacgccgccaagaacatcagcgtgtacaatatcgaaaaggtgatccagaagcaattggagctacaggagaagctgaaccagaccaagtacaaggagcagtacattgaacagatgaaaaatatcaactga

SEQ ID NO: 3334 - DNA, 1362 bp, Unknown
  Bacillus sp. multi
gtgacttaccttagcatcgcggtgaaggtgatgaagtaccaaatcgtgtgccccgtgaatatcgagtggaagacattcgagatatacctcaggactctatcctaccacttcagaacaattggcaatcgcaccatccagaagctgtgggagtacgacaaccagagcctaaagcacttcaaggacacagggcagtacccctccgcccagcaactttacggatgcacacagaagaccatctccggctacatctacgaccagcttaaggaggagtatcaggacatcaacaaagcgaacatgagcaccaccttgcagaaaaccataaggacgtggaactcccgcaagaaagagatttggagcggcgagatgtcgatccccagctttcgcaacaacctccccatcgacattcacggaaactctatccagatcatcaaggagaagtctggagattacatcgcgtctgtcagcttattcagttccaaattcatcaaggagaacgacctgccaaatggcaaaatcctggtgaagctctcgacccgtaagcagaactcgatgaaggtcatcctcgaccggatcattgactcaacctacgcaaaaggtgcctgcatgttgcataagcacaagaagaagtggtacttatccatcacgtacaagtcaaacatcaaggaggagttgaagttcgacgaggacttaatcatgggaatcgacatggggaagattaacgtgctgtactttgccttcaacaaggggctggttcgaggtgctatcagcggcgaggagattgaggcgttccgcaagaagattgagcaccggagaatctcacttctccgacagggcaagtactgctctggcaaccgcatcggaaaggggcgggagaaacgcatcaagcctattgacgtcctcaatgacaaggtggccaaattccggaacgcgacgaaccacaagtacgctaactacatcgtccagcagtgtctcaagtacaactgcgggaccatccagcttgaagacttgaagggtatatctaaggagcagacattcctcaagaactggacttacttcgacctccaggagaagatcaaaaaccaggctaaccagtatggcgtgaaggttgtcaagatcgacccaagttacacatcccagaggtgcagcgagtgcgagtacatccacaagaataaccgtcaggaccagtcaaccttcgagtgccagcagtgctcgttcaaggtccacgctgactacaacgcggccaagaacatctccgtgtacaacatcgagaaggtcattcagaagcagttggagctacaggagaagctaaaccagaccaagtacaaggagcagtacatcgagcagatgaagaatatcaactga

SEQ ID NO: 3335 - DNA, 813 bp, Unknown
  Bacillus sp. multi
atgaaggtgatcctggaccggatcatcgactccacttacgcgaagggcgcgtgcatgttacacaagcacaagaagaaatggtatctctctatcacgtacaagagcaacatcaaggaggaattgaaattcgacgaagacctcataatgggcattgacatgggcaagatcaacgtcctctacttcgcgttcaacaaggggctcgtgcgcggtggcataagcggcgaggagattgaagcctttcgcaaaaagatcgagcaccggcgcatcagcttgctgcgtcaggggaaatattgctcggggaacaggatcggcaaggggcgcaagaagcggatcaagcctattgaagtgctgaacgacaagattgccaagttccgtaacgcaacaaatcacaagtacgccaattacattgtccagcagtgcctaaagtacaactgcgggactatccagttggaagacctccagggaatctctaaggagcaaaccttccttaagaactggacctacttcgacctacaggaaaaaatcaagaaccaggcgaaccagtacggcatcaaggtggtcaagattgatccgagttacacctcccagagatgttctgagtgcgggtacatacacaagaacaaccgtcagaatcagagtacattcgagtgccagcagtgcagcttcaaggtgcacgccgactacaacgccgccaagaacatatcggtgtacaacatcgaaaaggtgatccagaagcagctcaaattacaggagaagctcaaccttacgaagtacaaggagcagtacatcgagcagatggagaacatcaactga

SEQ ID NO: 3336 - DNA, 813 bp, Unknown
  Bacillus sp. multi
atgaaggtgattctggaccgcatcatcgactccacctacgcaaaaggcgcgtgcatgttgcacaagcacaagaagaaatggtatctgtcgatcacatacaagagcaacattaaggaggaattgaaattcgacgaagacctcatcatgggaatagacatgggcaagataaacgtgctgtacttcgccttcaacaagggcctagtccggggcggcatcagcggggaggagatcgaagcgttccgcaagaaaatcgagcacagacgtatctccctcctcagacagggcaaatattgttccgggaatcgtattgggaagggacgcaagaaacgtattaagcctatcgaagtgttgaacgacaagatagcaaagttccgaaatgccaccaaccacaagtacgcaaactacattgtacagcagtgccttaagtacaactgcggcacgatccaactcgaagaccttcaaggaatcagcaaggagcagaccttcctcaagaactggacatacttcgacctccaggaaaaaatcaagaaccaggcgaaccagtacgggatcaaggtggtgaagattgaccctagctacacgagccagaggtgctcggagtgcggctacattcacaagaacaaccgccagaaccagagcactttcgagtgccagcagtgcagcttcaaggtccacgccgactacaacgccgctaagaacatctctgtgtacaacatcgagaaggtgattcagaagcaacttaagctacaggagaagctaaaccttaccaagtacaaggaacagtacattgagcagatggagaacatcaattga

SEQ ID NO: 3337 - DNA, 813 bp, Unknown
  Bacillus sp. multi
atgaaggtcatccttgacagaatcattgactccacctacgctaaaggcgcgtgcatgttgcacaagcacaagaagaagtggtatctgagcatcacatacaagtcaaacatcaaggaggagttgaaattcgacgaagacctcataatgggaatcgacatggggaagatcaacgtcctctacttcgccttcaataagggcctcgttcggggtggtatcagcggcgaggagatagaggctttccgcaaaaaaatcgagcaccgccgcatcagtttgcttagacaagggaaatattgttctgggaaccggatcgggaaggggcgcaaaaagcggatcaagcccatcgaggtgttaaacgacaagatcgccaagttccgcaacgctactaaccacaagtacgccaactacatcgtgcagcagtgcctaaagtacaactgcgggaccattcagcttgaagacttgcaaggaatcagcaaggagcagacgttccttaagaactggacctacttcgacctccaggaaaaaatcaagaaccaggcaaaccagtacggcatcaaggtcgtaaagattgacccgtcctataccagccagcgatgcagcgagtgcgggtatatccacaagaataaccggcaaaaccagagcacgttcgagtgccagcagtgctctttcaaggttcacgcagattacaacgctgccaagaacatctccgtgtacaacatcgagaaggtcattcagaagcagttgaaactacaggagaagctgaacctcactaagtacaaggagcagtacatcgagcagatggagaacatcaactag

SEQ ID NO: 3338 - DNA, 813 bp, Unknown
  Bacillus sp. multi
atgaaggttatcctcgaccgcatcattgactcaacgtacgcgaagggtgcgtgcatgttgcacaagcacaagaaaaaatggtatctctccataacttacaagagcaacatcaaggaggaactcaaattcgacgaagacctcatcatgggcattgacatgggcaagatcaacgtcctctacttcgctttcaacaaggggttggtgcgcggcggtatctctggggaggagatagaggctttccgcaaaaagatagagcatcgtcggatcagcctcctgcgtcagggcaaatattgcagcggaaaccgtattggcaagggccgcaagaagcgcatcaagcctattgaagttctaaacgacaagattgccaagttccgtaacgctaccaaccataagtacgctaactacatcgtgcagcagtgtctaaagtacaattgcggcacgatccagttggaggatctccagggaatctctaaagagcagacctttctcaagaattggacctacttcgacctccaggagaagatcaaaaaccaggccaaccagtacggcatcaaggtcgtcaagatagacccttcatacacgagccagcggtgctccgagtgcggttacatccacaagaacaaccggcaaaaccagtccaccttcgagtgccagcagtgcagtttcaaagtgcacgcggactacaacgcggccaagaacatatcagtgtacaacatcgagaaggtcatacagaagcagctcaagctccaggagaagctaaaccttacgaagtacaaggaacagtacattgaacaaatggagaacatcaactga

SEQ ID NO: 3339 - DNA, 813 bp, Unknown
  Bacillus sp. multi
atgaaggtgatactggaccggatcatcgacagcacctatgcaaaaggtgcgtgcatgttacacaagcacaagaaaaagtggtatcttagcatcacgtacaagagcaacatcaaggaggagcttaagttcgacgaagacctcattatggggattgacatgggcaagatcaacgtcctttacttcgcattcaacaagggcctagtcaggggcgggatctccggcgaggagatcgaggcttttcgcaagaaaatcgagcaccgccggatttcccttctcagacagggcaagtattgctccgggaaccgcattgggaaagggcgcaagaaacggatcaagccaatagaggtgctaaatgacaagatcgccaaattccgcaacgcgactaaccacaagtacgcgaactacattgtgcagcaatgcttgaagtacaactgcgggaccatccagttggaggacttacaaggaatatccaaagagcagacattcctcaagaactggacgtacttcgacttacaggaaaaaatcaagaaccaggccaaccagtacgggatcaaggtggtgaagatagacccgtcctacacaagccagcgatgcagcgagtgcggctacatccacaagaacaaccggcaaaaccagagcactttcgagtgccaacagtgctccttcaaggtgcacgccgattacaacgccgccaagaacatctctgtttacaatatcgagaaggtgatccagaagcagctaaaactacaggagaaactcaacctcaccaagtacaaagagcagtacatcgagcagatggagaatatcaattga

SEQ ID NO: 3340 - DNA, 1353 bp, Unknown
  Bacillus sp. multi
ctgagcattgcggtcaaggtgatgaagtaccagatcgtgtgccctgtgaacatcgagtggaagaccttcgaaatctacctccggacactgagctaccactttcgcacaatcgggaaccgcacgatccagaagctctgggagtacgacaaccagtcattgaagcacttcaaagacacgggtcagtacccttccgcgcagcagctttacggctgcatccagaagacaatctccgggtacatctatgaccaactcaaggaggaataccaggacatcaacaaggccaatatgtccaccaccttgcaaaaaactatcagaacatggaactcccgcaaaaaagagatttggagcggcgagatgtccatcccctcattccggaacaacttgcccatcgacatccacggcaacagtattcagatcattaaggagaagtctggagactacatcgcgtcagtgagcctgtttagtagcaagttcatcaaggagaacgacttacctaatggcaagattctggtgaaattgagcacccgcaaacagaactccatgaaggtcatactggaccgcatcatcgactcaacatacgccaaaggcgcgtgcatgttacacaagcacaaaaagaaatggtatctcagcataacctacaagagtaacattaaggaggagttgaagttcgacgaagaccttatcatgggcatcgacatgggcaagatcaacgtgctctacttcgccttcaacaagggactcgtgcggggtgctatctccggtgaggaaattgaagcctttcgcaagaagattgagcaccgacgcatctctctgttgcgacaaggcaagtattgttctggaaacagaatcggaaagggccgtgagaagcgcatcaagccaattgatgtcctcaatgacaaggttgccaaattccgcaacgccacgaaccacaagtacgccaattacatcgtgcagcagtgcctcaagtacaactgcgggactattcaacttgaggacttgaaggggatctctaaggaacagacgttcctcaagaactggacgtacttcgatctccaggaaaaaatcaagaaccaggcgaatcagtacggcgtgaaggtcgttaagattgaccctagctacacaagccagcgttgctccgaatgcgggtacatccataagaacaaccgtcaagatcagtcaaccttcgagtgccagcagtgctcgttcaaggttcacgcggactacaacgccgccaagaacatcagcgtttacaacatcgagaaggtgatccagaaacaattggaactccaggagaagctcaaccagacgaagtacaaggaacagtatatcgagcagatgaagaatatcaactga

SEQ ID NO: 3341 - DNA, 1353 bp, Unknown
  Bacillus sp. multi
ctatctattgctgtgaaggtgatgaagtaccaaattgtctgtcccgtgaacatcgagtggaagacgttcgagatataccttcgaacacttagctaccactttcggaccattggcaaccgcaccatccagaaactgtgggagtacgacaatcagtcccttaagcactttaaagatacggggcagtacccctcggcgcagcaattgtacgggtgcattcagaaaacaatctccgggtacatctatgaccagctcaaggaggagtaccaggacatcaacaaggccaatatgtcaacaacgctccagaaaacgatccggacatggaactcccgcaaaaaggagatttggagtggggaaatgtccatcccgtcgttccgaaacaacttgcccattgacatccacggcaactccatacagatcatcaaggagaagtcaggcgactacatcgccagcgtttcactattcagttctaagttcatcaaggagaacgacctgccaaacgggaaaatcctggtcaaactatcaacacgcaagcagaactccatgaaggtcatcttggaccgcataattgacagtacctacgctaaaggtgcctgcatgttgcacaagcacaaaaagaagtggtatctctctatcacgtacaagtccaacatcaaggaggaactaaagttcgacgaagacttgataatgggcatcgacatgggcaagataaacgtgctctacttcgccttcaacaaggggctagtccggggcgctatctctggggaggagatcgaggcgtttcgcaagaagatagagcaccgacgtatatccctcctgagacaaggcaagtactgctctggaaaccgaatagggaaggggcgtgagaagcgcatcaagccaattgacgtcctaaacgacaaggttgccaaattccgcaatgcgaccaaccacaagtacgccaactacatcgtgcagcagtgcctcaagtacaactgcgggaccattcagctagaggacttaaaggggatcagtaaggagcaaaccttcctcaagaactggacttactttgacctacaggagaagatcaaaaaccaggcgaaccagtacggggtgaaggtcgtcaagatcgacccctcttacacatcgcagaggtgctccgagtgcggctatatccataagaacaaccgccaggaccagagcacctttgagtgccagcagtgcagcttcaaagttcacgccgactacaacgccgctaagaacatcagcgtgtacaacatcgagaaggtgatccagaagcaattggagctacaggagaagttaaatcagaccaagtacaaggagcagtatatcgagcagatgaagaacatcaactga

SEQ ID NO: 3342 - DNA, 1353 bp, Unknown
  Bacillus sp. multi
ctgtcaatcgcggtgaaggtgatgaagtaccagatcgtgtgtcccgtgaacatcgagtggaagacgttcgagatatacctcaggacgctcagctaccacttccgaaccattggcaacaggactattcagaagctgtgggagtacgacaatcagagccttaagcacttcaaagataccggccagtacccgtcggctcagcaactctacggctgcattcaaaaaactatctctggttacatctacgaccagctcaaggaggagtaccaggacatcaacaaggccaatatgtcaactacactccagaaaaccatccgcacctggaactcccgcaaaaaggaaatctggagcggtgaaatgagcatcccgtcgttccgaaacaatctccccattgacatccacggaaacagcatccagatcatcaaggagaaatccggtgactatatcgcaagcgtgtccttattctccagcaagttcatcaaggagaacgacctcccgaacggcaagattctcgtgaaacttagcactaggaagcaaaactctatgaaggtgatccttgaccggatcatcgacagcacatacgcaaagggagcgtgcatgttgcataagcacaagaaaaaatggtatttgagcataacctacaagtccaacatcaaggaggaattgaaattcgacgaagacctcataatggggatcgacatggggaagataaacgtactttacttcgccttcaataagggcctagttcggggagcaatcagcggtgaggagatcgaggcgttccgcaagaagatagagcatcgccggatttcgttgcttcggcaagggaagtattgctcaggcaatcggatcgggaagggtagggagaagcgcattaagcccattgatgttctaaacgacaaagtggccaagttccgaaacgccaccaaccacaagtacgctaactacattgtgcagcagtgcttgaagtacaactgcggcacaattcaacttgaagacttgaaggggatctcgaaggagcagacgttcctcaagaactggacctacttcgacctccaggagaagatcaaaaaccaggccaaccagtacggtgtcaaggtcgtgaagatcgaccccagttacaccagccagcgatgcagcgaatgcggctacatccacaagaacaaccgacaggaccagtcaacctttgagtgccagcagtgcagtttcaaggtgcacgccgattacaacgcagctaagaatatctccgtgtacaacatcgagaaggttatccagaagcagctagaactacaggagaagctgaaccagaccaagtacaaggagcagtacatcgaacagatgaagaacattaactga

SEQ ID NO: 3343 - DNA, 1353 bp, Unknown
  Bacillus sp. multi
ctctctatagcggtgaaggtcatgaagtatcagatagtgtgtcctgtgaatatcgagtggaagacgttcgaaatctacctcagaacactctcatatcacttccgcaccattggaaatcgcaccatccagaagttatgggagtatgataaccagtcgctcaagcacttcaaggatactggccaatacccaagtgctcaacagctctacggctgcatccagaagacgatcagcgggtacatctacgaccagctcaaggaggagtaccaggacatcaacaaggcgaacatgagcacaacacttcagaaaaccatccgcacctggaactcccgcaagaaggaaatctggagtggagagatgtctatccccagcttccgaaacaacctcccgattgacatccacggcaactccatccagatcattaaggagaaatctggagactacatcgcctctgtttcgctcttcagtagcaagttcatcaaggagaacgacctccctaacgggaagatcctggtgaagttgtccacgcgaaagcagaactccatgaaggtcatcctcgacagaatcatcgactccacctacgcaaaaggagcgtgcatgttacacaagcacaagaagaaatggtatttgagtattacttacaagagcaacatcaaggaggaattgaaattcgacgaggatctaatcatgggcattgacatgggcaagatcaacgtcctctacttcgccttcaacaagggacttgtgcgtggtgcaatcagtggggaggagatcgaggcttttcgcaagaaaatcgagcaccgtcgcatatctctactgcgacaagggaaatattgttccggcaatcgaattgggaaaggaagggagaagcgtattaagcctatcgacgtgctgaacgacaaggtggcaaagttccgcaacgcgaccaaccacaagtatgcaaactacatcgtgcagcagtgcctcaagtacaactgcgggaccatccagttggaggacttgaagggcatcagtaaggagcaaactttcctcaagaactggacctacttcgacctccaggagaagattaaaaaccaggcgaaccagtacggcgtgaaggttgtcaagatcgacccctcatacacttcccaaaggtgcagcgagtgcggttacatccacaaaaacaatcgccaggaccagtccacgttcgagtgccagcagtgttcattcaaggtgcacgcagactacaacgcggccaagaatatctcggtgtacaacattgaaaaggttatccagaagcaactggaactccaggagaagctcaatcagacgaagtacaaggagcagtacatcgaacagatgaaaaacatcaactga

SEQ ID NO: 3344 - DNA, 1353 bp, Unknown
  Bacillus sp. multi
ctgtccatcgccgtaaaggtgatgaagtaccagatagtgtgccctgtgaacatcgagtggaagacctttgagatatacctccgtacattgtcctaccacttccgtaccatcgggaaccgcaccatacagaagctctgggagtacgacaatcagagcctcaaacacttcaaggacaccgggcagtatccctccgcccagcagctttatggctgcatccagaaaacaatatccggctacatctacgaccagctcaaggaggagtaccaggacatcaacaaggcgaatatgtccacaacgcttcagaaaacaattcgcacttggaactctcgcaaaaaggagatatggagtggggagatgagcatcccgtccttccggaacaacctgcctatcgacatccacggcaactcgatacagatcatcaaggagaagtccggcgactacatcgcaagtgtgtcgttattcagcagtaagttcattaaggaaaacgacttacccaacgggaagatcctggtcaagctctcaacccgcaagcagaactccatgaaggtgatcctcgaccgtatcatcgacagcacctacgctaaaggtgcctgcatgttacataagcacaagaagaagtggtatctatccatcacctacaaatccaacattaaggaggagttgaagttcgacgaagaccttatcatgggaatcgacatggggaagatcaacgtactctacttcgcgtttaacaaggggttggtccggggtgcaatatctggggaggaaatcgaggctttccgcaagaaaatcgagcaccggcgaatctccctgttgagacagggcaagtattgctcggggaaccgcatcggaaaggggcgggagaagcggattaagcctatcgacgttctgaacgacaaggtggctaagttccgaaatgcaacaaaccacaagtacgccaactacatcgtacaacaatgccttaagtacaactgcgggaccatccagcttgaggacttgaaggggataagcaaggagcagacattcctcaagaactggacctactttgacctacaggaaaaaatcaagaaccaggccaaccagtacggagttaaggtggtgaagattgacccctcatacactagccagaggtgctccgagtgcgggtacatccacaagaacaacaggcaagaccagtccacgtttgagtgccagcagtgcagcttcaaggtccatgccgactacaacgccgccaagaatatcagtgtttacaatatcgaaaaggttatccagaaacaactagagttacaggaaaagctcaatcagaccaagtacaaggaacagtacatcgagcagatgaaaaacatcaactag

SEQ ID NO: 3345 - DNA, 303 bp, Unknown
  Bacillus sp. multi
ctccaggagaagatcaaaaaccaggcgaaccagtacggggtgaaggttgtgaagatcgacccgtcctacacctcccagcgatgctccgagtgcgggttcatccacaagaacaacaggcaagaccagtccactttcgagtgtcagcagtgctctttcaaggtgcacgccgactacaacgcagctaagaacatcagcgtgtacaacatcgagaaggtgattcagaagcaactagaactccaggagaaactcaaccagacaaagtacaaggagcagtacatcgaacagatgaagaatatcaactga

SEQ ID NO: 3346 - DNA, 303 bp, Unknown
  Bacillus sp. multi
ctccaggagaagatcaaaaaccaggctaaccagtacggggtgaaggtggtgaagatcgacccctcctacacctctcagaggtgctcggagtgcgggttcatccacaagaacaatcgtcaagaccagtccaccttcgagtgccagcagtgctcgtttaaggtccatgccgactacaacgccgccaagaacatctccgtgtacaacatcgagaaggttatccagaagcagttggagttacaggagaaactaaaccagaccaagtacaaggagcagtatatcgagcagatgaaaaatatcaactag

SEQ ID NO: 3347 - DNA, 303 bp, Unknown
  Bacillus sp. multi
ctccaggagaagatcaaaaaccaggccaaccagtacggcgtgaaggtggtgaagatcgaccccagctacacctcacaacgatgcagtgagtgcggcttcatacacaagaacaaccgccaggaccagtccaccttcgagtgccaacagtgcagcttcaaggtgcacgccgactacaacgccgctaagaacatcagtgtgtacaacatcgagaaggtcattcagaagcagcttgaattacaggagaagctcaaccagaccaagtacaaggaacagtacatcgaacagatgaagaatatcaattga

SEQ ID NO: 3348 - DNA, 303 bp, Unknown
  Bacillus sp. multi
ctacaggagaagatcaaaaaccaggccaaccagtacggggtcaaggtcgtgaagattgacccgagctacacctcccagcggtgctcggagtgcggattcatccacaagaacaatagacaggaccaaagtacattcgagtgccagcagtgctcattcaaggtccacgccgactacaacgcggccaagaacataagtgtgtacaacatcgagaaggtgatccagaaacagttggaactacaggagaagctcaaccagacaaagtacaaggagcagtacatcgagcagatgaaaaacatcaactga

SEQ ID NO: 3349 - DNA, 303 bp, Unknown
  Bacillus sp. multi
ctccaggagaagatcaaaaaccaggccaaccagtacggagtgaaggtggtcaagatcgacccctcatatacttcccagcgttgctcggagtgcggcttcatccacaagaacaaccgccaagaccagagcaccttcgagtgccagcagtgctccttcaaggtgcacgccgactacaacgctgccaagaacatctccgtgtacaacatcgagaaggttatccagaaacagcttgagttacaggagaaactaaatcagaccaagtacaaggagcagtacatcgagcagatgaagaacattaactga

SEQ ID NO: 3350 - DNA, 1332 bp, Unknown
  Bacillus sp. multi
atgaagtaccaaatcgtctgcccggtcaacgtggagtggaaggttttcgagacctacctgagaaccctctcctaccagtcgcgtaccatcggaaaccggaccatccagaagatatgggagttcgacaacctgtcccttaagcacttcaaggagaccggcgaatacccgtccgcccagcaactttacggctgcacccaaaaaactatcagtggctacatctacgaccagctcaaagaggagtacaaggatattaacaaggccaatatgtccacgaccattcagaagactctcaagaactggaactcccgcaagaaggaaatctggcgcggagaaatgtccatcccctcgttccgctctgacttgcctattgatattcacggcaattccatccagcttattaaggaaaagggaggggactacatcgccagtgtgtctctgttctcctcaaagttcatcaaggaaaacgatttgccaaatgggaagatcctggtgaaactcagcacccgcaagcagaactctatgaaggtgatcttagatcgcctgataaactccacctatagtaagggagcgtgcatgttacacaaacacaaaaagaaatggtatttgagtatcacctacaaatccaatatcaaggaggagttgaagttcgacgaggatctcataatggggatcgacatggggaagatcaacgtgctctacttcgccttcaacaagtcactggtccgaggagctatatcaggggaggagattgaggcttttcgcaaaaagattgagcacaggcgcatctcgctcctccgccaggggaagtactgctccggaaacaggatcgggaaggggagggagaagcgtatcaagcccattgatgttctgaacgacaaggttgcaaagttccgaaacgccactaaccacaagtacgcaaactacattgtgcagcagtgcttgaagtacaattgcggaaccattcagcttgaagaccttaagggtatatctaaggagcaaacattccttaagaactggacctacttcgatctccaggagaagatcaaaaaccaggcaaaccagtacggcgttaaggtggtcaagatcgacccctcctacacctcccagcggtgcagtgagtgcggctacattcacaaggacaaccgccaggaccagagtaccttcgagtgccttcaatgcagcttcaaggtgcacgcggactacaacgcggctaagaacatcagcgtttacaacatcgagaaggtgatccagaagcagcttgagctacaggagaaactcaacctcaccaagtacaaggaacactacatcgagcagatgaagaatatcaactga

SEQ ID NO: 3351 - DNA, 1332 bp, Unknown
  Bacillus sp. multi
atgaagtaccagatcgtgtgccccgtgaatgtggaatggaaggtcttcgagacctatctccgcaccctcagctaccagtcgcgcacaatcggcaatcgcacgatccaaaaaatctgggagttcgacaacttgtctctaaaacacttcaaggagaccggcgagtacccgagcgcccagcaactctacggctgcactcagaaaacaatctccggttacatctacgaccagctaaaggaggagtacaaagatattaacaaggccaacatgagtacgactatccagaagactctcaagaactggaactcccgcaagaaagagatatggcgcggcgagatgtcaatcccttccttccgcagcgacctccccatcgacattcacggcaactccatccagcttattaaggagaagggcggggactatatcgcaagtgtctcacttttcagtagcaaattcattaaggagaacgacctgccgaatgggaagatactggtgaagttgagcacaaggaaacaaaacagtatgaaggtgatcctcgaccgccttattaactcaacatatagtaagggcgcgtgcatgttgcataagcacaagaagaagtggtatctctcaatcacctacaagagcaacattaaggaggagttgaaattcgacgaagacctgataatggggattgacatggggaagattaacgtactgtacttcgcgttcaacaagagcttagttagaggagcaatttccggcgaggagatcgaggctttccgcaaaaagatagagcacaggcgcatcagcctgctgagacaaggaaagtattgctccgggaacagaatcggcaaagggcgtgagaagcggatcaagccaatagacgtgctaaacgataaggttgccaaattcagaaacgccaccaaccacaagtacgccaactacatcgtacagcagtgccttaagtacaactgcggcaccattcagttagaggatctcaaggggattagcaaggagcagactttcctcaagaactggacttacttcgacttacaggagaagatcaaaaaccaggcaaaccagtacggcgtcaaggtcgtcaagattgaccccagctacaccagtcagcgatgcagcgagtgcggctacatacacaaggacaacaggcaagatcagtccaccttcgagtgcctccaatgctcattcaaggtgcacgccgactacaatgcggccaagaacatctcggtgtacaatatcgagaaggtcattcagaagcagcttgagctacaggagaaactgaacctcaccaagtacaaggagcactacatcgagcagatgaaaaatatcaattga

SEQ ID NO: 3352 - DNA, 1332 bp, Unknown
  Bacillus sp. multi
atgaagtaccagatcgtgtgccccgtaaacgtggaatggaaggttttcgagacataccttcggacactctcctaccagtcccgtactattgggaaccgcaccatccaaaaaatctgggagttcgacaacctgtctctcaagcacttcaaggagaccggcgagtacccctccgcccagcagttgtacggctgcacacaaaaaacgatctccggctacatctacgaccaacttaaggaggagtacaaggacatcaacaaggcgaacatgagcaccaccatccagaaaacactcaagaactggaactctcgcaagaaagagatttggcggggcgagatgagtatcccctctttccgttccgacctacccatcgacattcacggaaactcaatccagcttatcaaggaaaagggaggtgactacatcgcctcagtgtcactgttcagttccaagttcatcaaggagaacgacctacctaacgggaagatcctggttaaactgtcaacccgcaagcagaactctatgaaggtgatcctggacaggcttatcaactcgacgtacagtaagggtgcgtgcatgttgcacaagcacaagaaaaagtggtatcttagcattacctacaaatccaacatcaaggaggagctaaagttcgacgaagacctcattatggggatagacatggggaagattaacgttctgtacttcgctttcaacaagagcttagttcggggtgccatcagtggcgaggaaatagaggcgtttcgcaagaaaatcgagcacaggcgaatctctctactccgacagggcaagtactgttccggcaacagaattggcaaggggcgggagaagcggatcaagcccattgatgtgcttaacgacaaggtggccaagttccgtaacgccaccaaccacaagtacgcgaactacatcgtccagcaatgcttgaagtacaactgcgggaccatacagcttgaagacttaaagggcattagcaaggagcagactttccttaagaattggacgtacttcgacctccaggagaagatcaaaaaccaggctaaccagtacggcgtaaaggtggtcaagatcgacccatcctacacctcgcagaggtgctctgagtgcggctacattcacaaggacaaccgtcaggaccagagtacgttcgaatgccttcaatgctcgttcaaggtccacgctgactacaacgccgccaagaacatcagtgtgtacaacatcgagaaggtcatccagaagcagttggagttacaggagaaactgaatttgaccaagtacaaggaacactatatcgagcagatgaagaacataaactag

SEQ ID NO: 3353 - DNA, 1332 bp, Unknown
  Bacillus sp. multi
atgaagtaccaaatagtgtgcccggtgaacgtggagtggaaggtgttcgagacctacctacgcaccctttcctaccagagccgcaccatcggcaaccgcaccattcagaagatatgggagttcgacaacctgtcgttgaaacacttcaaggagaccggtgagtacccttcggcacagcagctttacggctgcacgcagaagaccatctctggctacatctacgaccagctcaaggaggagtacaaggacatcaacaaggccaacatgagcaccactatccagaaaactcttaagaattggaactcccgcaagaaggaaatctggaggggcgagatgagcatcccatcgttccgctccgaccttcccatcgacatccacggcaattccattcagcttattaaggagaagggaggggactacatcgcaagtgtgagcttattctccagtaagttcattaaggagaacgacctcccgaacggaaagatcctagttaagctcagcacccgaaagcagaactccatgaaggtcatccttgaccgtcttatcaactcgacctactcgaaaggtgcctgcatgttgcacaagcacaaaaaaaagtggtatttgagcataacatacaagagcaacatcaaggaggaactaaagttcgacgaggacttgataatgggaattgatatgggcaagataaacgtactctatttcgccttcaacaagagtctcgtccgtggagctatctccggtgaggagattgaggcgtttcgcaagaagatcgagcacaggcgaatcagcctcctccgtcaggggaagtattgctccggcaacagaatcgggaaggggcgcgagaagcggatcaagcctattgacgtcctgaatgataaggtggccaagttccgcaacgccactaatcacaagtacgctaactacatcgtccaacaatgcttaaagtacaactgtggcaccatccagttggaagaccttaaagggatctcgaaggagcaaaccttcctcaagaactggacctacttcgacctccaggagaagatcaaaaaccaggccaaccagtatggtgtgaaagtcgtcaaaatcgaccccagttacacctcgcaaaggtgctccgagtgcggctatatccacaaggacaaccgccaggaccagagtaccttcgaatgcctccagtgcagtttcaaggtgcacgccgactacaacgctgccaagaacatatccgtgtacaacattgaaaaggtgatccagaagcagctcgaactccaggagaagctcaatctgacaaagtacaaggagcactacatcgaacagatgaagaatatcaactag

SEQ ID NO: 3354 - DNA, 1332 bp, Unknown
  Bacillus sp. multi
atgaagtatcagatagtatgccctgtgaatgtcgagtggaaggtgttcgagacctacttgaggactttgagctaccagtccagaaccatcggaaaccgcaccatccagaagatttgggagttcgacaacttgtcgctcaagcacttcaaggaaacgggcgagtacccatccgctcagcagctctacggctgcacccaaaaaactatctccggttacatctacgaccagcttaaggaggagtacaaagacattaacaaggcgaatatgagcacgaccatccagaaaacgctcaagaactggaactcacgcaaaaaggaaatctggcgtggcgaaatgagcattccgtctttccgatctgacctcccaattgatattcacgggaacagcatccagctcatcaaggagaagggcggggactacattgcctccgtgagcttgttctctagcaaattcatcaaggagaacgacctgcccaacggcaagatccttgtcaagctctcaaccaggaagcagaacagcatgaaggtcatattggaccggctcatcaactcaacctatagcaaaggtgcctgcatgttgcacaagcacaagaagaaatggtatctgagcatcacttacaagagcaacatcaaggaggagttgaagttcgacgaagacctcattatgggaattgacatggggaagataaacgtcctgtacttcgccttcaacaaatccctggtccgaggtgcgattagcggggaggagatcgaggctttccgcaagaaaatcgagcatcggaggatctccctcctgcgccagggcaagtactgctctggaaatcgtatcgggaaggggagggaaaagcgtattaagcctatagacgtcctcaacgacaaagtggccaagttccgcaacgccacaaaccacaagtacgcgaattacatcgtccagcagtgccttaagtacaactgcggcacgattcaattggaagacttgaagggtattagcaaggagcagacattcctcaagaactggacgtacttcgacttacaggagaagatcaaaaaccaggccaatcagtacggagtcaaagtggtgaagattgacccctcctatacaagtcaaaggtgtagcgagtgcggttacatccacaaggacaacagacaggaccagagcaccttcgagtgtcttcagtgttccttcaaggtgcacgccgactacaacgccgccaagaacatctcggtgtacaacatcgagaaggtcatccagaagcagttagagttacaggagaagctcaacctcacgaagtacaaggagcactatatcgagcagatgaagaacataaactga

SEQ ID NO: 3355 - DNA, 1353 bp, Unknown
  Bacillus sp. multi
ctgagtatcgcagtgaaggtcatgaagtaccagatcgtgtgcccggtgaacatcgagtggaagaccttcgagatataccttcgtactctcagctaccacttcagaacaatcggcaaccgaaccatccagaagctgtgggagtacgacaaccagagcctcaagcacttcaaggacaccggtcaatatccatcggcgcagcaattgtacgggtgcacgcaaaaaactatcagcggctatatctacgaccaactcaaagaggagtaccaggacatcaacaaggccaacatgagcaccacgctacagaagaccatccgcacctggaactcacgcaagaaggagatatggagtggcgagatgtccataccctctttccggaacaacctgcctatcgacattcacggcaactcaattcagattatcaaggagaagtctggcgactacatcgcctccgtctctctgttctcctccaagttcatcaaggaaaatgacttgcctaacggcaagatcctcgtgaagctctccacaaggaagcagaacagcatgaaggtgatcttggaccggatcatcgactcaacctacgccaaaggggcctgcatgttgcacaagcacaaaaaaaagtggtatctatcaattacttacaagtccaacatcaaggaggagttgaagttctaccaagacctaatcatgggaatagacatgggaaagatcaacgtgctgtacttcgctttcaacaaggggctggtcaggggtgccatcagcggcgaggagatcgaggcttttcgcaagaaaatagagcacaggcgcatctccctcctgcgtcaagggaagtactgctctggcaaccgtatcggcaaaggccgggagaagcgtatcaagcctattgatgtacttaatgacaaggtggccaagttccgtaatgcaactaaccataagtatgccaactacattgtgcagcagtgcctcaagtaccattgttctaccatacagcttgaagatttgaaaggaatcagtaaggagcagacactccttaagaactggacgtacttcgacctccaggagaagatcaaaaaccaggccaaccagtacggcgtgaaggtggtgaagattgacccgtcttacacaagtcagaggtgctcggagtgcggctacatccacaagaacaacaggcaagatcagagcaccttcgagtgccagcagtgcagcttcaaggtgcacgccgactacaacgctgctaagaacatatccgtgtacaacatcgagaaggtcatccagaagcaactagaactccaggagaaactgaaccagaccaagtacaaagagcagtacatcgagcagatgaagaacattaactga

SEQ ID NO: 3356 - DNA, 1353 bp, Unknown
  Bacillus sp. multi
ttgtccatcgccgtgaaggtcatgaagtaccagatcgtgtgccccgtgaatatcgaatggaagacgttcgagatatacctgcggaccctctcctaccacttcagaactatcggaaaccgaaccatccagaagctctgggagtacgacaatcagagcctcaagcacttcaaggacaccggccagtacccctctgcccagcagctctacgggtgcacacagaaaaccatctcaggctacatctacgaccagctcaaggaggagtaccaggacattaacaaggccaacatgagcacaactttgcagaaaactatccggacgtggaacagccgcaagaaggagatatggagcggagaaatgtcaatcccctccttcagaaacaacctcccgatagacatacacggaaactccattcagatcatcaaggagaagtcaggcgactacatcgccagcgttagcctctttagttcgaaattcatcaaggagaacgacctccccaacgggaagatccttgtcaagttgtccactcggaagcagaactctatgaaggttatcctcgacaggatcatcgactccacttacgcgaaaggagcttgcatgttgcacaagcacaagaagaagtggtatctgagcatcacatacaagagcaacatcaaggaggagttgaagttctaccaagacttaatcatggggattgacatgggcaagatcaacgtcctttacttcgctttcaacaagggcttagtgaggggcgctatctccggggaggagatcgaggcgtttcgcaagaaaatcgagcacaggcgaatctcactcttacgtcaaggaaagtattgcagtggcaaccgaattgggaaggggcgcgagaagcggatcaagcccattgatgttctcaacgacaaggttgccaaattccgcaacgccacaaaccacaagtacgcgaactacattgtgcagcagtgcctcaaataccattgttcaactatccagcttgaagacctcaaggggatcagtaaggagcagaccctgctcaagaattggacatacttcgacctacaggagaagatcaaaaaccaggccaaccagtacggagtgaaggtggtgaagattgacccgtcatataccagccagcggtgctcggagtgcgggtacatccacaagaacaacagacaagatcagtcaacgttcgagtgccagcagtgttccttcaaggtgcacgcagactacaacgcggccaagaacattagcgtgtacaatatcgaaaaggtgatccagaagcagcttgaactacaggagaagctgaaccagacaaagtacaaggagcagtacatcgagcagatgaaaaatatcaactag

SEQ ID NO: 3357 - DNA, 1353 bp, Unknown
  Bacillus sp. multi
ctctccatcgccgtcaaggttatgaagtaccagatcgtctgcccggtcaacattgagtggaagacattcgagatataccttagaacactctcctaccactttagaactatcggcaacaggaccattcagaaactgtgggagtacgacaatcagtcacttaaacacttcaaggacaccggtcagtatcccagcgcccaacagctctacggctgcacccagaaaactatatccggctacatatacgaccagttgaaagaggagtaccaggacatcaacaaggcgaacatgagcacaaccctacagaagacaatccggacctggaactcgcgcaaaaaggagatatggagcggggaaatgagtatcccttccttccggaacaacctccctattgatatacacggcaactcgatccagatcattaaggagaagtccggggactacatcgcctccgtctcgttgttcagcagcaagttcatcaaggagaacgaccttcccaacgggaagattcttgtgaagctatctacacggaagcagaacagcatgaaggtgatcctcgaccgcatcattgacagtacctacgcaaaaggtgcctgcatgttgcacaagcacaagaaaaaatggtatcttagcatcacttacaaaagcaacatcaaggaggagttgaaattctatcaagacctgattatggggattgacatgggcaagatcaacgtcctctactttgctttcaacaaggggctcgtccgaggtgcaatctcgggtgaggagatcgaggcgttccgcaagaagatagagcaccggagaatcagcctgctgcggcaaggcaagtactgctctgggaaccggatcggcaaggggcgcgagaaacgtatcaagcccatcgacgtattgaacgacaaggttgccaagttccgcaacgccactaaccacaagtacgccaactacatcgttcagcagtgccttaagtaccactgctcgacgattcaattggaagatttgaaggggatctctaaggaacaaacactccttaagaattggacctacttcgacctccaggaaaaaatcaagaatcaggccaaccagtacggggtcaaagtggtgaagattgacccttcctacactagccagcggtgctccgagtgcggctacatccacaagaataaccgccaggatcagagcacgttcgaatgccagcagtgctccttcaaggttcacgcagactacaatgcagccaagaacatcagcgtgtacaatatcgagaaggtgatccagaagcagctagaattacaggagaaactcaaccagactaagtacaaggagcagtacatcgagcagatgaaaaacatcaactga

SEQ ID NO: 3358 - DNA, 1353 bp, Unknown
  Bacillus sp. multi
ctctccatcgcagtcaaggtgatgaagtaccagatcgtgtgcccggtcaacatcgagtggaagacattcgaaatctaccttcgaacgctctcctaccactttcgcaccatcgggaaccgcacaatccagaaactctgggagtacgacaatcagtctctcaaacacttcaaggacacggggcagtacccttcagcccagcagctctatggctgtacccagaaaacaatatcgggctatatctacgaccagctcaaggaggagtaccaggacatcaacaaggccaatatgtcaacaactcttcaaaaaacgatccggacgtggaactctcgcaaaaaggaaatctggagcggggagatgtccatcccttcgttccgcaataacctgccgattgacatccacggaaactccattcagatcatcaaggagaagtctggcgactacatcgccagcgtctccctgttctcctcaaagttcattaaggaaaatgacctgcctaatggcaagatccttgtcaaattgagcacccggaagcaaaactctatgaaggtgattctggaccgcataattgactccacctacgctaaaggagcgtgcatgttgcacaaacacaagaaaaaatggtacttgtcgatcacgtacaagtcaaacattaaggaggagttgaaattctatcaagacctcataatgggaattgacatggggaagatcaacgtattgtactttgcattcaacaaggggctggtccgtggtgctatctccggcgaggaaatcgaggcttttcgcaagaagatagagcatcggcggatctccctcctccgtcaggggaaatactgctccgggaacaggatcggaaaggggcgcgagaagcggatcaagcctattgacgtgctcaacgacaaggtggcaaagttccgcaatgctacaaatcacaagtacgccaactacattgttcagcagtgcctaaagtatcactgctcgactatccagcttgaggacttaaaagggatctcaaaggagcagacactcctcaagaattggacctacttcgacctccaggagaagatcaaaaaccaggcgaatcagtacggggtgaaggtggtgaagatcgaccccagctatacctcccaaaggtgttccgagtgcggctacatccacaagaacaaccgtcaggaccagagcactttcgagtgccagcagtgctcattcaaggttcacgccgactacaatgccgctaagaacataagcgtgtacaacatcgagaaggtgatccagaagcagctcgaactccaggagaagctgaaccagacgaagtacaaagagcagtacattgagcagatgaaaaacatcaactga

SEQ ID NO: 3359 - DNA, 1353 bp, Unknown
  Bacillus sp. multi
ctctccatcgcggtgaaggttatgaagtaccagatcgtctgcccggtgaacatcgaatggaagacgttcgagatatacctccgcaccttgtcctaccacttccgcactattggcaacagaaccatccagaagctgtgggagtacgacaaccagtcgctcaagcacttcaaggacacgggccagtacccctccgcccagcagctttacggctgcacgcagaaaaccatctctggctacatctatgaccaactcaaagaggaataccaggacatcaacaaggccaatatgtccacaaccctccagaaaactattagaacctggaactcccgcaaaaaggagatatggagcggcgagatgtccatcccctctttccgaaacaacttgcctatagacattcacgggaacagcatccagatcatcaaggagaagtccggggactacatcgctagtgtgtcgctgttcagtagtaagttcattaaggaaaatgacctccccaacgggaagattctcgtgaagctctctacccgtaagcagaactccatgaaggtcatcctcgaccgtatcatcgactcgacctacgctaaaggagcctgcatgttgcacaagcacaagaaaaaatggtacttgtctattacctacaagtcaaacatcaaggaggaattgaagttctaccaggacttgataatgggcatcgacatggggaagatcaacgtgctttactttgccttcaacaagggcctggtcagaggcgcaatatccggtgaggaaatagaggcgttccgcaagaagatcgagcacaggcggatcagcctcctgcgtcaggggaaatattgcagcgggaaccgcatagggaagggccgcgagaagcggattaagcctattgacgtgctcaacgacaaggtggccaaattccgcaacgcgacgaaccacaagtacgcaaattacattgtccagcagtgcttgaagtatcattgctccacgattcaattggaggatctcaagggtatcagcaaggagcagaccttacttaagaactggacctacttcgacctacaggagaagatcaaaaaccaggcaaaccagtacggggtcaaagtggtgaaaatcgaccccagctatacaagtcagaggtgcagtgaatgcggctacatccacaagaacaatcgacaggaccagagcaccttcgagtgccagcagtgctcattcaaagtgcacgccgactacaacgctgccaagaacatctcagtttacaacatcgagaaggttatccagaagcagttagaactccaggagaagctgaaccagacgaagtacaaggagcagtatatcgaacagatgaagaatatcaattga

SEQ ID NO: 3360 - DNA, 594 bp, Unknown
  Paenibacillus thiaminolyticus (multi)
atgggaaagaggcgatggacagcctcccgtcagttccgccaattactagctaacgagacgatgttcggtagcgagttgttaaacttcgagtatgtccttattgacgtggccagatattccgaggaggagcttctcgcactgagcaacaccatcgggtccgttttcctactggaccagacagccgaccaagcagagttgctggatagactgggcaagctcatgcacactatacagcagctccctgaggacagccagcagcagctcgttgcgtggatggccaacattctaagtcaaaagctccctgaaaatgagcctcaattgcgtgagttgatccagaacgttaaaggcggagtgtcggtgatgggtcttgaaaaaactcttgatgctatcaagagggaggggagaagggaaggtcggagggaaggtttgagacaaggcttacaagagggaatccgggaaggcaaacaggaggggaaacgcgaggccaagaaggaagtggtgaaacagatgatcgccgaagatttggaccctgaactgatcgctcgggttaccgggttctcattggaaatgataactcagctaagggagcaataa

SEQ ID NO: 3361 - DNA, 594 bp, Unknown
  Paenibacillus thiaminolyticus (multi)
atgggaaaacggcgttggactgcttcgagacagttccgccagttacttgcaaacgagaccatgttcggttctgaattacttaactttgagtatgtcctgattgatgttgcgcgatactccgaggaggagctactcgctctttccaacaccatcggctcagtcttcctccttgaccagacggccgatcaggccgaattactcgatagactcgggaagttgatgcacacaatccagcagttacccgaagactcacagcagcagttggtcgcctggatggcgaacattctctcacagaagctacctgagaacgagcctcagttgcgcgaactcatccagaatgtgaaaggtggcgtgagtgttatgggacttgagaagacactcgacgccatcaagcgtgagggtcgtcgagaagggagacgtgaagggctcagacagggcctacaggagggtatccgggagggaaaacaggaggggaaacgtgaagccaagaaggaggttgtgaagcaaatgattgccgaggacttggaccctgagcttatcgctagagttacgggattctcacttgaaatgataacccagctacgagaacagtag

SEQ ID NO: 3362 - DNA, 594 bp, Unknown
  Paenibacillus thiaminolyticus (multi)
atgggcaaaaggagatggacagcaagtcgtcaattccgacagcttctggctaacgagacgatgttcggttctgaactcctgaacttcgaatatgtcctcattgatgtggcgcgttactctgaggaggagttgcttgccttgtccaacacaattggcagcgtctttctgctggaccagaccgccgaccaagccgagttactcgaccgtctcggcaaactaatgcacaccattcaacagttgcctgaggacagtcaacaacagttagtcgcctggatggccaacattctctcccaaaagttacctgaaaatgagccgcaattgagggagctgatccaaaacgtaaaaggtggcgtcagtgtgatgggtcttgagaaaacactcgatgcgattaagcgtgaaggtcggcgagaagggaggcgtgaaggactgcgacagggattacaggagggaatccgtgaggggaaacaggagggcaaacgcgaagccaagaaggaagttgttaagcagatgattgccgaggatctcgacccagagcttattgcaagagttactggcttttcacttgagatgataacgcagttgcgcgagcagtag

SEQ ID NO: 3363 - DNA, 594 bp, Unknown
  Paenibacillus thiaminolyticus (multi)
atggggaaacggcgatggaccgcatcaaggcaattccggcaattgcttgctaacgaaaccatgttcggcagtgaattgctcaacttcgaatatgtgttaattgatgtcgcccggtactccgaggaggaactgttagcactaagcaataccattggatcagtctttctcctcgatcagactgcggaccaggcagagttgttagaccggctcggcaaactaatgcacactatccagcaacttccggaggactctcagcagcagttggtggcatggatggccaacatcctgtcccagaaactcccagaaaacgagccacagcttagagagcttatccagaatgtaaaaggtggggtgtcagtcatggggttggagaaaaccctggatgctattaagcgggagggtaggcgtgaggggagaagggaaggtctaagacaaggactacaggagggcatcagggaaggaaaacaggagggcaagagggaggccaagaaggaggttgttaagcaaatgatcgcggaggatcttgatcctgagctaatcgccagagtcaccgggttcagccttgaaatgattactcaactcagggaacaatga

SEQ ID NO: 3364 - DNA, 594 bp, Unknown
  Paenibacillus thiaminolyticus (multi)
atgggcaaacgacgatggactgcatctcgacagtttagacagctacttgctaatgagactatgttcgggtctgaactgctgaatttcgagtacgtcctgatcgacgttgcccgctactcggaggaggagttgcttgcattatccaacaccattgggtcagtgttcctcctagatcagaccgcagatcaagcggaactacttgacagactcggcaagctgatgcacaccattcaacaactccccgaggacagccagcaacagttagtggcctggatggccaacatcctctcccagaaactccccgagaacgagccgcaactcagggagttgatccaaaatgttaagggaggtgtttccgttatgggattggagaagactcttgatgcgatcaagagggagggcagacgggaggggcgtagggagggattacgccaggggctacaggagggtatcagggagggcaaacaggaggggaaacgcgaggccaagaaagaggtggttaagcaaatgattgccgaagacctcgacccggaacttatcgcaagagttaccgggttctccttagagatgataacccagcttcgagagcagtag

SEQ ID NO: 3365 - DNA, 687 bp, Unknown
  Paenibacillus lentimorbus (multi)
atgccatacaggctactactgtaccaagttgagatatggcgttaccttatgaaggaccaggagaagacaaaaggaaaaccgaaaacttttagactcccaccaattgtaccaatagtgctctacaatggcaagcggcgctggacagcctcaagacaattccggcagctcctcgctaacgagactatgttcggaagtgaactgcttaacttcgagtacgttctaatagacgtggcacgctatacagaggaggagccgctcgccctctctaataccattgggagcgtattcttgctcgaccagaccgttgaccaggcagaattgttagaccgtcttggcaagctgatgcacacgattcaacaactacccgaagacagtcaacaacagttagtcgcatggatggcgaacatcctaagtcacaagctgcctgaaaacgagccgcagttgagagacttaattcagaacgtgaagggcggagtaagcgtaatgggccttgagaagacattagacgccattaagagggaaggtcgaagggagggcagaagggagggaaaacaggagggcaagcgggaggcgaaggaggaggttgttaagcagatgattgccgaagatttggacccagaactgatcgctagagttaccgggtttccacttgacatcataacacaactcaagaagcaatcacactaa

SEQ ID NO: 3366 - DNA, 687 bp, Unknown
  Paenibacillus lentimorbus (multi)
atgccttacagactccttctataccaagtggagatatggcggtacttgatgaaggatcaggagaaaacgaaagggaagccgaagaccttccgcctaccgcccatcgttccaatcgtcctctacaatggaaaacgtagatggaccgcttcccgtcaatttcgtcagttgcttgctaatgagaccatgttcggcagcgagttgctcaactttgagtatgtcctaattgacgttgcgcgatatactgaggaggagcccctggccttatcgaacactatcggttctgtcttcctcttggaccagactgtcgatcaggctgaacttctcgacagactcggcaaactaatgcacaccatccaacagctcccagaggactctcagcaacagctcgttgcttggatggcaaacatactgtcacacaaactgcctgagaacgagccacaacttcgggacttgatccaaaatgtgaagggtggggtgtctgtcatggggttggagaagacactggacgccattaagagggagggcagaagggaggggcgacgcgagggcaaacaggagggaaaacgagaagcgaaggaggaggttgtcaagcagatgatcgctgaggatctcgaccctgagctgattgcaagagttaccggttttcctttagacatcatcacccaactcaaaaagcaaagccattga

SEQ ID NO: 3367 - DNA, 687 bp, Unknown
  Paenibacillus lentimorbus (multi)
atgccttatcgccttctgctctaccaagtggaaatctggcgttacctcatgaaggatcaggaaaaaactaaaggaaaacctaagacgttccgtctcccacccatcgtgcccatcgtactctacaacgggaagcgcagatggaccgccagccgacaatttcggcagctcctggccaacgagactatgttcggatctgagctgctcaacttcgagtacgtgctaattgatgtggcccgctatacagaggaggaacctcttgcactttcaaataccatcggctccgttttcctgctagatcagactgtagatcaagcagaattactcgacaggctgggcaagttaatgcacactattcaacagctacccgaagactcccagcaacagttggtcgcgtggatggccaacattctgagccacaaattacccgagaacgagccacagttgcgcgacctcatccagaacgttaagggtggagtctcagtcatggggttggagaagacccttgatgccattaagcgtgagggacgtagggagggccgacgagaaggaaaacaggagggcaaaagggaggctaaggaggaagttgttaagcaaatgattgccgaagacttggaccctgaactgattgctagagttactgggtttcctctggacatcattacccagctcaagaaacaatctcattag

SEQ ID NO: 3368 - DNA, 687 bp, Unknown
  Paenibacillus lentimorbus (multi)
atgccgtacagattactactctaccaagtggaaatctggcggtacttgatgaaggatcaggagaaaacaaagggcaaacccaagaccttccgcctgcctcctatcgttcctattgtgctctacaacggcaaacggcgatggacagcttcgcgccagttccggcaactcttagccaacgagaccatgttcggttcagaactgctcaacttcgagtacgttctaatagacgttgcgcgatacactgaggaggagcctcttgcgctatccaacacaatcggatctgtgttcctgttggaccagactgtcgatcaggccgaactgcttgatcgcctcgggaagctcatgcacacaattcaacaattaccagaggatagccagcagcaacttgtcgcctggatggcaaacatactctcacacaaattgcctgaaaacgagccccaattgagggacttgatacaaaatgtaaaaggtggcgttagcgtgatgggtcttgagaaaacattggatgcgattaagcgggagggaaggagggaggggcgaagggagggcaaacaggagggaaagcgtgaagctaaggaggaagtcgttaaacaaatgatcgcggaagacctcgaccccgaacttatcgccagagtgactggatttccactcgacatcataacacagctcaagaaacagtcgcattag

SEQ ID NO: 3369 - DNA, 687 bp, Unknown
  Paenibacillus lentimorbus (multi)
atgccatacaggctactgctctaccaagtggagatttggcgttacctgatgaaggatcaggagaaaacaaaaggcaaacctaaaaccttccgtctccctcccatcgtgcctatcgtgctctacaacggcaagcggcgctggaccgcttcaaggcaattcagacaactgttggctaacgagactatgttcggttctgaacttctcaacttcgaatatgtgcttattgatgtagcgagatacacagaggaggaacctctcgctctctccaacaccatcggctccgtgttcttattagaccagaccgttgaccaggccgagctactagacagattggggaaactgatgcacaccattcagcagctcccggaggacagtcaacagcagctcgtggcttggatggcaaacatcctcagtcacaagctgcctgagaatgagcctcagcttagagacttgatccagaatgtcaaaggtggggtttcagtcatgggtttggagaagactcttgacgcgatcaagagggaggggcgtagggagggacgtagggaaggaaaacaggagggaaaacgcgaggctaaggaggaggtcgtgaaacagatgattgccgaggatcttgacccagaacttattgcacgggttactggctttcccctagacatcattacacagctcaagaaacaaagccattaa

SEQ ID NO: 3370 - DNA, 603 bp, Unknown
  Paenibacillus thiaminolyticus (multi)
atgcgtgaccaggaaaatgcgaaaggaaaacccaagaccttccgattacctcccattgtgccgattgtcctctacaacggcaaacggaggtggacagcctctcgccagttccgacaactactcgccaacgaaaccatgttcggctccgagttgttaaacttcgaatatgttcttatcgacgtggcgagatacacggaggaggagttgctggcattaagcaacacaatcgggagtgtgttcctgttggaccaaacggctgaccaaacggaattgctcaaccgattggggaaattgatgcacactatccaacaactccctgaggagtcccagcaacagctcgttgcatggatggccaacattctctcccaaaagctgccggaaaatgagccacagctacgagagttgatacaaaatgtgaaaggtggcgtttccgttatgggattggagaaaaccctggatgctattaagagggaagggaagcgtgaagctaaggaggaagttgtcaagcagatgatcgctgaggatctcgatccagagttaattgctcgtgtgacaggcttccctgttgacatcatcgcaaagttacgggaacaaagccattga

SEQ ID NO: 3371 - DNA, 603 bp, Unknown
  Paenibacillus thiaminolyticus (multi)
atgcgtgaccaggagaatgctaaagggaaacctaaaacattcagactcccacctattgtgccgatagtcctctacaatggcaagcggcggtggaccgcctcaaggcaattcagacagctcctcgctaacgagaccatgttcggttctgaattactgaacttcgagtatgttctcattgacgtggcacgctataccgaggaggaattgctggcacttagcaacaccatcggctcggtctttctcctcgaccaaacggcggaccagactgagcttctaaatcgacttgggaaattgatgcacactattcagcaattgcccgaggagtcccagcagcaattggtagcatggatggccaacatactgtcgcagaagctcccagaaaacgagcctcagctccgtgaacttatccaaaatgttaaaggtggagtctctgtaatgggtcttgagaagacgctggacgccattaagcgggagggcaagcgtgaagctaaagaggaagtggttaagcagatgatcgcagaggatctcgatcccgaacttattgctagagtgacgggtttccctgttgacatcatagcaaagctccgagaacaatcccactaa

SEQ ID NO: 3372 - DNA, 603 bp, Unknown
  Paenibacillus thiaminolyticus (multi)
atgcgggatcaggaaaacgcaaagggaaagccgaagacattccgactcccgcccatcgtgccgattgtgctctacaacggaaaacgacgctggaccgctagtcgtcagttccggcagcttctcgctaacgaaacgatgttcggaagtgagttactcaactttgaatatgtgctcatcgacgtagcccgttacaccgaggaggagctactcgcacttagtaataccattgggagtgtctttctactcgatcagaccgccgaccaaactgagttactcaaccgcctcggaaagctcatgcacaccatacagcaattacccgaggagtctcaacagcaattggtcgcctggatggccaacatcctttctcagaagttgcctgagaatgagccccaattgagagagcttattcaaaacgttaaaggcggagtgtcagtcatggggcttgagaaaacactggatgccatcaagcgcgagggcaaacgggaggctaaggaggaagttgttaaacagatgattgcggaggacttagacccagagctgattgcgagagtgaccggtttccctgttgacatcattgcaaagctgagggagcagagtcactaa

SEQ ID NO: 3373 - DNA, 603 bp, Unknown
  Paenibacillus thiaminolyticus (multi)
atgcgagaccaggagaacgcgaagggcaagcccaagaccttccggcttccaccaattgtgcccatagtcctttacaatggcaaacgtaggtggaccgctagtcgtcagtttagacaactacttgctaacgagactatgttcggttctgaactcttgaactttgaatacgtgctgattgatgtcgcgcgttacacagaggaggagcttttagcactgagtaacaccataggctccgtgttcctcctcgaccagactgccgaccagacggaactactcaatagactggggaagctgatgcacacgatacagcagttacctgaggaatctcagcagcagttagtggcgtggatggccaatatcctttcccagaaattgccagaaaacgaacctcaactccgtgaacttatccaaaacgttaaaggtggcgtgtctgtgatgggtttggagaagactctggacgctattaagagggaagggaagcgtgaggctaaggaggaagtggtgaagcagatgatcgccgaagaccttgaccccgaactgattgctagagtcacgggcttcccggttgacatcatcgctaagttaagggaacaatcacattga

SEQ ID NO: 3374 - DNA, 603 bp, Unknown
  Paenibacillus thiaminolyticus (multi)
atgcgagaccaggagaatgcgaaagggaagcctaagacgtttagacttccacctatcgttcccatagtcttgtacaacggaaaacgccgttggactgcttccagacaatttcggcaacttctcgcaaatgagactatgttcggttcggagcttctcaacttcgaatacgtgctgattgacgtcgcgcgatacactgaggaggaactcctcgcgctcagtaataccatcggttccgtattcctcctggaccagaccgccgaccaaactgagcttctaaacaggctaggaaagctcatgcacaccattcagcaattaccagaggagagtcaacagcagttggtggcatggatggcgaacattctcagtcagaagttacccgaaaacgaacctcaattgcgggagttgatccagaacgtcaagggaggggtttccgttatgggattggagaagactttagatgctattaagagggagggcaaaagggaggcgaaggaggaagtggtgaagcaaatgattgccgaagaccttgacccagaacttattgctagagtcactggattccctgttgacatcatcgccaaacttagagagcaatcacactaa

SEQ ID NO: 3375 - DNA, 450 bp, Unknown
  Stenotrophomonas sp. multi
atggcatcaccccggttgagatacggacgctattcccgcactggaaatgtctattccttgacgacaacaacacacgggagagagccattctttagtgatgcgggaaatgttgcagtgttagttgacgcattaaggttcgttgagcggtctggcatctctcactcactcgcttgggtggttatgccggaccaccttcattggctgatggaattgcagaagggtactctcgctcagtgcatggcgctcctcaagagccgctcctcaagacagttgaacagaatcagcggaaggaaagggccactgtggcaacatggctatcacgaccatgcagtgagaactgatgagtctctgcacgacaatgccatgtacattcttggaaatccagtgagggccggattggccggaggactgggagattatcctcacgcatggtgtcgctggcctctgtag

SEQ ID NO: 3376 - DNA, 450 bp, Unknown
  Stenotrophomonas sp. multi
atggcatccccacgactgcggtacggtcgctattcgcgtaccggcaatgtgtactcactgacaacaactacacacgggagggagccattctttagtgatgcgggcaatgtagctgtgctagtggatgccttaaggttcgtcgagcgatcaggaatctctcactcacttgcctgggttgttatgccagaccaccttcattggctgatggaattgcaaaagggcacattagcacagtgcatggctctactcaagtcccgatcctctcgccaacttaaccgtatcagtgggcgaaaagggccactttggcagcacggataccatgaccacgctgtgcgtaccgacgaatctctgcacgacaacgcaatgtacatcctgggcaatccagtgcgcgctggattggctggaggacttggggattacccacacgcctggtgtcggtggcccctttaa

SEQ ID NO: 3377 - DNA, 450 bp, Unknown
  Stenotrophomonas sp. multi
atggcgagcccgcgcctgagatacggacgttactcacgcactggaaatgtgtactcacttactactacaacacacgggagggagccgttcttcagcgatgccggaaatgttgctgttctcgttgacgctctcagattcgttgaaaggtctggaatctcacattccctagcgtgggtcgttatgccagatcatctccactggctaatggaactccagaagggaacacttgcacagtgcatggcgctgttgaagtcccgatcttcgcgccagcttaacagaatcagtgggcgtaagggtccgctgtggcaacatggctatcatgaccacgcggtgagaacggatgagtcactacatgacaatgccatgtacatcctcggaaatccagtgagggctggacttgccggaggactcggagattatccacatgcttggtgtaggtggcccctgtga

SEQ ID NO: 3378 - DNA, 450 bp, Unknown
  Stenotrophomonas sp. multi
atggcttcacctagactcagatatgggcgctattctcgaaccgggaatgtttactcgcttacgactactactcatggtagggaaccattcttcagcgatgccgggaatgtcgccgttctagttgatgctctccgattcgttgaacggtctggtatctctcactcattggcctgggtcgtcatgccggatcacttgcactggcttatggaacttcaaaagggaactctagctcagtgcatggccttacttaagagtcgatcatcacgacagttaaaccgtatctccggtcgcaaagggcctctttggcagcatggctaccacgaccacgcagttagaactgacgagtcactgcatgataatgccatgtacatcctcgggaacccagtccgcgctggcctagcgggagggttgggagattacccacacgcatggtgtaggtggcccttatga

SEQ ID NO: 3379 - DNA, 450 bp, Unknown
  Stenotrophomonas sp. multi
atggcgtctccgagattgcgctatggacggtacagcagaactggaaatgtctattcattgaccacaaccactcacggacgagagccgttcttcagcgacgctgggaacgtggccgtgctcgtggacgccctccgcttcgtggaacgaagtggaatctcgcatagtctcgcgtgggtggttatgccggaccacttacactggcttatggaattgcaaaagggaacacttgcacagtgcatggccctgttaaagtcgagatccagtcgccaacttaaccgtatttcggggaggaaggggccattgtggcaacatggctatcacgaccacgccgtcaggacggacgagagcttacacgacaatgctatgtacattctcggcaatcccgttcgtgctgggcttgctggtggtctgggagactacccacacgcctggtgtaggtggccattgtga

SEQ ID NO: 3380 - DNA, 20 bp, Artificial Sequence
  Synthetic Sequence
ttcggaatgggagtgagttg

SEQ ID NO: 3381 - DNA, 20 bp, Artificial Sequence
  Synthetic Sequence
gaaagctccattgttttaag

SEQ ID NO: 3382 - DNA, 12 bp, Artificial Sequence
  Synthetic Sequence
tttttttttttt

SEQ ID NO: 3383 - DNA, 103 bp, Streptococcus pyogenes
gccggccagcatttgaaacagttttagagctagaaatagcaagttaaaataaggctagtccgttatcaacttgaaaaagtggcaccgagtcggtgcttttttt

SEQ ID NO: 3384 - DNA, 30 bp, Unknown; identical to SEQ ID NO: 1129
  Bacillus sp. multi

SEQ ID NO: 3385 - DNA, 30 bp, Unknown; identical to SEQ ID NO: 1119
  Bacillus sp. multi

SEQ ID NO: 3386 - DNA, 37 bp, Unknown; identical to SEQ ID NO: 1277
  Bacillus sp. multi

SEQ ID NO: 3387 - DNA, 35 bp, Unknown; identical to SEQ ID NO: 1267
  Bacillus sp. multi

SEQ ID NO: 3388 - DNA, 67 bp, Unknown; identical to SEQ ID NO: 1425
  Bacillus sp. multi

SEQ ID NO: 3389 - DNA, 97 bp, Unknown
  Bacillus sp. multi
gtttagtactaacataagatgtatttaaatggtgtcattttaccatttaaggataagtttcctaaaagtttagtactaacacaagatgtatttaaat

SEQ ID NO: 3390 - DNA, 132 bp, Unknown
  Bacillus sp. multi
gtttagtactaacataagatgtatttaaatggtgtcattttaccatttaaggataagtttcctaaaagtttagtactaacacaagatgtatttaaatgagtctagtcagtaactcagtagtttgtccctcgt

SEQ ID NO: 3391 - DNA, 65 bp, Unknown
  Bacillus sp. multi
accttctatatcaggtgtaccgttagcgaacccctgcatttaaatacatcttatgttagtaccaa

SEQ ID NO: 3392 - DNA, 67 bp, Unknown
  Bacillus sp. multi
acttttaggaaacttatccttaaatggtaaaatgacaccatttaaatacatcttatgttagtactaa

SEQ ID NO: 3393 - DNA, 65 bp, Unknown
  Bacillus sp. multi
atttaaatacatcttatgttagtactaaaccttctatatcaggtgtaccgttagcgaacccctgc

SEQ ID NO: 3394 - DNA, 67 bp, Unknown
  Bacillus sp. multi
atttaaatacatcttgtgttagtactaaacttttaggaaacttatccttaaatggtaaaatgacacc

SEQ ID NO: 3395 - DNA, 72 bp, Unknown
  Bacillus sp. multi
gtactaaaccttctatatcaggtgtaccgttagcgaacccctgcatttaaatacatcttatgttagtaccaa

SEQ ID NO: 3396 - DNA, 74 bp, Unknown
  Bacillus sp. multi
gtactaaacttttaggaaacttatccttaaatggtaaaatgacaccatttaaatacatcttatgttagtactaa

SEQ ID NO: 3397 - DNA, 86 bp, Unknown
  Bacillus sp. multi
atttaaatacatcttatgttagtactaaaccttctatatcaggtgtaccgttagcgaacccctgcatttaaatacatcttatgtta

SEQ ID NO: 3398 - DNA, 88 bp, Unknown
  Bacillus sp. multi
atttaaatacatcttgtgttagtactaaacttttaggaaacttatccttaaatggtaaaatgacaccatttaaatacatcttatgtta

SEQ ID NO: 3399 - DNA, 65 bp, Unknown
  Bacillus sp. multi
cttctatatcaggtgtaccgttagcgaacccctgcatttaaatacatcttatgttagtaccaaac

SEQ ID NO: 3400 - DNA, 67 bp, Unknown; identical to SEQ ID NO: 1573
  Bacillus sp. multi

SEQ ID NO: 3401 - DNA, 64 bp, Unknown
  Bacillus sp. multi
gtttagtcctacgataagatcggtttaaatggtgtcattttaccatttaaggataaggttccta

SEQ ID NO: 3402 - DNA, 67 bp, Unknown
  Bacillus sp. multi
gtttagtactaacataagatcggtttaaatggtgtcattttaccatttaaggataagtttcctaaaa

What is claimed is:

1. A recombinant nucleic acid, comprising a heterologous promoter operably linked to a polynucleotide encoding a CRISPR-associated transposase with an amino acid sequence selected from the group consisting of SEQ ID NOs: 124-133, 135-246 and 275-287.

2. The recombinant nucleic acid of claim 1, wherein the CRISPR-associated transposase:
  a. is from a bacterium selected from the group consisting of *Lysinibacillus* sp., *Brevibacillus* sp., *Sphingobium* sp., *Undibacterium* sp., *Bacillus* sp., *Chryseobacterium* sp., *Sphingomonas* sp., *Labrys* sp., *Paenibacillus* sp., *Streptomyces* sp., and *Stenotrophomonas* sp.;
  b. is from a bacterium selected from the group consisting of *Brevibacillus brevis, Brevibacillus laterosporus, Brevibacillus parabrevis, Bacillus megaterium, Bacillus thuringiensis, Bacillus weihenstephanensis, Enterococcus faecalis, Undibacterium pigrum, Novosphingobium rosa, Labrys methylaminiphilus, Paenibacillus thiaminolyticus, Paenibacillus lentimorbus*, and *Paenibacillus terrae;*
  c. is associated in the bacterial genome with a CRISPR locus;
  d. is located in the same operon as a CRISPR locus;
  e. is located within 2.5 kilobases of a CRISPR locus;
  f. is encoded by a nucleotide sequence having at least 90% identity to a sequence selected from the group consisting of SEQ ID NOs: 1-123, 604-627 and 2020-3379; or
  g. any combination of (a), (b), (c), (d), (e), and (f).

3. The recombinant nucleic acid of claim 1, further comprising at least one polynucleotide encoding a guide RNA capable of hybridizing with a target sequence, wherein the guide RNA forms a complex with the CRISPR-associated transposase.

4. The recombinant nucleic acid of claim 1, further comprising at least one polynucleotide encoding a donor polynucleotide.

5. The recombinant nucleic acid of claim 1, wherein the polynucleotide encoding the CRISPR-associated transposase further encodes at least one nuclear localization signal (NLS).

6. A vector comprising the recombinant nucleic acid of claim 1.

7. A eukaryotic cell comprising the recombinant nucleic acid of claim 1.

8. A non-naturally occurring system for sequence-specific modification of a target nucleic acid sequence, comprising
  (a) one or more guide RNAs or a DNA molecule encoding the one or more guide RNAs, wherein the one or more guide RNAs are capable of hybridizing with the target nucleic acid sequence, and
  (b) a CRISPR-associated transposase having an amino acid sequence selected from the group consisting of SEQ ID NO: 124-133, 135-246 and 275-287 or polynucleotide encoding the CRISPR-associated transposase,
  wherein the one or more guide RNAs and the CRISPR-associated transposase do not naturally occur together.

9. The system of claim 8,
  (a) wherein the target nucleic acid sequence comprises a coding nucleic acid sequence, a non-coding nucleic acid sequence, or a combination of a coding and a non-coding nucleic acid sequence; or
  (b) wherein the target nucleic acid sequence comprises an endogenous gene or a transgene; or
  (c) any combination of (a) and (b).

10. The system of claim 8, wherein the system comprises a divalent cation.

11. The system of claim 8, further comprising a donor polynucleotide.

12. A method for sequence-specific modification of a target nucleic acid sequence in a cell, comprising providing the system of claim 8 to a cell that comprises the target nucleic acid sequence.

13. A method for sequence-specific modification of a target nucleic acid sequence in a cell, comprising providing to the cell a CRISPR-associated transposase comprising an amino acid sequence selected from the group consisting of SEQ ID NOs: 124-133, 135-246 and 275-287, whereby the target nucleic acid sequence is modified.

14. The method of claim 13, further comprising a guide RNA capable of associating with the CRISPR-associated transposase and hybridizing with the target nucleic acid sequence.

15. The method of claim 14, wherein:
  (a) the guide RNA is provided by expressing in the cell a recombinant DNA molecule encoding the guide RNA;
  (b) the CRISPR-associated transposase is provided by expressing in the cell a recombinant DNA molecule encoding the CRISPR-associated transposase; or
  (c) both (a) and (b).

16. The method of claim 14, wherein:
  (a) the guide RNA is provided by contacting the cell with a composition comprising the guide RNA or a recombinant DNA molecule encoding the guide RNA;
  (b) the CRISPR-associated transposase is provided by contacting the cell with a composition comprising the CRISPR-associated transposase or a recombinant DNA molecule encoding the CRISPR-associated transposase; or
  (c) the CRISPR-associated transposase is complexed with the guide RNA and is provided to the cell as a particle.

17. The method of claim 13, further comprising providing a donor polynucleotide to the cell.

18. A eukaryotic cell containing the non-naturally occurring system of claim 8.

* * * * *